United States Patent 9,487,797 (GENOMIC PLANT SEQUENCES AND USES THEREOF) - sequence listing, part 6

SEQ ID NO: 11039 - DNA, 1501 bp, Oryza sativa
tgtgatatgcatattgttggaaaatcaatgcattaaactttgaggacgttcatgtattgtgggaaacgtgcattgcacgtgcacgattacttgtagatgagtaaatagatgagcagagaggagtgaatgacaacatggctacaccatcatatcttgtgtctccgattcttatagaattatatgcaatccctcttgaactaccttggtagcaggaggtattgcataataatgtataccggccgcctgtgaaaatccttagtctgaaaaattgaatgtacacgggccctgtacatatatgggtttcattactttccgcgttcgtggatctggaaaatccaaaaatttacaaactgtggagagttcatctccatagctaggtagcgtagcgtgctattccccttctgtcatgtttacgttagtctctatcgcattgtccaagttaactatagcaacggtgttttgcacgtacaggtcaatactccatccgtttcacgatataagtcgttctaacattttctatattcatattgatgttaatgaatctagacatacatataaatttatctaaattcattaacatcaacataaatataaaaaatgacttacctcatctgtttcacaatgtaagactttctatcattgttcacatacatatagatgttaatgaatataaacacatatatatgtctagattcattaacatctaaatgaatatggacaatgctacaaagcactggtggagaaaccatctttcgtcggtcggccgaattccacaatagtcccggatgcaataaaaaccgggactaaagatgatctttagtcccggttcaaaagggtaacgggtaacaccaaccgggactaaagattcaaatgttgtcagggcatgtcaggccccccccccccgggatctttagtcagatctcggggatctttagccaaccgggactaaagtcccacccctatatatatatcttcttcctcctccagctgcccgagcaagcttcaaattttcttcaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagagagaaaaattgtgtggggaagaaagaatatatagaaatttagttgatttgttaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatggcattattgtatgactgtcattattgtaagaataattatttgtgtacggtttttttcgactcatgtaga

SEQ ID NO: 11040 - DNA, 1501 bp, Oryza sativa
cacgttcgttccctcgttctcgttcgctcgttcgcgttcacgttcgttcactcgttcacgttctcgttcacgttcgttctcattcacgttcgttcgctcgttctcgttcacgttcattcgctcgttctcgttctcgttcatgttcgttcgatcgttctcgttctcggtcacgttcgttccctcgttcacgttctcggtcacgttcgttcgctcgttcacgttctcggtcacgttgacgtgttcgttctctttcacgtgttcgttcacggcggtgtggcagcatcgggccggcgcgtggcgcggcggcgtggcgtggcggcggcgtggcgacggcgtggcgccgcggcggcgtggcggtgccgcgacggtggcatgccgcggcggtgtcgtggcttctcgtggcgcggcgtcgtcgtggcgcgacgtcgtggcgggcggcgagatacggagagagagagagatcgagattggagagagagagagatcgagggaggcggcggcggctctcaccccagagatgcggcagcggcggaggaggcggaggcggcggcgacgacgacgagctcgagacgacggcgagatacggcggcgtcggcgcggggatgccctaggcagtggcggcgaaggtctggccgagagagatcgatcggccgaaaacgtctaagtgttggtggagaagacgatggcgcaccgggaatatatataccccccggatctttagtcccggttgttctcatcaaccgggactaaagatcttatcccgctattttcaaattctttttaaacccggttagggttaagaaccgggactactgattatagcactgaatattattttcccttacatatgtgtttctaaaatagaagataatgcattacaattatttaaagtacaaagattaatgacaattacttcgaaaaattattgttgtctgtaataaattaagtggataaatcataataagcaaatatatgacttaaaattaataaaaattccaataatcatatatacttagcatatgaatgctattattaaattggtaaaaactctaattaacatatgtatgtacatatggcatgatttaaaattaataaaaattgtaatcatcatatatacttagcataggaattatattaaattaaatgttaaaaactctaattaacatatgtaaatgccacatgcatgatttaaaacttttaaaaattcgaatagtcatatataattagcatatgaatgatagtaatataaattgtgaaaaactctaattaacatatgtaaatgccacatgcatgatttaaaacttttaaaaattctctagtcaattataattagcatatgaatgatagtaaattaaatgttaaaaactctaattaacatatgaaattgccacctgcgtgatttaaaacttttaaaaattgtaagtatcacatataactagcatatacatgatttaaacttgttaaaacctgtaataatcgtgcgtaattaacatatgccata

SEQ ID NO: 11041 - DNA, 1501 bp, Oryza sativa
actatcaatatgcaaaaagctgcaaacaacacagaccttctgatgcttcaggatgttgtgaaacagctgtatagaacaaaatttgatgtcaaaatggtaacttaccaataaaattccttaacagggaaatgttttttaggcttggcatacctagatctgatcatatcaagaagacatggggcgacagctgatgcttccggatgcattgccatgcacttcatacagacaccgagcatgtataacaatttacctaggacaacaaagtagcgaccaaggaaatcgataccatattactaacgaagttcaacatgccattcttccttcacattagtttacactggtattttttctggataaaagggacacacaaattattcgtatcagttgggatgttgtgcattgtgatccttagcaatctcaattacttttctacatgctaaattacacattgcagagataatgtacaaaatcatcaatatgtacatgaatctaaaacaaaactgtggagaaagtttattagtattatgtagtacagatttatatagaggtgaattgaccctaagcataattcgtaaatttacaactaccaaatcaaatgcaagctatctacggatctaccagcgggggcgaagcccaatagaggcccgtgggtgcagatgaacccccctcaaacaaaatttttagttattacccccatatctcggccctatatgcaccccccttggcccaatatagtgcacccacagtccaaacaacagtccagttaacgttgtaagcccatgaggagagtcgaatccagatcaatcttttctcttctcgacttctcgtatgccgcgtcccgtcgctgccaatcttgacgactccgcctcgcatctgtttggcttccacgccactgctctgcaatcagccaatcccagtctcccagacaacacttgcccatctcggcatcgtgacgcgccgccgtcggccgtcgccctcggcagctcactgtcgctgtcgccgtcgcccctgcttgcttagtgcctacgttgctcgctccagccgcaggagccaggaaggcaggaaggcggtcgccaggcaacaagctaaccaggagcaagcgtcagaccacactttcacaagccatgaagccaacaatgacatcatccatctccatcaactgatcagcacacagccacattgtgcgttagtagagacaaggtaagaaagcatgcttcatctatttcttttttaatcaatttgatttattagatacaaaggcctaaaatttttattggttgtttttttttacattgtagaattaggaggccagtagggttcaatttggaatccttcagaattggaataaaattgcagattggggggaaatttgagaatttgagttgaaggtgctatttggatgtaagtcatatcaattttcattctacttctgtacttgaatgaatgataaaatcagtatatatttacatcctcctaaatcatctaatgataggttaattga

SEQ ID NO: 11042 - DNA, 1501 bp, Oryza sativa
cttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctgtctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaa

SEQ ID NO: 11043 - DNA, 403 bp, Oryza sativa
cgaggcctaccgctgtggctaagcggcggcgtgtgccagcccaacccccgacgacgacgacgcgtggcgacggccgccgcgacacccgccgccacgtcgccccgccacgcgccgccccccggcgagctcctcctcctcttttataatcccagcctcgtctcccccgcgatgaccacccccctcgccgcgccacgtacgccgcatcgcatgcgcgcgctttccctcgccagagcaagtagcccgccgcctcttcttcttcacctccgacgagcccttgcacccgcgtcgtcgtcttctccggcgccggtgctgttgctgcgtcctgcggtttcttgttcttctttgtttgttagcgacagggcggcggcggctcgccggagcagcggcagcagcaggagaagca

SEQ ID NO: 11044 - DNA, 1501 bp, Oryza sativa
tttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagcttgttgcctggcgaccgccttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaat

SEQ ID NO: 11045 - DNA, 1406 bp, Oryza sativa
ctgcggcccctcaaatactactgcaaaacattgtagcatattgcattagtagttcaattatagaggatccatatcgggagtagggcatatatgtttgtcggtgacatgggaccggggatatcttgactagaggtttgggcagccgcggtcacccacgtggcctgaccccctcggggggtcgggcccgaggttgatgaggccgcccctccctctatctccccgaggggtcgggccgctcccgtttcgaccccccgggggctggggcgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccgatcacagaccggtcagatcgcgggttagggggcaacaggcggcttgacacacgcctcgccccgtcccgtcggaatgatgagagcctccaggcactcgtccctagccagagccggcgtgggaactcctagagttggcacgtcagccccggccagatacattccaggcttcatcgcaaccattgcaaggaagtcattgtatgaagaagtgcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtccccacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaa

SEQ ID NO: 11046 - DNA, 1270 bp, Oryza sativa
ctccaaacttccaaaattctaaaaacaatgagtttttattgtacgtaaggtacatttaaaaggttaccagtcctgaaaactcaaaacctccagtgttatgtagcaccatccttgccactctcccattggatggctgagattcattctactgtttttgtccttttaccaatcctatgctcattatttactacattatgtggctctttatgcttgcattatcagattgtctttcacttgttaagattgttaccggtgaccagtattgttgtaactttgagaccactattatttttaattaattagattatgatgcaagaaattttaatagtatgcaatatacttcaataagatgacatctatttgtgtatttagatttttgaagaaaattgtgaatggttaaagattaactgtgaataccctgcaaaaaagtttaaatatgaatagtggttagtgataagtactaactctatcctaaaatatgagaaattttagagttgaacacgggtattaacaaagtaggtgaaattaaatgggggagttatgtgattgtatgagaagaggagtataagaagaatttgaagggtggaagattgttattggttgagaagagaatgtataggtggagaagttgttatattttgggataaatattaaatgttagaagttgttaaatattttaggatggagtgagtagtatacaaagcagtagtggaagtatatatatgatcataccgagaagaaaactaagctacacatagtgttttcttttttgagagggcacatagtgttttttctttaaaaaaaaactcattagatacacgtagttaacagcgacacaaaagagaaaaaaaataaatgtcactagccagatcgatcggtcggtcgtttccacacgtgcgcgcgtgcggcccggccacttgcgcgacgatgtgcgtgtgaacatggaaattaatcgctaatataaacgagtttctagctagccttcgcgctcgagccacactgtcgtgaagaaaaaacggttttaatttcgtagtaggttcatataaaaacttactctaacaataatatttctcacgtgaaaggtaaggaccacgtgccataattaaatcatgctaatgaataatttgtacacacgactgacttgtagtagtactgaactagctactactccagctaggaatagagtactggatagctactgcgtgaatatgtacgcgtcgatcgtcttgtgatgactaccaggtcgtctgttgactgatcgatctataga

SEQ ID NO: 11047 - DNA, 1501 bp, Oryza sativa
gttcggaatctttccccctaaacctcgccggcgcatcaatggcggccggatcttccgcgcccgtttccccctcatccggccgccctctctcactcccaaccctatataaaccctccccgtgcctccctccaccgtttccgccactcgccgctctctctccccgccggaatcgagctcgcaccgtcgccctctctctccgtcgtcgccgccgagctccggtccaccgccgttgtcgccccggaccacctctcccctcggcgccgcctccttcggcttcgccgcatccccggcgacctcgtccacccctccgtttcgctcgccgaccgccggagcaccgtcgaccccgtccacccgagccgcgccgccaccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgcccttaggtgcggctgacgcgtgggacccccggcgccggccggtgtgagcccgggtgcgcccggtccaccatggaccgtggggctgccgcgtgggccccacccccgtggacccggtccgcgcgcccctcccctcggctgaagcaataaatccattttttttaaattaaaatttaaatgaagaaattcgcaaatattcatttaaagagcatataaacttcaaatggccataacttggccatttgaacttggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttcaacatattgaatcccagcttataaaattatgttgctttaaattattgcattatcgctttatttaaattcccgcgttatcactgttttatctagccatgcctatttacctttgttatgaccttattattattgttattgttattattaccttgttcaccctagattaaacaaaaccccaactagtggacactctactcatggtaccactagtatggctttaggtagatgcttcgctggttaataggacaacattaggtggttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccactataaggactaa

SEQ ID NO: 11048 - DNA, 1501 bp, Oryza sativa
tgcatgcttggatgggggaggagtggcagcgggggagaaggagggaggacggtcgagggggtggaaaagcggtggcggagtggatgttgtgcgctcggtcaaaaagataaagaggaggaggggcaagatgcctaccggtttttttaaaaaaccgacacctatgcatactttataggtgtcgattctattaaaaaacaataactatagtattggtatcagttttttctctataactgacacctataatataagtataagcgacgattcttttaaaaaaccaacacctataatattgttattaattttttctgtagaaccgatacttatagtatttaaaggtgtcagttctatatttttttcaacatgtgaaagtggaaataggttcataggtgtcagctttaaactgacacctacgaaggattagtagtgattggctggtgtggctgatgcgttatacatcaaaagatgtatacgcgcgattaatttaactggtcaagcccatgacagctaaaaacaaaacctttcttggacaatagaaaacgaaaacatccgcctctgccatataaaaacttgaccaaagtcaggcatgattatgaagcactaattagtgcacatgatctaggtgtttggtctccctaatctcacaaaacaaagacatccacgaccatgaacacgcaaaacagctcatgcgacattctgtccaaacaacattatacacgcagacagcctatgtaccacatacacacatacaggaaagcaaatcatattaattagtcacggatgaacaatcacaacatcgacccctgctgatggtgatattttacatgatggccatctttcagtaacttcatctacaggaaattattatttttatataatttcatgaatggaatatatgcccccagtccccagatatatatatatatatatacacacacacacacaatgaaaattgttttttataagattgacaaacatggtacaatattaatttgacatccctataaaattttcaagtctaatataaacacacttctactcacaactgaattagtcttgtttgtgtggtgatagattccccacatagatcagaatccattttccatgaagcacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccat

SEQ ID NO: 11049 - DNA, 1501 bp, Oryza sativa
tttacagcaatggcatctcttgtccaacctcattcaggaattgcgcaacacacaatgtttggatcaatggtcatatcagtggaattcgcagcatttcctctccaggaaattctataatttgttctttgctcaaatccagcatgctgcacccatctcttggatatggaaaacaaatgcaccctaaagctgaaagtattcctctggttacttttgatggatagattaaacagcaaggacctcctacaaagaaaacatttcaatacccaaggaaatgatagatgtgtaacttgcaactccttgaccacagaagactcattccatctgtttttcacctgcagctttgctcagcaatgctggcacaacattggcattaatgggaattttcacacaaccttcatggacatgataatagaagcaaaagagaattttcaatttcctttcttcatggagacttttgcaatctgctgttggaacatttgaagcagaagaaatgattttatttttaataatgttccagtcaattttcaaaggtggagatctgatttcaaggaagagtttactctacatatgcatagagtaaagaaatctgaacaaaccctctggcaatcatggattcagccttttgattaattatttcccttccctctgtaattctcttctgtttttttctccttttgtaaattgttcccttggtttcttaacaaagcacagtaagagcctctcctgttgttttacccgtaaaaaatgggagtgataagtttgatcactcgacaagtgctatatgctcaacggctcttaattacagttttacttctgtttaaaacaaaatttagatccataaaaactcatgcaatttctagatataacagtattttaaacagtcatttttagacaagaaaaaaaattgaactttctttaatgtgcatgcttggatgggggaggagtggcagcgggggagaaggagggaggacggtcgagggggtggaaaagcggtggcggagtggatgttgtgcgctcggtcaaaaagataaagaggaggaggggcaagatgcctaccggtttttttaaaaaaccgacacctatgcatactttataggtgtcgattctattaaaaaacaataactatagtattggtatcagttttttctctataactgacacctataatataagtataagcgacgattcttttaaaaaaccaacacctataatattgttattaattttttctgtagaaccgatacttatagtatttaaaggtgtcagttctatatttttttcaacatgtgaaagtggaaataggttcataggtgtcagctttaaactgacacctacgaaggattagtagtgattggctggtgtggctgatgcgttatacatcaaaagatgtatacgcgcgattaatttaactggtcaagcccatgacagctaaaaacaaaacctttcttggacaatagaaaacgaaaacatccgcctctgccatataaaaacttgaccaaag

SEQ ID NO: 11050 - DNA, 638 bp, Oryza sativa
tatgatgaggacgtctgctctactctctccgtcttaaaatataagtatttttaacttcgatacagtcttcgatatgctattttgatcaataatatatataaaaataagatattttaaataaaaagagttttcatattataatagtttgtttaagataaatctaataacatcaattttatatgattgatcttttttttctataaatagttaaagtaaaaaagtatcacttgacactatgctaatattgcttatattttgggatggaggaagtgtattctcgccaagatagcatggaccgtttagattagtcttttccaaaacataacaattttaaaattaattataccgggttggacttggaatttagcattttattagtgtattccaaattcgaaattagtttactagaaagctgtaattgaagtaaagtatattcttattttaatttatgcgctataatttactagaaaattagtttactggaaaatttcaatatttataaaatcaataacagtagtctgtgcaactgcaacatatgggttagtaaccagtgccttatccatttgtgcttataatttcatcggttcttctcttgttgaattggcccttttatggatattatggatacacagacaaga

SEQ ID NO: 11051 - DNA, 1501 bp, Oryza sativa
taaatacaataccccctaggaggagaggggacacacccaccatagaacacaatcgacatagaagccacaacatagaagcgaacataagccaagacacgccgccggatatcgacttcagggataagcacggctagtcccctacggtgtctccggatactgtcaggagagacgaaagcgctctctctgatctcgccgggcacggattcgaggaggaaggctacccagttgttgactacgagtcagattgtcagactgccatgtcgacaacaattagataggctaccccaaatattgtactggtgtgattatggtgaataagatcaacgaccggcttcggccaacaggatgtagggttattacctgacaactcaggggcccgaacctgtataaaaatcctcttctctgtctcttttacctcagtctcgcgtatatcctagcaccgacgatccccatactatgcaaataccagaaccgtgacatcaaacgtcaacaaaccaataatcccaaaaataatcacataaatccaaaaaaaaaaacagtatggtaaacattactgaggtggtactgctcatagtccatgccctcacctcgtccacacacacacaccagtcatcacgcaccgcgaggctttgaccggcacagcggggcaatgggggaaaaaaagtagaggcggcagtcgacagctcggcacaaggactatcggcggcaacagatgcgtgacaggaggacggaggaggaggctgttggtgcgaaggtggcatggtgagggcaggaggcgggcgtcggcttggcgcgtcaggagaagcggcggacgggcaagtgcggctggggatgggggttcgagagttagggtttcagcaatgctaggctggtgggtttgggctggctgccaggctagctggctggtgtcacaccccaatctggcaccgccgtacaacagcacctgacaggagcgtgtcgtaggaaaaacggcgcgaaccgcttcctacgaaaccgcgatcacggtaccagtcccaggacatagtgctggtacccacggtgacaaatatgattcattgcaatccttaaaatatatagaggacttatttaccttaacttagattgcagctcagaatagcccgagaatgcaatcgatgacgcggacgaggaaacaccaacaacaacagcagcagcggaaccaacgaactaacacccaacaccacaggcgacggctgggaaccaggacgaaaccctaatcttcgcttcacttcatcttcaacttcagggccgaggaactatatatatatatatatataagaggaatggtttctggaatttatagaaataatattctcaagaatattattgacagtcaccaacgtgcgggaccaaaggaaatggtctatggaattttggaataaggcactgatttatgggacaaaggaaggagggatacgaaatagacttccctcgggcggcatgggcgtggcccgagagaaaggtgcggctcggccgagccaaa

SEQ ID NO: 11052 - DNA, 1501 bp, Oryza sativa
ccgcatcaagcttcgcatatatggctgtgttgtgatgcctcttttctcagcccatctccttttattttcattttcgtgtacacgctttttaaactgctaaacaatgtattttttaaaaaaaaattctatacgaaagttgcttgaaaaaatcaaattaattcatttttaaaaaaaaatattaaatacttaattaatcacgtgctaatagattgttccgttttccgtgatcactgtcccggatggtaacttgttctacgaacacacccaagttgttcgttgctaggccatatgctggccgttggtttccacttgtgcttcacttaggctgcgttcgttcacatgagaaaggggagattgtatctcgttttccgtatgcacgttttttaaactactaaacagtgtgttttttaaaaaaaatttctatagaaaagttactttaaaaaatcatattagtccatttttgaagtttaaaatagttaatactcaattaatcatgcgataatggcttacctagttttacgtatcttcccaatcttctcaattccctctccctcaaacacagccttagttcagtttcaatgtattgatttgacttattttaaagagaacttatcttttcattcacggtcgtctcaactgatttcttcgaaagtagtgtggagatgggcttagatgacttgtaagagttagaatatggtcagtacacccctcgtttcatactatcagtcgctttaatttttacctagtcaaacttttttacattgggccaagtttattaaaaaatataatatcattttcaataaaaaatattattaaaatatattcaattttacatttagtgaaaataattttattttttgagatccttctaaatttttctctaaacatagtaaaaactaaaaaagattgactaggcaaaagtcaaaacgacttataatataaaatagagagagtatatttatttttaataacttaaattaggtcaacaggggattaaagtatgtctaatttagttataaatgtttgtaaagttacatatgacgaaacagtctttattgtcactttttgttactaaaatgttttgatgtccgtttggatgatcctaatacgcaaagtctccagcgagatgatgccgcgagatccttctagcggacatgtttgtttcatttcatctatattgacaaatggaagcaacacaataaataatagaaacaacagcaaatactttaatgtgcatttacatttttgccaaatgtcataatttaaattaaaaattggttacataattgcataggatattgtgctggttgtttttggaattttggaatccctgaaactagtacatttttcctcattttctctgataacctagtatagtagttctatgtttccagaacgagttgcattgatacagtaatttgagacctctatttatagtgcatcttgtgcataaacccattccaaactaaaaggaagacaaaattaattggtagtgccatgg

SEQ ID NO: 11053 - DNA, 1501 bp, Oryza sativa
cctcctccttttcccaaagaagcaaagggcgagctcccctttctctccctccttttcccattttcctcccgccggcgtcatcctccctccgccctgtcgccgatttggacgcgagcgccgagcgccagctcgcgccttgaccgcccaagtcggtttccaaaccgacattgccgccctttaaagccccgggcgccctccctctcttctcctcccatcgcctccactccattgttgccgcccctctgtttcgccgacgccgttcgtcgttgcgcgcgtcggaggagccggcacgagcgaggacgcggaaggggactccgggcgctcgtcttcctcctcttccccggcccgaggccggagagattactcccgcaccgtcggcctctcgtcacagcgcccctcctcatctcggtagtgcctccctccgttcttcctcctcgctccacctctccccctaaattttcggtagtagctcgagtagcctccccgtagctagccggcgccgccccgaccgttgccgccgctcgccgtgtgctcgccgctgtcgccgcccgtgctccgtagcacccgcttgtcgccggcctcgctcggcgtagctccgctcaatccgacgctagcaacggattcccgtggccgcgtagatgctctcaccgccgggaattggcccctcgtgacctcgtcgccatttcccccttctcccgccgccgcttgccgccgccgcaattcgtcgccgtcaagctccctccgacgaatccgagccgttggctcgtctctcctcgacctgagcaaccacccggtgtgctcgctttcgcctgtatcgccgtggttcgctccgctgctcgccgctgtcgaccgccgtccgttccggcaggcgtcgtcgtctacctcccgccagcccgcgtggcagccacgtaggcgccacgtcggcgccagctcggccaagaccgggtcgagccgaccccggtcagcccctccccgtgcgcgcgttccaccgcgagccgtgaggctgcgcgtgggcccgccgcatccgtttcaccgcggaccacgcgcgtgcaccgcatcccttccccgcccgcgcgcgtgcgccgcgtgctccctccgcacggcgagccgagccgctgacaagcgggtcccactcgggaccgcgcgtggtgagcccggtctactggcgctctctctcctcccctcccgcgcgcgcgcgtcttgggccgccttgggccgcccagcccatttagctcggccggaccgccccaattctctcgggccgcgccctagccgcccgaggaaaagtctattttccctccctcttttcttttcttttcttttcttttccaaaaaggatttaattaaatccttttcctttagacaaaaatccaataatcttagaaattcaatatcttctcaaccgtaaatccgtttgactccgttcaacttccaaaattcctcaaatctcgagatctatctaatggcacgcttagaggtcattaatagggctttattttcg

SEQ ID NO: 11054 - DNA, 1501 bp, Oryza sativa
aaacaaaaaaggttgtattaagaaatcaaagctttacaaaattttaagtgaagtttcacaattttataattgaagttgcacatggttaaaaagtattgtttttgggatggagggtgcaaatgcactcgatcgaaaagaaaaatatgttctctgaatcgctcagcattcaacgcttagtgagggttagattacatacacattgaatctccttattaatatgcctagtacaagcatttttcaagcacacgagaaaacctactagcacttgctacatatcaccagtccaaaagcataatatttcagtacaagccatttcatgccattgcaaattagatggaagcaacagctacagaagcaaactcaacagctacagaagcaaactgagataaaatagtaaacgttgggactttacttattattagtatgtcaagtactaacttcttttaggcaagcataacaaaacctactagcatttgcaagttgcaacatatcgccagctctccccggaaaaaaaaaacatatcgccagttcatgccattgcatattggacggaagctgcatgtacagaagaaaatcaagctaaatagtgtccagctcttctagaatcacaaaatagtatccaactcttatgtacaaaaggtgttcattcccaacaaaaaatgctagtagatgtacagtctagcaaaaaacaactctatatatccctgtcaaaacaaatttgcaatcatctcatagcaaaacaaaaaaaaaagattcataccatcaattacagcgaaacatgcagataacaaaaaaaaatcaccatccatacaaccaaaattgcatacaaataaaagattaaccaaggaactgaaaagacaaacagattcttcagtacaagccagtttagtctatgcattgtgcaattggaaattggatggaagcaacaagaacagaactaggtatttgttcttaagtaaatgatgttaaactctgcaagtttagtctatgcattttgcaagtgtatgtgactgacaattaaggaaaaaacccgacaacaaaacttatgctgggaaataaaccaaaatattctaagaattctcattaatttgcaacttaagttgcacgtatttataactaaagttgtgcatatttataacttaagttgcacatgattgcatttttttattcttagaaaaatcacaaaaataggtaaaatacctagaggaaaatttcctagatacacaacagtagcaagtattcaagggtgcggaaataaaaaaaaatattactctaggtacctagatacacaatgcagcaagcattcaagggtggcaaaataaaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatg

SEQ ID NO: 11055 - DNA, 1501 bp, Oryza sativa
catccccaagcacggcaaccgaattcatcgccacatccagcgacgaggtgaatctgtgccactgccgccgagcttgaggggagagacgcacagaacagcgcgccggcgcgtgggagggtcggcctcgggcgccggaggggcggaggtggagctggagctggagcgtgaggaggaggaagaggcggcgacatcggcgtaggtcgacctccgacgaatgaggcggaggaagcgggggcggggctgccggcggagagaagggcatagcagggtataactttttcaaaaagacccctaaaacctcacatattacaaagaggtccaccgcagctattccacaccgttgatcatcgatccgacggctgagggagaggactaacgctggaatcgtattgtgccacgtggaggggttgtttgcacgcgaatcggcagagatttcgaaattagagattacgccaatgcatcaggtacaacatttatatcatccacgtatacgtggaataactgtaaaaaaacatttgtgattattattttttaatactaaactgcttaaaaatcgatcagttaaatttatccaccgtagtacaatcgttacgctaacgcgtcaggaacatcgctcatatcatacacatgtaaagtggaatattttaaaaaaaactttgtgattattattgaaatactagactgtttaaaaaattgttcagttaaattttatccatcgtgacatcactctgtgcgcaaatatagagcatattatttatctaaaaacaaacaattttttttgagcagattagttctctaaaccaaacaatactttttgatcgctatacacactccgtaaacacccggtgcaacgcacggtcacttttgctagtctatatatatatagcatgtagattcgatagtaaacaatttactagtaaatttgggaggggtagggggcgccggtggttggggtgcacgggggtgggttgggaggggtgggggtaggatgtgagggggagcattttagctactacgtacgccagatgcggtatagtatgtatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttccaaatttgcgccctctaatcatgcatacacattatgattagcactttccattttctatatcacatttccatatatacaacgtttgcatgcagatacttaccttttgaatcatgattcgtttttgaaaaatgacgccattccactaattgcgattattgccatctattttcaagattacattccattttcaagatgcacatataaccggctactgtattcctttttttgatttttcttttc

SEQ ID NO: 11056 - DNA, 1501 bp, Oryza sativa
ccttgggtgtgatgggcggcgctgccagctggccagcagcgggcttacatgggtacggtgggcttcctcgggtgcagctgatggtgggcttcctcgggcacattggctgacggcaggcttccttggcttggaaccggcgccagtagcctgtcccacgcggatccagcataggggccctccctcgcggggatgtgatgccgacgatgacagagggcagtggggacgacagatccgacagcgacggcaggtggtggggccagcagccggcggcgcatctgatgcgcaggggtgctggctcaggcggtagcagcggcgccgccccgcgcggatccgtctacaatggcggcgggctagggttcggccgggttttttccatttttaattttctttcacagaatttgtttttgcatgcggtctgattttcgcagatttttgggtgcatgcggttggcattggccgcatgtgaaatcacttttgacagtttgtaaaactgatttttgtaatagtgagaaacgaagttgaaacgacggtcgttacgtctctccccttggaattttttttatttataattttttttattaaaagttttacaaaaataattttccattttgaaaattgacggaaggagtcgcctaccgccctctgggagaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctcagctagggcgattttgtactgtggggggggccgcctgcaaatgggcggcgaggggggcatggaattttgcaggcggcccccttgccgccctccgctagggcgattttgtactgtgggggggggccgcctgcaaatgggcggcgagggggcatggaattttgcaggcggcccccttgccgccctgggggagggcgatttttgcctctccccctataaagcccagtcccttctctgtgaaatttcattatattcactaaaaatccaaaaaaaacaaaagagagagaggggagggcagcagaaggggagcggcgaagccctgctggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 11057 - DNA, 1501 bp, Oryza sativa
tctgaacaaactccctaccaccaggtgagtgtttattacttaccggagtaagtaacggttgtttgcacgtactagtctgtcctaaaaaaagccaaactctggctataaatctggacacacatgtgtccaggttcatagttaggattggacttttttcaggacggaggggtagataagtgtgttagtgggcaattaaccacgtgagtgttgtcggctaggtcctgctgcctgccagtcgttagataagccgttgcttgattggtgtgtgtgcctattaagataccccgcgttttactgtgcgatttataaatgtgtatatgttaaatatttttgaaatgatcaaagttaaaatgttgaaacaataatgtgagcaagataatttgacacatacttgttgatctctatataatataatattgtagatgatgtgtcatgtttgcatgggttttgttagtgagtgaagaagtggcatgcttgcatgggtttttaaatggactaaaatagtaattactagtgggtgatgatgtgatatgcttgcatgttgagttttagcttctaataattgttaatggtaccaactatatagaaagtataaattaagtatatgaaactatagattaagtatgtactgtaaatcatcttgttctgtgagtgagtgaaaaggaaaaaaaaaagcactggtgtgctgcagggtttaccttaccgccggggccagggttaccgcgccccggcggtaagcacggttaccgctcggtaaccgcggtaaccgtgaaaaaccgtacaaaaccgtgcaaaatttatcaaaaattcaaattattttttaaatttatttgtatttaaggaagttaccacggtatttatattaccgtacccccgcggtaagcccggtaaccgcggtaaccgcgcggttaccggcggtgagttaaaccctggtgtgctgtgcagcagcagaagaaaaagaagacctccattgtgtctgcgcttctctttcctgagccaaacacggtgtgttaatgtgtgggatcttaattcttaattgttcggacgaatttttgaataataagaataatcaaacgttataaaaaaaaattaaaacggtaaatattttggaacggtgggagtaattgtgagctgggccatggaggacagaagccagggggcggactggcagaggcaaaaggccggagacacgaggagatgggtggccggaggagttgcggagagacagcaaggggagcgaattttttttatttttaattttttttattaaaagttttacaaaaataattttctattttgaaaattgacggaagtagtcgcctaccgccctctgggaaggcgatttttaaaaatcgccctcctagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggc

SEQ ID NO: 11058 - DNA, 1501 bp, Oryza sativa
ctatcaatatgcaaaaagctgcaaacaacacagaccttctgatgcttcaggatgttgtgaaacagctgtatagaacaaaatttgatgtcaaaatggtaacttaccaataaaattccttaacagggaaatgtttgtttaggcttggcatacctagatctgatcatatcaagaagacatggggcgacagctgatgcttccggatgcattgccatgcacttcatacagacaccgagcatgtataacaatttacctaggacaacaaagtagcgaccaaggaaatcgataccatattactaacgaagttcaacatgccattcttccttcacattagtttacactggtattttttctggataaaagggacacacaaattattcgtatcagttgggatgttgtgcattgtgatccttagcaatctcaattacttttctacatgctaaattacacattgcagagataatgtacaaaatcatcaatatgtacatgaatctaaaacaaaactgtggagaaagtttattagtattatgtagtacagatttatatagaggtgaattgaccctaagcataattcgtaaatttacaactaccaaatcaaatgcaagctatctacggatctaccagcgggggcgaagcccaatagaggcccgtgggtgcagatgaacccccctcaaacaaaatttttagttattacccccatatctcggccctatatgcaccccccttggcccaatatagtgcacccacagtccaaacaacagtccagttaacgttgtaagcccatgaggagagtcgaatccagatcaatcttttctcttctcgacttctcgtatgccgcgtcccgtcgctgccaatcttgacgactccgcctcgcatctgtttggcttccacgccactgctctgcaatcagccaatcccagtctcccagacaacacttgcccatctcggcatcgtgacgcgccgccgtcggccgtcgccctcggcagctcactgtcgctgtcgccgtcgcccctgcttgcttagtgcctacgttgctcgctccagccgcaggagccaggaaggcaggaagccggtcgccaggcaaccagctaaccaggagcaagcgtcagaccacactttcacaagccatgaagccaacaatgacatcatccatctccatcaactgatcagcacacagccacattgtgcgttagtagagacaaggtaagaaagcatgcttcatctatttcttttttaatcaatttgatttattagatacaaaggcctaaaatttttattggttgtttttttttacattgtagaattaggaggccagtaggggtcaatttggaatccttcagaattggaataaaattgcagattggggggaaatttgagaatttgagttgaaggtgctatttggatgtaagtcatatcaattttcattctacttctgtacttgaatgaatgataaaatcagtatatatttacatcctcctaaatcatctaatgataggttaattga

SEQ ID NO: 11059 - DNA, 1501 bp, Oryza sativa
ttttggactcactgtattcaagccaactttcaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgacccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagctggttgcctggcgaccggcttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaata

SEQ ID NO: 11060 - DNA, 362 bp, Oryza sativa
gacttctagaaagtaaaaaaaataaacccgttgataatcatattagatttttaaaatctcaatgacaataaaacggagaagcagcgggcggggtgtataagagtatagttgcagagccgccgacggttgacaggacttctagaaaataaaaaataaattccaactatagttatgtttgatttttttaatcacaatgataataaagagtagacagcggacgggctatagaggggcatagtggcattgttttatgggacttctaaaaattataaaaagtaaaattataagtccaatttttaaaggctcggaacttctaagaagtaaaaaaacaatgataatcatgttcaattttaaaatcgtaa

SEQ ID NO: 11061 - DNA, 501 bp, Oryza sativa
atatatatatatatatatatatatatgaatgtggataatgttagaaactcttataatatgaaacggatgaagtaatattttagagaaaaaaaatgaaaactaaaactacacgtctaaccgagggagtaatatataagcaggcattttattcgcgatttcgcatcggtttcttcgtcaactgatccaattaattcatcgatcgtccctgaattcaaacagtacttacattatatagtttggcaagtaacacggaaattaacgtcagctctagcagctatatatatataacattctacctgttcagacaaacattcaatcgtgctcgattgacctcactaattcatccctgtaaccagctaccacttcaattttcccgcgcaaacgccttaataattagatcgagtacgataatctgacgttcttgtgctaaccaaattataaggggacgatcagcctaagtaggagtaggcgagtagctatcatccgagacaatggggttcg

SEQ ID NO: 11062 - DNA, 1501 bp, Oryza sativa
aattaaaacataaagaatattaaaagatgaatttagagtccatatagaaatataattaaaaacaacggaaattcagaattaaaaaataggaatattgaaagatgagtctagagtttatataggaatttagaacaaattgaaagtcaaaattaagaaaaataataaaagtagagtttagagtccatatataaatacaatttataaataactaaaattcaaaattttaaaaataagcatgattaggagaagagtctagagtccatataggaatataatttagaaataagtaaaattcgaaattagaaaataattaatcactgtcaatacagtacaaaattcaaaattatgttgctattttaaatatattttaataaaaaaaatatgaaaaatatttaagctgttatatgagaaaaaacataacgatgctagccgcgcaatctgtgcgggccaccatgctagttatattatgatataaaggtatcgagcattttggcataattcctatcatacaccaatgaattatgactttctatgcttctcccattgcaacctagcattgttgacgatggatactcgcggaccggatgagttaagtattgaagtacgttggaacgagggtctacgtagtacgacatcaagcaaacaaaagatacggattatactgcttcaggccccttgtcaggtaatagccctagtccagtttatatgagattgatgacgataagaacatattacaaagagagtatttgaaacagatggtaccaacgagatcgtagtcaagggattcgacaagatctcccgacgacttggctccatgcattccggctttgtaaactttggtgggtgtgtggtcgatgagatgcgatgcccttcgcctccccctaggggtcccttttataccgtgtaataccttgaccctcaagtaagacttagggatatgtaaaccgacatgatataccaaagattttaccctttccgagtagaacttcggcaatttcttaactcatagagatattttccataacttgagacgagttcctaacggcgtatatggaaacgatccgtatacgtgaaggtataccttatcggtatatttcataagttgtaggatagagggtatgccttatccataaccttgacagtggcccccgacttcaacttaaatgaattcatgttatcgcatgcgacttctcccgatagtgcgttgtcgtactcgctaggtcaatctcggttgtttaaccgtagagacacggagctatcgacaacacttacagggaacccatcgatgcggattttgaatttaaattgaagtctgaacaacggtctccaacgggccttaggaattttcagcggcaatctctcccctttcctcgaaatacgaaccgccaggtagtgctcctatttaatggaattttgagatccatttcaagtccgcttgccagaaaacccttactattccccggcttcctcagactctacgtttccccaatcctcaacaccc

SEQ ID NO: 11063 - DNA, 1501 bp, Oryza sativa
gaatcaggcagcctctataccgatcagtattctgtgccgtacctaggggtgggtagcgagccagctcggctcggtctagctcgttatcctaacgacctaaaaaaccagctcggctcgactcgttgcaaagctcgagctggctcgtttggctcgcgagctaatgacctaaaacaccggcccaacaatttttgcaatggatacacaggtaagtgcagagaggtgctgaagctgaaccgataattgaagaactaaagtactaaacacgagatcaacaacaacaaatcaagcatttgctccgagatctggttgaggcagctcctccatggcagccggcggcgtggccacacaaccagcggcgaaccacggacgtggatgatgactggcacggtgtgggggcggcgtcgtggaatcgtgggtgatgagcggcggcgcgggcgcacgacactcactgctagagtgctggagcctggcgcggaggtggattggcggcggcggagcgacggtggattggtgacggtgaagcggcggagtgaagaggagaggaagatctggagaggcggcagtgcacgggatggtggcgctgtggcgggctggcggcgccgcgcggagtggagagaagaggagaggggacgcgagtcgcgatggtggcggcggagcgaacagggaagagggaagtggagcgaacagtcagctagggtttactagtctttaccttatgtccttatctgatgggcctatgcgcctacgggctttgtggtcttggcttagtgggctttgtggcttgctgttgttgagctgttggctaatgaaaagctcgttaaggctcgcgagtagagctagctcgagctggctcgttatctctaacgagctttaaagccagctctgctcgttaggaaatttaaacgagccgagccaagccgagcttatcacgagccacgagcttcctctccacccctagccgtaccccccactgacatactgtaggtctgtaggttttgctcagacgcggcctcgtttggacggcccaagtgggagacggctcaggtaggagcccacacggtttggaggccgccccacatgcgcatatgcgatcggtgagacggtgagcgagaccgagaccgtttgggccatcgtgcagcttgggcgagcccatacgattcggaggcaggccacgtgcgaccctgaggcctgagccgatacgacgcgatcggttcgatttgcgttgtcgagtccgacacatctcattcgatttcgatctcatctccaccgtacaacgtcttcccttcctcattgcccttgtcacgtacggatcagtagatcgcatcagatatcatatcctcctcccttcaattctctcctcgatcgccgccgcgcgtccgtgcgtgcgccgctacaaaaaaaaaaaaaaaacttggggtttcctcgccggcgccgcgccgatccaacaacgaactcactcaatcgccgcgagacacgatcgatcgagaaatcgagatggcgc

SEQ ID NO: 11064 - DNA, 410 bp, Oryza sativa
tcaacagcgtcatctattaaaaaacggagggagtagatcaatatgtgatatatcgctttcaaatttaacttatataaatagaaaaaataacaaattttaactttggatagaacgtgtaatccgtagtcaaattcgttttttttttaattttataaatcaaatttgaacttgtatgtttatggaaaaacatattacatgttgatctactataccaattatttttcacttttttaataaatttgatgtacaaaataaggaggtgtcctctcgagggatcagaatccgctcctacataaaataaatagatctaatacaatcaaatattctagagtgagaataaggacaaagaaaacggggcgaatagaataaagtgatctgagtttgttttttcatttttgtttatctgtagc

SEQ ID NO: 11065 - DNA, 1501 bp, Oryza sativa
ctaattaagccgtcattagcacatgtgggttactgtagcacttatggctaatcacggactaattaggcttaaaagattcgtctcgcgatttcccctataactgtgcaattagtttttctttttatctatatttaatgctttatatatatatccaaagatatgatgtgatgtttttgggaaaaaattttgggaactaaacgggcccttactgaaccgtaacttgccacttggtagggttaggccatgagcccatgacgagaggtaataaaggcttaaagctgcagaatctaggttggttggagtagtaaaaaagattcaaccgaggccaacgagatttcaactcccgcgtgataatcgaaaatgctattggtaccaacttgagataacctatactagtgtggtactgtggtggagtgatgttgtacagtacggagcgaatagacacggtggtgtggcatcgccggactatgaccagcgtgtcgtgaaccgcgagcgggatcccacatggacaacaaaggtcggatggggctaaaattttttactccctgtcacatcggatatatagatactaatttaaagtattaaatataaactaataaaaactaatttcataaattagctaatccactagacgaattttttaagtataattaattcataattagtaaatgtttactgtagcattacataggctaatcatagattagttaggctcggattaattaggctcaataaattcgtctcgcgaattagttcaaggtcatggaatgagttttataattaatctatgtttaatactatcaaatagcgtctaaacttccgatataatatgtactaaaatttagtctctgcaaagcaaacagggatcgatttcattggtagagtacgaagagattgagtagcgtgactccatggaggaaattgttagggaaagttcagttccgatcctaaagtcacgttccagcggtatcatctcggtacttacctactacaaacagaggtcgtgtcggtagaagccacacgcttagattaaggtctagtgtcagatccggacttggcgaagcaaaccccagacccacaatcccaggagtggcaagcggaacatgcatacaaccacccctttgtccaacaccaacgccaccgacaatttccgtcttgacttgaggctttgcgactcgacgagtgattggtggatcggtggcgtaatcgcggcttagactgcggatcagcggatgacagtctctccctaccccacaggccactcgcccactcgccgacacgcgctcgtgatgttgctatgctgcgtagtgtccgcgaactccgtgggcctccggctctctccgagtcgtcgggtgaaacgggccgccggcacgcgccacgcggccttcttctactacatggacgcgactgtttcggcgtgggaaagaaaaagtgtcgcggcgagccgccgaggcatcgcggctgcgctccgcagtcgcaagcggccaagcgcaacgacggc

SEQ ID NO: 11066 - DNA, 348 bp, Oryza sativa
ttatatttcacgccaattttcgtaggcggacgcataaaagatctgcctgcgaaaataaattttcataggcggacggtgagattcatcccggtttacatttttgtagacggtcatttggctccgagggtcatacctttctgaaaacataaaaggtcaacgttgctaaaaaatcgtttttctaatagtgagatggaccaattaaaagttcaatcttcggaaagaaaaaaaaaacaacgaagaaaagtgctcctaaaatataagttctttctccctaccaaatcaatttgacattattatggtactagtagttctcctaccactatatgtatgttccttcccttccgtagt

SEQ ID NO: 11067 - DNA, 1501 bp, Oryza sativa
gcttcacaaagcagataccggatttctcatattttgcaaaaacagttggaaaatttggggggggggtttgaataaactttatttaaaaatgcactttatatttttttgaatttaactaatttcaaagaacaagttttcatctattttctctcatccactttaacatttaaacctacgaggcatctagaagcttgttcttctatgtttacagcacttgctcttgcggtttatcaactcaatcagacataaaacatctaaattttacgaaagccgagaaattatgatcgtcctaggtaatacgtacaaaagtagtagcaaaaggtgaattatcctatgcatttgagatttcataattttacaggccatactctaatcctcttccacgactaactgtaagttcgattgggcaatactccctccattccaaaatataaggcataaccacccctaacccaaacaccaagaaaataattattatcatcttatagtttggatcatcctaataaatacaatgcatgtatccaatagaattagagaatataagagtggaggatttaaaaaaaataataatttaatggagaaggggtcatagttaattgtctacatgcatacatgtcttatattatggaatatcttaaaaaaagtggttgtgccttgtattatggaatggagggagtagcatctttgattgagtaatagattttaccacattgatagtattgaccaactaagaccagtgtttgcttcatgctatgatttttgaagtatcctactttttcaactaacaaatctatctaactacgaacttgccatttccctacagtacatataactagatagtatctcttcgtatcaattttctattcgtagttagatgtacttaacatggcaaatttctatacgaaatgaaaccgtcgtaaattccgtttcttataaatttgaataccaaatccagttttcttgtggaagtttttttcctaaggcatacataattttagctctttttcttggcaaaggcaatgtattttctcgaaggtttctaaaaaaccaaaacccatgaacaaactgcaaacagtgaccatgaattcctgtttaccagtagacccacttccctactaccagtctaccacactatgacactacccaacacagccgagtaaaagaaaatggaaaaagacaaggaaaataaaatgagaaaaacccaacaagaaaaggaaatcaaagctgggaaagaaatagaccctggagagagaaagcatccatccaaggtctcagtcacacctacaacaatgcatctctaactcccccccttctccctcttttcctctccatctcccttcttaacctccccaccctcttcttcctcacctcaagtcgtctcctcttcttcttctcttcttccttcctctcccaacaccaaaacccaagaaccccacaagtgcgggcgaggaggggagggaggcattaatggagccctctaccaagcagctcctccccatgc

SEQ ID NO: 11068 - DNA, 1501 bp, Oryza sativa
tgtacaccttagctcagagatctccaaaatctgcctcccagaagcgatcctataggccgggtcggggacaaagcttcagaatagcgtggggaaacagaccacggcggaccatgccacgctacgccgacaccgtagtccgtaaataccccctccctttacacgagatccacatggtcgtgggacacaaactatgcgaacgaatcgatcaagcacccttctttaatcaaaagtttttttttaaacacccgtctcgatctcaagtctacccctctttcgtctttcccgatccaaacaactagtagttttgtactaatccaaagtcgtctccaataattatccattataaaaggaacgcaacacacgcactccaggtaaaccctacgactccagctaataaacgcaaaggaggaaataaagcgaacgggagcgacaaggacggggaagattcgtgccccgattttttcgtgttcgagacgcgcagggaggggggaagagattgaggtggtgggaggatcggaataggatctggtgcccccctctcgtcgtggttgcgctctcatcaactcgactcgaccggtaatcgatcgcgactgccgccaccgcaacattctcatttctctctctcgtccccgccccacccccacccaccacaccacacccccgtctccgcgcgaaaattcccacgccacgcgcgccggaagagagggaaggcttttcctccgttctccgcccacgcgccgtcatcgctgcccgcctttcttcctccgctttgtttgggccggagcggggggcgcaccggcgccggcgacgtctctcttccgaatcgggtaagcgtcatctcgttccgatcttggatacaggttgcgtgagggagcttcgcggggcggggcggggtggggtggggtggggtgtggaatggggatttgaattctttggtttgatcttctcagttgcgccacctgcttcgggttcacgcctctctctctgccttgctctccgctttcccgcatgtgatgcttcctgcacgccttcgttttgttcttctcttttgctctttgctcttgcctgcacggttcgtcgtctgatccatccatacttttctgttggaaaaagaacgtgttgtttgaccaatcgaagcgttcgttctcgttttgttcttcgacttttagtttttatagacagctgctcctgcctggtggtttcctgtttttgatttcgtgctttttgttcctgatgatttgactcaggaggcgggagccagttcatggaatctggtggaattgatgctcaagtcagagcaatcgagcagcgcacaagattggagattcctatacgtgattgagattgcaaatgtggcgcctgttcaatgagttgtgggatgttctaggatctgggtttttctcatcgaggtttctttaatccagctcaaatctatttacacctcatccgtttgcaccgagatcatctctgtgtgtgtggtcaccgtgagattaggaggaga

SEQ ID NO: 11069 - DNA, 1501 bp, Oryza sativa
gcagcgccgcccgcgccggtcgtcgcgccgccggcccgccccgtcgacgccccgcggcgccgtggcggacgtggcggcggcggaggcggcggcgagctcgtggcgtggaagagtgtacggcaggagaggtgggagggtgcgctcgaggtggacggagagctgcctctctggctggtgggttaagcctcctactgattgcaaatctccctaaatatgacttgatttggcttttgccttctctccaccctaattaagtattcatgaacacaccataacctcagcattttataagatctgccggtggtcaagctaaggctagccgtgcatttttcattcaagaatgcgaatcttttctgttattttgattcaaaggtttcccagtactccatatcgctttcttgagatcatctataaactaaagatccttttgaacatcttagtaaaaaagcatgcacaacatcttcccacacattgagaaatacgaaaggcactttctggaccacatcactgtgcaacaaatcctttataattaacctaaccattttcatcttgtagcatctccttgattagtgcaggctaaccgctgacctagagcacatatatgcatatagccccagaagggtcctaaaaaggtaccagctttggccacgtacctagcatatttttaccagcagtatctaacacgccagggtatattacttgccgactgtcatttttaatttccactgtgccagcagttgctgaagcactcacccaaatcttcagtaatttgatcgacaaagaggagggcgacactaacttaccctatgctggcctagcgaaaaggagatggcatcttggcactcacgatgcttgcggggaacacaacatatatacccagattctctgctcacccctagcttcgatcggcgacaacaatggcatcactgtcttgtggttgcagttttgttgcaccccgcaactctctgaaaacaaaagtcaaaaaccttggtctcccctaactccaagtgatcttatcactgttcttgccaattttgatagtgacttgatttgaggaattaatacaggtgtacatgtagtataatattgttgtaactttgtagttacactcactaagctatggataatacaatcgtttcagctaattaaaaatgcaatcttctgaggtaagctcgtggatagattaatttgtcggtcgttaattagaggtggacggatttgtcgacgtgctgcaaatgattgatcggatcgatgcatacttgctgcaggatggcacgtacctgaggaacggcccgggactatggaacctcggcgactacggcttccggcacctgttcgacggctacgcgacgctggtgcgcgtctcgttccgcggcggccgcgccgtgggcgcgcaccggcagatcgagtcggaggcgtacaaggcggcgcgcgcgcacggcaaggtgtgctaccgcgagttctcggaggtgcccaagccggacaacttcctgtcctacgt

SEQ ID NO: 11070 - DNA, 1501 bp, Oryza sativa
tatttctgacaaattaaaatttgttggatgtgtagagctttgttctgggctgccaatggaagttgcaatatatatgggatctgtactgaagaaacagggactaattatattggttcagtcaatgacaacaagtagctaaatcctcattttgtttggtcttagacagtactgttttacatttgcacttaacagtgtccaaattgcaaacaagcaaattgactttcccatcagagatgcatgagaactgatgaaaccataacagccacaagatgcaacctgaacggtatgtggttaatccctggccagtgctaatatctggcaaaaaggtacctaatacaatctaaatctcttctctcagggtgacacagtagctagctagcatcgatatctgatctcggaatccttctggatttcgttaatctgaatcttgattattaagctactgagaacagcaaccactaatcagtagttcagtactggtcgtagtacaactaacagtgatcagcagcggagggagtctggacagctaccttccagagatgtctcttggcgagctcctcgtgaactacttgactcttctcttcatgcgttttcttcagattgaaccctggccatgcatgcttacaattaatgattaccttttcataaagattattatttttagaaattattcgttgtccattattgttttttaattagcatcatcggccactgtttatataacttttgtttttttaatggaattacagaacttctgttgaaaatcaatcagttgaattaatcagtcatgccaagagtctcaaacatggtaggaaattagtttcagaaaattcaaaccatgacaaaaagaagaaaagaaaagaaaacagatccccgacaaagaagaaaacatactcctgaaaatgcaaagtcggatcaaaattactagcaatatctaaaccgcaaccacaattggctacatttcacaatcacctttttggccattttgcaccttaattaattttatgctgtctattctcccaaactcacacaccatcatcacgtgcataagcttacaaacctaccagtaacatctccacttgacaaaaagatgcatatatgatatgaactaatagcccttcattaattttctatcaaatcttgaagttgcaatttgcaatgactttagatgcatcaccacgtagcaaccacaagttacacgcagcaatttgcacatcaccttttttgacataatctatggccattgttggatgcatgccaagttcatcaaccctagaaaacctctataaataaccaccatgcattctgctctcgagctccttatcatacaaagcaaaaagactaagcaaaactaggcaattcttgacacaactctacattgccaaggtagaagaagaagaagaagaagagaggtagaagaagaagattgtgagataagcccatatggctccaagcagagaggtttgcgcggtggcgatggcgatggcggcgccgttcatcg

SEQ ID NO: 11071 - DNA, 1501 bp, Oryza sativa
tgggaaagttgtggagataatggtgtcttctttgccgcccgttctcataaacaatcacccacaaaatcaagagaaatttgggcatagttgttttgatgctatgggaaaaatgttctagcattttctgattcttgatcccttatttgtacatacaaaccaaaaatgagctggccatatatattgggcacctagattgtgtgccatgactctcccaatatatgacatgccccatggacaagtcacaccaggcactaatgcaactaaagattcactctggatagcgaaatgaattgctatagtgagcaacatttaattgatatagtcacaatttgagattgttctagatggatgaatagatagtagatttttttattatgtgatgataatcgaggtacaagcagaagagttaactactactcgtataagtcatattggggttatcccatcttcaagttgactttatagaaaaacataacaacagtttcaacaaaaatatgtcatacactagttatggcattttagtctctttactgtggaacactctttttttcggttcacaccatatctccgatgccacaacttttttttatgatcaatttcattgtatttgtcttgtgtttttttaccttgggatgtcctttgatccactagttcaacaaggtttcgtcgccattgtgtgcgcttagaacatcacttctcaatttttgcataattttctcctatatttggcgtacaaatgtgcatgctgcatagtttcgaggttttttgtcatagagctggcagaattaattgttcagccactgacggatttgcagctggtttaccatctttatcttattttatagtaggagccatatattttttttagcattttcaaagtgctcatgccttccatatcagctttgcagctactgaatctaatctcccattgaattgtgttgtatgccgactttgcactggtattccattgttcgtccatcgccatctaatgatgtcatcaacccttctgattggattatgttgttgcttcgtatctgaagaaacatgtcgaagaattccttcatcaggtcgacagtgaggttgtacgtgatatcctgtatccgctgatcgtttgttactgcttcatatatcgatcgactctttcgctttgatcggttgttaaggccaggtgctatagctctttgagtggttgatgactgaccaagttcgatacccagaaaattgctttgcttccctcaccttttccatctcagtttgctggtattacgcattctatactagataaaatttcgttggacattctgtactacataaaattttaattttgatcgttacccattcagtacctgacagaaaaaattcttttaccaaacatatattttctaaatcatacatatataacgtgcaaaattattgttcgcacggggtaacaacttatacttccagatcaacttctaatcatgtcattccatttccaaatgacatttccaaattcttgaca

SEQ ID NO: 11072 - DNA, 1501 bp, Oryza sativa
aatggccaatccaaaagcgagaatagtacagaatgacctaatctatatatatgtctatactattataaaaattgaagatgttttgtcgatattttgatacgtcatctgtgtatgagtcggtttttaagtttgtttgcttttgaaaatacatatttgtatttgagtcggtttttaagatcgttcacttttagtaatacagaaggaatcatataagaaatttgtttaaaaaaactcgcatgctaacttgagacgatcggactcctagctgcagctcatgattttctatatatatatatatatatatatatatatatatatatatatatatatatatatatatatatatatataagcgaactcccacagtgaatttcatcttaactaaaccatataacaataataaaattaaaataaccttcacacgttgtaacgcacgggcattttttctatctctactattataaaaattgaagatgtttttgccgatactttggtatgtcaatcgtgtatgagtcggtttttaaatttgttcacttttgaaaatacaaatccatatttgagtcggttttaagttcgtctgcttttgaaaatacagaaggaatcgtataagaaatctcttttaaaaactcgcatattaacttgagacaattagacttctaattgtaactcatgattttctaacaaagtatatatccaagagaatttaacacaataaatttcacgttaactaaaccacataacagtaataagattaaaatagccttcacccattgtaacgcacgggcattttttctatattataaaaattcaagatgtttttgcctggaaattttgtacgtcatcctaataacacatgcttttattttcctactccgttccatatagtataccaacgcaacacgcgtccgactatccgtatttgagtcgggttgttaatatcgttcacttttactaatacagaaggaattatataagaaatcatgatcagactcataactgcaactcatgattttttaaaaatatatatatccaagcgaactctcatagtgaatttcatcttaactaaaccatataacaataataagattaaaatagactttacccgttgtaacgcacgtgtattttttatagtactaaataaatagaaggagtaaaacttcgaacagagtccggctagccccatgtcgtgtcgtccacttgccatgcatgcatgatgatttcacccatggatttgatcgatcgatcgaccatcgccttgagttcgttgtgcatgcgtgccgcatgccccttgtctgtctcgatctccgtccttttttctaaaataaacattccatgtacacctctacagtacatatatatcctacttatataaacacttctaaaaactagacaacagattaatcttagtattgacgaaattatgaccagtgacgattttatatcgacgagcgtatcgtctactattaaaaaatagttagctataaatacgagtatccatgtt

SEQ ID NO: 11073 - DNA, 1501 bp, Oryza sativa
gttactgtttttctataaacttggtcaaactaaaagtaatttgacttttaccaaagtcaaaacgacttataatctaaaacagagggagtagtatatttgtatatgatatatgttttgtgttataactgttattatgttttgtatttgtatatataaagttaaacttgaagatggaataatgccaatataacttatacgggtaatagttaactctctttcgcttttacatcgattatcatcacaaaatcaaatataatctaccatctattaatccattcagaacaatcaagctagtgtatggggcctagcttttcatggctagacgtgttaaccaggctgtttgttggttcggtttcaaattgggctgctgttagagaccgtgcacactctggttttcatagttggagaatgttacatctccggtttcgtggttaagggatgagactgaaacttgatctaaaagttcatgggtgtaaaaatggacttttctgctgccattaggtgtcggctagttgccggcttttactgggaactttctcttcttggacgagatttacatgtgtcctcatcgtgaggaacccattgggccgctcttgtgtgagctttacactcccactttatgttgggcttcaacgtgggcctgaccgtgtcgaatgggccgctctcttctgggcctcactatttggtggctgtctgggccaatgctttgtgggctataaataggaggaataagttcagcggctgtccctcaactttacaccgagatttttttaaggtccgttaaccacaaaatcagaaatgtgtatttctgaactatgtaaaaccgtgcataaaaggtcccaagacagtatataggccgggtttcgctgacgtagcatcctagttggcaaaagtaattaaaattattatgtgaggtccacgtgtaagtgagaaaatggtgtgggtcccacatttctctctgtttattttcttttatcttctctcttcgggttctctcgagcaggcgaggcgatagagggggagagcggtggccggcagctgagcgggacggcggcggcgggagaggaggagaagtggcgtccggcgcgacggcgtgcttagcggcggagatgttcgaacgcgccgggtgctcgacctagggccccgctgccggcgagcggcgcgctctccccgtcaaccctctctccctccctcgcctactcgtccttctatacgcctcggccagtccgacgctctcgtcgcgctgtatgcgatgtgtcggaaggtgagctcgccgtcgacggctgcctcctctcctcctctccctccgccgccggtggggacgcaatgttcttgttcttgtggcggcggcggcgacgacgtccgccggcgccagcgacgagccgacgtacgagaccaagtccatagacccgagtctcgccgtcatgacgctgtcggcgcccgtaagtaagctatccatatccatctagctgcgccgccgcgcgcatgatctcgcatgcac

SEQ ID NO: 11074 - DNA, 879 bp, Oryza sativa
gaatgagtaacaatcgaaattttatcttgtaccgaatgtgcaacatcagcaacagagacataaataggagatggaagcaaagcaattgactctacaaccactcaaagcagaagagtcgatcggtatatgaaacactaacaaatgattggtggatacaagtggcacaggctcaccatcgatctagctattgaaggaattctttgacatgctactttagatatggagtaacaacacagatgtttaggaactaaggtcttagatctttcgatatgctgataactctagatttggtggaaacttgacacacatgatccggcttccgatcaataggatccaagtctcctttggttatcaatcgtgtgctatccagttgacctcactaagaaggttaatccctgcatgcgaatcgaaaaacacaagcaagaacaatgtagattgcaactcaatttgcagatgaatgattaaagactcgaagttggggttccacaaaccgaaccatcggcaaaaatgtaacgacagaattaatctaagtgaaacccgactcgaaactatgacggctactgaataaatatgattagggatgtcctagggttagccctaggatgcatactgtcacgcccagaaattttgcccaaatttctagactattttgtgtattaaatccctgtccaggaatcagccagggtacacaaaacgacaaataatatacacatccaaacgtaaataaagcgtaaatacttacagaagagacacttagtcctcacacagaaaagaaagcagtagcaacggaaaaaggcgatcctagcggggctacatcttcactccacaggcaaaactcaactgggctctaagcccttgtcgtctaacttcatcttcagc

SEQ ID NO: 11075 - DNA, 1501 bp, Oryza sativa
agtttcctccaaatcgagaattatcaatacctatgaaaagatcgggacctagtttagtcatcagttggtaccactagcatagactgcatgcgggtaaggcattttcataccgcacagtagggtgaaagcggtcacgaaaattcctgatcgaccaaaacgcctttttcgtatatggagtacagtttccgaccatatcgttttttatctatttataaattttgttttttctaattttttgtgcatcatattaatgtcgacactaagtagtttaaataataaatatatataatcaattaccggtcgatcgagcttcgtttcctaggagatgcccgttttcaccctacacacggtgcagatgttgatgacacgtggtgtgtataatgaaccgaaacaacaagctcttcccacaaatcagaaatttgcatgaaaatggagagatcttaatttcttcttcgattctaaagcgacaaatcaacaactaatcgtctaattcacatcgaaattattcagttcagcgacggtaattaagctccagccagtacgttccatactgcaccgaagtaattaaccatcctaattaactaacaccctgatggcctagctcaatgcaaactctgttgttactaccactctccaagaatcaagcccatcatggccatcgcggccaggagcaatgcgtgagccgctgtcgccgccgacgacgacgttgcggcgctcgccgttgcggcttcttggggcgccgggctcggggaaggcgatggcgacggcggcggcggcggcggcggtggcgtggccgccgtcacggcggcaggaggtttcgcgatgggcgacgccgccggggcgggcgccggcgacggggcggagtcgacgttgatcatgaggcgctggcccttcttgcagtgatcggcgtcggcgctggagaagtaggcgaagccgggggcgtcgaggaggaagagcacgctgccgtcgttggccgccgccgccgtcgcgttgcagtggtagtacccgaacttgtccaccttcaccacggaatcgttcttgtacacgaactcttcgatttgcagcatgaaatcgatggatgaattgaatcaagaacaaattcttcgatgttcgaattgttttatagctagcttgggggccttaccaatggagtcggcgacgtagaagcggatgccggcggcccacttggcgtacaagtcgacgctagccggcggcggcgtcctccacccgctacggccgccgacgacgtactgcttccccacccgcatcgggagcacggtggccgagacgcacaagccgccggcgacggcagagacgatcaggaagaagcagaggaaagagaccagctgatccctccgagccatgaactaagacaccgagcgtcgcctgctaccaacacagaattgaagcgaagaagcagccgattatgacaaaattgaactgatcaggagatggtattatcatcggaatttataggagatgggagagccggcgaggcggg

SEQ ID NO: 11076 - DNA, 1501 bp, Oryza sativa; identical to SEQ ID NO: 4225

SEQ ID NO: 11077 - DNA, 770 bp, Oryza sativa
gacatagaaaaaaacatattttttgatggatggagtactagctagagtagtagcatcggattaataatgaacttcaacaacaactttcgtgcaactcgatatactatgtactaaccccgtcacaaaataaattcacttttcatccatcccacacgctaccaatatacaaaacaaaaaactaaaatactcttatttcatcaaatcctaatgcaactcttactcattttatttatttttaatgtaattattctctactttcacaaacacagatacgatgagtactttaaagacaaacttatttttgagataaatgaaatgagttaaaaaagaacttattacgggacagcagaaagtactatagctagctagaccttatcttccaaatcagaataaccaacaatctaaagcaatgagaatagcatgtaagaatcatcaggagactaaccatctccttaaagcttcctcgcaaacaaacacataaagaaaaattagactacttagggtgtgtttagttcatatcaaaattagaaatttggttaaaattggaacgatatgatggaaaagttggaagtttactccgtgtgtaggaaagttttgatgtgatggaaaagttgaaagtttgacttattgtaatattttggcagcctcgatcgctagcctagctatatatataataactaataagtagtaccatgtcccatctctgctagtcaagtctctctgtctttctctcgacttgaattttcatcgatcggttttaccggcaagca

SEQ ID NO: 11078 - DNA, 1501 bp, Oryza sativa
attaaaacatttgcaaatatttgttaagtaaccatgtgcaagaaaaaaaaactaattgtttcgagctataggttaactcatgccatcattggcttattgttcattcaaatctagcatggaaaacgaaaacacgattgtttcatacatatattatcagtattggaggtttgaattccaaccaataagaatcagatatacgatataccatgtcctgatttcaatctactcacatatcaaactgaaaccagcaaaggacgcttgtacatctactcacatatcaaactgaaaccagcaaaggacgcatgtgcaaacgccaggtagtgggcaggtaattacacccatcttataccacttcttcatttactccattgttactaaataagcacatatcatggtttctgatttgtttggtccattgttactaaataagcacagatcatggtttctgatttgtttggtctaggaaagccactttgctgctgatctgaggctaaacaatccaccgccgtgccttataatgtctccactccactatagaatacgagaattttcctaccccaaagaggatcaaactgttcgaacgctgggaatacttgtgcgtggatgagaaatcgagaatcgaggatatgagctagatcgatcatcacctcggggcgtggtgcccgcggccgagctgaccttcatcgttgcggccccacgcccagacctccccttcggcggaaaccgcgagggagtggtagtgcccggcggcgacggcggcgacggacgtcgggagggagggcacgggcgtggggacgtagacgtcggcggccggcgccggctgccccgccgcgccgtggctgttgtccccgaaggcgtacacggccccgacgcgcgggagtggcgcgccgttcccggcgagctcggagaggaggcggcggcggaggaagccggaggcggaggcggccgtgcggcggagaggacgcatttggaactcgagagaggaggaggggaatgggtgggtttgtttcatgtggacctcaaaaatgggccttgtgggttgtggcccatgtccaaatcatgtaattttgggccagcctagtaaagcatctctcaggccttcatcactattccaatccaaacggtccacaagattttatatttctatttcttttggaataccagatttttttttctagacaagattattttatgtggtgcaattaaatctcctctagttttcttccggaaaaatttttttcctctttactgtcagggataaacatacttctaagaaacatcttacatagcgtagcatgtggatgacaataatttaaaaacggagaaaataaaatacacgggacactcctagttctaccgcctaataaaagggagatatttaactatttaccacgtttataagtgttaattaaaaatttatcactggaactttgagtgacaaacttttaatcaacaaaagtagtaaatagttatatgcccaacaaaagagagacaagctagc

SEQ ID NO: 11079 - DNA, 1501 bp, Oryza sativa
atcaaattaaagaatatggtgctatatttttaccgtgactatatccaaaagcatttaaatctattactactccctccatccaaaagttttatacatattctatttgtttagtttttctaaataaaatagacatatttatagactttaagtacataagactgaaatgaagagattgtcttttctttttacaatactagattaaattgttgatcggaacccaagcaacatttttaatgcccattggttacatacatagtatagctcttgatctttgttagagcaaggataatagtgggctatataaaccaactataagctaatgtgaaagaggtaaagaaaaatgatgggtgttggctctaatgcaaaagctagttctacacatgctccaaaatatcacattaaaattatagcgagagaaaaaaataaagtgaaacttatagttaatctattatgcatgatagctctaatatgaactaataaccaatagttagctttacttacaatcccattgtttcgcttattcatatgcttattcgaatcacttatttgcaaatataaatcatttatgagtaaaagttttatttgtgtgttcttaacaattcaaaaccaaatgttgtaaaataaactacgatgagaaaacaaaaagatcaaattcaaaatcaagttctaaaattaaaattttggcttataaccataagtataagcataacctaaacaataagtcccttattaaacttgctcttatatgcatgataactttttttcttagtcttaatgaatggcaatagaaatacttaagttctaaacttttggatggagagagtaagagcttcatcggttgatctaataagctaaagaaaaaaaccaaagtttgaattttcgaacttaattttaaagttgatcttaaaatattttcaacgtaattcctttttagctacaaacaaatatatcaaagtttcacctatgaattaatttgtatttctcaataaaccgtttaaaattattagagaaaatgtggataatcgatgaggctttaggctgcgttcggaacggagcagcgattagcacgtgattaattaagtatttgctaatttttttcaaaaatagattaatatgattttttaagcaactttcgtatagaaattttttgtaaaaaaatataccgtttagtagtttaaaaagggtgcgagtgtgggggcgcagccttaatactttatagagtccatagaaagagacctgatcgtacatggctccttttttttttttggataaatcacgcagctaatttttctttttcttttttaccagtagtaggagtgtaggacacttcatatcgttgtgctagtatccggcgccgcttccgttcatctgcgcctatttattgcggcctcttcttcctcctctcctcgcctcgcctcgctcttccactgttcatctgcgccacgacacgacacgacacgacacgagacgagagaggagtcggcaatggcggaggggtcgc

SEQ ID NO: 11080 - DNA, 1501 bp, Oryza sativa
tatgcgtgacttatcttttaatttttttcataatttttttaaataagacggatggtcaaatgttggacacggcaaccagggtttgtcttttttttttggacagagggagtactccctcctgccaaaaaaaacttatcttctagagtttaaattgtgtcacactaagaactaacgtctaccatcctacctaccctcagcatgtaaaacgaaagttttatcccttcgatactctttacctacctatcactcttactacttttttcaatgattaaggatattttagttattctccatctccattaattccaccttggtataataggaatgcattttttttgaacggagggagtacatctatactactttaaatgataccccctccatcccataatataacaactccaccaccgatattcccttatcaaccaatcacaacactcaaccatttatttttccaacctacttccttcgtctcataaaaatcaactaagaattggatgtaacacattcgtaccatgaatctggacacattgtattagaatgtatcacattcagttttagattcttttttttatagagagagtatctcaacttttcaaccaatcaagcctcttcttatttaattctacatactttcttaataacctaatgaatgaagcatttaactatttgtcatttttagatttgacgtttagccgtttaccactcatatatcaatgatacgtggattctcatatatttattacatgtctataatacgtgtatccagtgataaattattaaacaccatacgcatagatggcaaaatagttaattatctcccactgaacttgtgtttgagctgtgtgacctcttctgttgtctccccctcgacccaatcaatcaatctgacggaaaccacgcattttgcaacttggaatggaacccccacgcgcgtacccatcttccattgacagacaattgggccccactccgcagctggcccaccaaccagtgcccgcaaaagcctcaccggtcggtggccgcgcgcgtcgggaaaaaccgaaaaaagaaagcgatcagcgcaagcgagtgacctgaccctgaccgaccgaaccggaccccataaaaaaaccgaacaaattacaaaacccagctctgatcttgcacgcgctgatcagtcgctcgctcgctcatgcggccggcgacgaatcaaccagcaaactaaaaaagcgaagggaaaaaaggagagaaaaaaaaaaccaactccctcctccccgttctccagatccgcaccgccaccgccgccgccgcgcgatcctccgccgcgcctaccggtgcggtctccgatccggccgccacccgcgcgggatccgccgccgccgtcgtgctgccattctcacggtgtctgtttttttttttttccgttcgctgcaggtcggggattggtggaggaggcgcgccgggtgggctgtggagtagggggaggaggaggaggagggtgtgaagcggagcgacgaga

SEQ ID NO: 11081 - DNA, 1048 bp, Oryza sativa
cttttgtggcaccgcattactttcctattatagtaaattatacacctcaagtttatacacctcaagtttacacatctaaagtttagaccaaaagtttataagtcaaaagttatatatccggttcaaatttgaatttgaatttgggtattttttatatatagtatttctatacatctaaagtttatagacctaaagtttatagatctaaagtttataagtcaaaagtttatatacccgtttcaaatttgaattttaattatatctgattcaaatttgaatttgaattcaaatattttctatatatagtatttctatacatctaaagtttatacacctaaagtttagtttatagatccaaagtttataagtcaaaagtttacatacccgattcaaatttaaatttgaattatgtccgattcaaatttgaatttgaattcaaatatcttctatatatagcatttctatacatctaaagtttatacacttaaagtctatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttat

SEQ ID NO: 11082 - DNA, 910 bp, Oryza sativa
actaccgcttccagaatataataagttttagggttaagaaatgaggtataattaaatatgagaatactatgattggataagtggaggtagtgaagaaattgaatgatgaatgattatgatttgttaggaatgattggtcagaaagaaaatgttagtgaaattgttatattttgggataaagggagtaatattttttttacatatatcctctacactgttgtccttgtattgaaagctgctaacacgagtacacagcggaggatctctcaattgattgttcattgtttcctcctgaatcgttaggcaaccggaattttatttgcgtgcgtccaatacgctaacccagcaaagggaccagaaaggaaggtgatcccaaagctcgaggtgtttctttgcctcctcttcggctggaagcaggcaaactggcaaaggtttctgtttcctccaactcctaggaaaactcagggtccctgatgatcacctaatggcaggaaaagtaacctgaatctgacaccagtttgtccatttgtttcagcatgcagcccctgttcagttcccttttctggtaaaccttggatggcgagttttaagttcttggtggttgtggcaggtgatgcacccaggaagttctgacaactgatgctaaggctgtgtttagttccacgctaaaattgaaagtttgaagaaattgaaacgatgtgacgacaaaagttagaagtttgcatgtttagaaaagttcaatgctacagaaaagttggaggtttgaagaaaaaagttggaatctagacaaggcctaacttttcttcatcagcaacagaagacctcaccgcgggaggccataatctgaccaatcacaagacaaagtgagccatgctctagcaaaattagatgggtttcacatcataaaatg

SEQ ID NO: 11083 - DNA, 552 bp, Oryza sativa
tgccggttccccctcctttctccgaccatcaacaacagccactgctccagccaccgccgaagcgccaccactccgtgcccgacaatctcttcctcctccacaaccagccccagccaccgccgccggcgcccgcgcaatgcctcccgtttccaacgctacatagcgcggtacccttccagctccagccttcgatgcagcatccgcgcaacgcgatgaagtcaaccgcggcggcggcggcggcgcagcagcaacacctcctggacgagcttgcagcggcggcgaaggcaaccgaagtcggcaactccataggcgcgcgagagatattggcgcggctcaatcagcagcttcccccaattgggaagcctttcctccgctccgcctcctacctaaaggacgccctcctcctcgcgctcgccgacggccaccacgccgccacccgtctcacgtctccgctcgacgtcgccctgaagctcaccgcttacaaatccttctccgacctctcccccgtgctccagtttgccaacttcacggtaactcaggcgcttctggatg

SEQ ID NO: 11084 - DNA, 1121 bp, Oryza sativa
ctatgacttcggcggttgatcgggcttgttccctcctcgttccccgatagcttcaatgtccatggtcgcttctctattgcaaaaatggaatgtctctattcagttagtacgatagtagtatgagcaacaggattaccatcattttgtttaccgcgactgttgacgtcaaacacgaggcctgggagagtacaggttcaaagctcgccttcgggtgtgttagcgtgccaattgaattgatcctgcaatcaacaagaaatagaaacagagagatcgcggttaaatctataaatgatagccgatcggctaagtgtcgatgacatatcatttatctttgagccgatgtcatatgtgaatcgatcggcgactataaatagataataaagacttaaacctactcgatcggctgtagatattaccaatatatagttcttatatcgatatatatttaaatcaagtgattgggatagatcggtcgccatgccaagacaatataaatcacttggatcgaaatatatattaataacaggactatatatgtttatagcatagccgatcatatagatctagcatgtatcggctaatacttcgatactactctatatcaggatattaaaacaagtataatatatcaaacaaaagcttaatatacttaaatgcaataagatcttgacataaagggcggatttaacatgtcactgaagcatatagagcgaatatggttaaatcagataagatcggctgaaactccgatactaccctaatcggcaaccagaaggcaggctagagattgatattctaaacacgacttaatagatcaaactcaactgatgcagcattaagtatgaaaagaagaacaatatctagacaatcaagccgctggaagtttcatagagtggtggatatcttatataatctaaatcaacatcaaaatctaacctaatcggctgccctctactagcagatgttagccgattgtaggttagatagtgatattgccagagattatgtacgatatatgataactcgacgaattacgtaaacaagattagagtatcataaagatggaagcactaatcccgataacacaagccatcataacaagttttacctcttgttgaaga

SEQ ID NO: 11085 - DNA, 1501 bp, Oryza sativa
ccctccgtatactccaccgacttggatcaaagtcaaattgctttaagtttaacaaagtttataaaaaaagagtaacattttcaatccaagacaaatttattatgaaaatatatttaattattgatttgattaaattaatttagtattataaacattcctatatttatctataaacttagtcaaacttgaagcagttttactttgaccaaaatcaaaatgtcttataacctgaagtaaccatttatatccctttagaattcatcccaaaatataacaatttttccacctattttttcttaactaatcataatattttaccatttaaattcttcacctattttctcttttcaagcaaacacgttcatctcgtatttaattacacctactttcttaatactcctgtctaattctaaaaagatgaaccagtcgtaattatagctcattttcaaaatgtacgatgtcgttaattttttgcacaatatatgaccattcgttttattcaaaaatttaatataaatatgtaaaaagtataagttaagattatttttttaattgatattaaaacaagtcggaacaaaataaatgatatccatataatttttttagtacaaatggttaaaatttatgaaaaagtcaatggcgtcatacattttaaaatggatgaagtacatgaaaaaaaaaggtgttgtgttgttttactcaacaaagtaactttctgttcagttgagggttaagataaagaatattttcccactgcgaggaaaaagataaaagatatttgctctcttgccacaattcacatttcacctggctacttatataagcaagatatattttactcgtggaatgacagttgatttagggttctttcagtttggagggaaatcgattacttagaattaattactattagtgtcattcggttcataataatgtaggtataggaaagctaaaggaaaatttcctttggtacgagttgtaatgagaaaacatagaaaaaaatttatccacacaaacatcttggaaaatttctatgaattgaagtgtgtatgtatttatattcctccattcttcctatttatatgtgtttaaattcctccaaaacaaacaagcccttataaagaaatctcgaaatgcttgttcactttctaggagtacagtgcaagttaatttcgtgcaagcccatctctgcacacatacgagctatgcgaccgtatagatccctaaaattaggggcccaaaatatgtgtttcaatttaaatcaaaatattccgatatatttaggattgtgtattcctttttttttcaaatttatctatttctctccactaaataggattaaccgagttgtttttctcaactccggtaagtgttcaataataatcatgggctacatcaaaggaaagaactatatttagcgacgacgatatgaacgtgcgttctaattctaaacaataacgattccattttttcatggaaaaagtacgaattaccccctgaa

SEQ ID NO: 11086 - DNA, 380 bp, Oryza sativa
gctcgtcactactccatcccgctcgccggcgtgcaccggcgattgggagacgtggagtccggataagttacgcgtggagtgaagatcgtgcgggcgccctgatcaagcgactcttctctatataaaccgacccgccgtcttcacgcaacacacgcgttttgctgcaaattcggattcatttttgttttggaaacgttccgaaaaatccggtgcgtgcaaacggcgtggagtccggataagttacgcgtggagtgaagatcatgcgggcgccctgatcaagcgactcttctctatataaaccgactcgccgtcttcacgcaacacacgcgaaatcaatctagggtttgcctcctactctatactgcgccgtcgctcataga

SEQ ID NO: 11087 - DNA, 1501 bp, Oryza sativa; identical to SEQ ID NO: 10182

SEQ ID NO: 11088 - DNA, 1501 bp, Oryza sativa
ctgttactgcagtagcctttgggttccttcagcaaattcatctgtgcttttgtttgtatatttctgttactgcagttgcatttgtattccttcagcaaattcatttgtgcttttgtttcagttggttctagcagttgaattagcctgaaatccggatagtttcaggaaatttcatctgagctttagtttcaacagacctccgcaggaaaattttaacaacagtgagtgagtgtgacgcactgacgctgcacttggcagttggctcttgcacatcactctcaattgcaatttctgaaaatggcatagcattgctcagagtcacaggaattcacttgaaatcatatcaacattagggcagagattaatggaatagcttcaaaacataaacaaaaagaacagccgtttttttttgtggagaagttgggtccaaatgggctgggcccaccaatcatttatggcccatgggctcaaatctaacggcccatgaacgcatctcaccgtccccttctctctcctccgccgcctcctcctcactagtgacgacaccacccgaccaaaccgcaaagcgacgcgacgcggtaaaaaaaggaatcaaaaaggcgaaaaaaaatcgtcctcctttccgtagctggcaacatctccgcctctcctctcgcttcccgcatcttcccacacacacacacacaaaaaaaaaaacctcacgcgcgattccaatcctccctgaatccaccgcgcctttgcctaagggtttcgattcgttcgcgtgcggctgctctccccccgatcgatcggcttctcgcctcgctctcgacgaatcgaggtcgctagctcggttcggttgtgcgttgcgttgcgttggcgtggcggcgggcggttgaccggttcgctagggttggagctccgggagggggaggaatgatggcgagccacggcgccggggtggtggctgctggatccgatgccgctcctgccgaggtagatgacgcgcctcgtctgatgttctattgatttttgaatttgttttttttttgaatatgtgatcgtttatttagtgtctatttaggatgcaacgaatttgatattatgctaattactgtaccaaacttaagctaatttgaggatgtgggtgattggtagaagtaaaatttagccaagggaactaaactattcatgcaaggtggcttcgttgaatttttgcaaagaaaaattagagcagaagtttgatcggatttgaacgtctttgctatgcgtagaactacatgttaattctgagaatctatggttgtatggaagcctagttgtacgaatcattctagttgcaatatagtactgacttaaagcattttgccaatgaattactgaaatggttaaagctgcagtgaggatgaatcttttggtcatggcttttgtaactaagttgctatgtgcattatgccattatataaatgatcatgagttcatgacccctttatttgctaatggcaggtcagcattgtggggc

SEQ ID NO: 11089 - DNA, 1501 bp, Oryza sativa
ctttccagtagccgtcgccgtcccgccgtacgcgaccgtcatcgggattgtggtccgagaaaagtttggatacgactggcggcgtggcaccgatggggatggggggattgaagatgaagggcaagtttggtttggtgccatactaaaattatcaaagtttagataatttttggcactactaaatttagatggctaaaacttttactatctaaagagatatattgttaaaatttagcattaataaaaaaactagaaatactattaaaaattaccaataaattagtagggcggaatttggaaccgaaccaaaccaacctgaagcgaactactcgccgcggcagagttcgcgggcttgatgtgcacggcccaaacaggcaaaatcctgagggggagaggcagtcgaacggcctcgtgcgatgagcggcccagcaacccagccgaaccgtcgactttgccgttgcgcaccggtggagaaccgcgggccgagcgcacttcagctggccggttacttccccgggggccgggggaagctgagctggtcacgctccgaccgccgcaacacacacacacacacctgccaccagtaccacaattctcaaccgtcggcatcggcaggactaccgatcgaaaccgtcggcatcggcagttactggaggaggtgctggtgctttgtgaattttctggtgattagcactgtatgcggtttcatttggccccactgatgtattagtagcgtaaaaatgagaaaaaactgcatcgtactaacatatttcgtactccctccgagctgagagtagtttacgtatcgttttggacaagaatgatatcaaactttaaagttttggacaagaatgatatcaaactttaaaatctttgattatgaaaattttctaaaatatttgtctttaaactatggtgactatatgtatatattaatcttaaaaatacttcaattaaattatatatttgttaacatttatatacatattataataaataataatgattaaagttgtttttgaagaccgtgctcttgttcaaaacgacgagtattataaacccggagggagtattagtattagatttgtttacgagtaaatttcacttcatactatcttttttattcccgatgttttattttggatcatccttcaaaccaatgttttaattttagactagacaattttatctcagcgacactttggatcaccctttattcttttatttatctacttctaatttatcatatgttaaagaaacgatctatatatagctgaggagtttattggtgtttgatgaaaacaaaaccacgaacacacagaaaataggaaaaccctgtattttattaatcatgattcattaacatgaatatttacaaatacatgatggctcccgcaggagttcgccttttgccttcacgagaaatgcttaatggaaaggtatgctgactcgagattgcgtacagtccgctgattcccggcgcctagcaataaggctaccg

SEQ ID NO: 11090 - DNA, 1501 bp, Oryza sativa
aaatgtgtggctatatcactatgctcatatgtaatttaattacttagtgaagggtgagggtggggagagggccgggctgcctatatgtgagaagagtgttttagttattgtgcacttgtataatcatgctaccgcccaaccttaccactactaaaaaagcatttttccatgcggccaaaccctatttttccatgtgataggggcgccatgcggccaaaccagattttcgcatgcgggtgcttatgcgagccgtatgcaaaaataaaatttcgaaaaaaaaaataaaaatctcgaaattgaaaaaccaaaaccctagctagcctggtgccacaagcctgcttcagctgccacccaccggccattgctgcttccgaggtcgggggcgacggatctgcccgccgtcgtcgctcccgagggcgggggtggcggatccacccgatcccaccaccattgccgccaccaccgcccatcaccttcgctctcgtggttaggggcagtggatttgcccgctcccaccggtagccggggccgtcgaggggccaagcccgaggtagcttaagccgcccgctgcccactcgccggccgccaagagagagcgaggaaaggatgaggaccgaaaagataaggttggactttgaaaaattttgaagtgttgagagggaaaagtggaggcaagttaggcttctcggtggatccttaacatgcccgcctgcgaaaatgtatttttacatgtggccccttaagaggtccccttgcaaaaatagactcatttccggatgcggctatttaagagtatcgtctgcgaaaatcgatttttccatgcaaacctcttaaggagcggtatgaaaaatagaggtcgattttgcaaatatggctaattacggtccgtctgcaaccaaataggagtcttgtccagaaaaatcgtttttggagtagtgtacgtggggccactacacaagttgctagctacatgtgtttagaatgtgcacatgtcatttgatggctggaatgtatcttgtaggccgtctcaataagacaacccgatgatatatagttaaagctaatcaagcttgagtaagctgtcctgttcaataatttgatatatagataagattccagtacatcttttacttatacgccggaatgtgagggcgacgtgcgtgatggcccacgacctaacagaaaatcagctatggttgctcacgtactgaacttgtcgtcgattggttggctaagcaatatgtcaaagctggaatgctattattttaccacaaattgcaagcacagccagtagaagaagctgataaagaaacctctcaaagcgcagttcagcaacagcccaaagttgatatagaatcagtcaagtagggaattggaaacgtactctaccaagtagtaccaagtaccaactaccaagttccaatattaattcgattcttatgttgaggcgcggccaaactgccgcgggatcatccttctgccaccggagactcccgagatg

SEQ ID NO: 11091 - DNA, 1501 bp, Oryza sativa
ctcttctgatggttttgggaatctttctctataatatcttggatatgttttggagaagaaactaaacaatgttaagcaggaggaggaaacctagaggaaacaaattaaaggaaagtaaaggattaggaggctccaattcgaaagaatgaagaacatcaactttaaagacttttgcaaaaagtttacccctaaaaaatctagtatgttacataacaaatgggcaaagaccattttgaaagcccacataggaccaatgcgatagcaacctgtatagcccactaacattcaaaacaacccagtgaacatcaatacagtgaaaaacttatagctagcccaatttacacacaaaactagccacgtgtccaattacaataacatatttcattgaccaaagcaaacatcacaggtgaccatatcctactactagattgcaaaatgaatatatgaaaacctttagcatcgacaagtctccagcctagcttcatctgcaatctggattagggtgttccgacggcttccttgttgaggagcacggagatgtggttgaatagtgtcatgtcctgatttttctctttctgttttttgcacgtgtttatgaaaatttagttttggtttattctccttaaatagctttatgaaaatttcatgaaatcaaaatagtttaatgtgattaattaattaattacaccattggcttgttcttaattggagttacttggatttaagttgtatttcggaagtggtgctcaatttctagtccattccaaatatcctaaatcctccaaaagatccaaataatctaaagttggaatttctagaaaagtccgtacctattcccttccttcttttctctaatgttcccttttgcattttgccccttctacttcttccttcctgtttctttttctctcctttttcttcaaccttcagttatatatggagcttaagctcccttctactttgagccgctcagcccgggagagcccgagccactgctcccgctgtcccctctgcaccctcggcctagcccacacagccgccaacccgagccgtggtgtaggcccgtgtcaccagaccacaccatcgctgtcacgagcccgtgcgtgcagcactgtgctattgctgaactcctgcaagaaccggtgccacctcccaaaaatcggtgtcgtgcgccaccctaaacctagtccccttcctcccctataaatactaccggccatcgcccttctccccttttttccgaagctgctcttgtaggatcgacgaggccgactagaggggggggtgcataagtggttttaaaacttttggataaaaccgagttatatatgggcaaggtaaatcaaaatggttttccacaatccaaagcttgaatcaactagtctcaactaagtgcacaaagaagttagcctacgttgaggtttgcaagcctagggtgataatagcacaaataatttctagtatgtaaacatgctcaaagtaaattggcacaaatgtaagt

SEQ ID NO: 11092 - DNA, 301 bp, Oryza sativa
tagatatcatataaaaaatatgctttagataaccacaataaatcattaagttggaaaatgtataataaatcagatataaaatcttgggcgtacctttgtagatatatgccagatatttatatatcaaaattagtagccaatttaaaaatcaatttttactaattaccttagataatggtttttccattataaaaaaaattaccgtagataaggttgcactgtacatcacatatcacggatatgtgcacgtggctgttgatttgattctccgctgtcatcttttctggttcctttgattaga

SEQ ID NO: 11093 - DNA, 244 bp, Oryza sativa
tatagctatttttggttatgcatatggacaagtatttgtataggttcatagctataaatagctatattttgggacggagggagtaggataaactttgcattttcgttaataactttattttttgtctgaatagctaaccaacccatacactactacactagtaccgaatcttttgtggagtccaataaatattgtatctttatcatttaacacataactttcttctttttatttatggttgcag

SEQ ID NO: 11094 - DNA, 1501 bp, Oryza sativa
tttggtatccttgtgcacttgcatatttgctgtgtggcttgttgagtatgtcatatgctcattcttgcaataatcatcaaacctcggttgaagaaaaaggatccggaaggagatgacgtttggcttataccccagttgagctgcctgtgggagtggagctgaagccatcgctagaccgttattccgttgctgttttcttttcttttgtaagtatgtaacgttattattatgatggatttgtatattaaattgtcagtttgtgtacctcggctgattcctggacgaggattttatgcacaaataagttcggaaattattagtgaatttcagggcgtgacagcggcccccttcctcccaccgctgccatcgccgcacgcgtggccactgccctcccctcgcccccctcagggcagatctaggaggaagtgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaggcgatcctagcggggcttcagctccactccacaggcaaaactcaactggagtctgagccttggtcttctaacttcgtcttcagctcagaagcactacacttctgaaaagagggaataatagcaaggctgagtacaaccaccgtactcagcaagccacaccaatgatgcagacgtgcaaagggatacaaggacggtttgtggctatttgcataaaggcggttgtaaaacattttatttagcaaacagtaaaactgttgaataattaaggtaaattagatctccactgatcaatgctacaccacgttgaacaggcccaaccaacccacctgtactacagtgcattgggtcgatttattaagtgtgagactaatcacgatgaatctggtcgatcgcccataaccgcaggcacggctattcgaatagttttactctggccagaggtgcacaactgtatccacaagacacaacccaccgacatgtcaccgcgtcatcatgtgcccatgacgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccagacaccccggccgacccaactccatcacgcccaccctcgccaccggtgcctaggaaagggtcgagctatacttcagatcaagcagttacccactcccgcttgtggtaagcactgtaagtcttctaggatttcccgtgaaccggtccttaattgccatgggtgcgactcacaaaaccatgcacccacagcccaccattcagtcgcattttagttggataattacgaccatgaaaca

SEQ ID NO: 11095 - DNA, 1501 bp, Oryza sativa
gagatggagaagagaggagagataagagtcgctaacatataggtcctacctactgacttagcgagttaaccgtggtcaatatgtcacgttagcagaaatcatttatcaaaccacaaaagaaatctatttgcaccggttttgctctttgagagatgtgactgaatcatgagcaagcattgggagaggcaatatagacttttcctgtccgtggcgtcgtaagtttatatgtgctgtgctttaatgggctgagctcaaacaacgaacaaattgggttaggattttgttcaaagtgggcttatatgggcctgaccggattggattacgtcactataaagcctgttgagagcgtcggtttttttagtgctagttcagattgtaactaaaataaatcttaccaaattttagtaggatttcttacgtatttactaaatttaacaacatattaagcgtagatattttttataactttaccaaaatataatatggttgaaaatagcatcaaatgaaacgggcccttaatttccaatacaagccgccgccgctgcctccgttcctgcgacagtctcgccctccgagacgcggtgcggcatcgccgacgcggagcaaacgggatggtagtgggtcaggggagggatcgtcgttcgccgggcttcccctcgacgcgctgttcgagatcctcctgctctgtggtttggttgcccgccagcagcccgagggagatctccatctcccgccccagcggctcagcgccgtctgccgcggccgtggtcatcaacgcgcacgcgtcctggtcgagcccgtcgttcctcgctccatcgtacgtcagccaggtttaaggcgcatcaccagttcaccaccgacaccacgctgaacccggccattggtgtcgacaaagagcatctagattctatctatgtgtgggattaattagtaaaacagcatggatcagcacgagacatgatttccgttgattgctccggctggccagctgactaccagaacgtacgataagttttagatcaatcagcatatactcatccggccggagactaggtcatatttagattatagccaaaataaaccttgtcaagttttgacaatgctaaaattttagcaagaaagcaatattgtcaaaattttggcaggatttcttatgtattgattatgtattaatcaaatttggcaacaaactaaacgtagatatttttggcaattttacccaaaaaatagtatggttgaaaattgtatcaaaatgaaccggccctataaatgccattgtcacgtctaaagtaaaataaaattttggtgaagtgtatctcgtgatcacgtatacttcctttgaagtagtacacgtatatgaactttttgggtttacggactcgagcactcaattgacttccgatttcatgcatacaaatcccattggcacatattgcattctcagcggtcttatgtgtgaccttctgatttactttttgagtaaatataaaaaaactgcaat

SEQ ID NO: 11096 - DNA, 1501 bp, Oryza sativa
tctcattcaaacgggcggatttgctcccgcaaatctcgccggcgtcattgatggcggtcggacctcccggccggtttccttccttccccggccgccctctcccccttccaaccctatttaaaccctccccgcgcttctcccgttcgtttccgcctctcgccgcccttcctcctcgccggaatcgagctcgcgccgtcgccctctctctctcctccgtcgccgacgacctccggccggccctcctcgctcgccgggaccgtctcccaccccggcgtcgccttctccggcttcgccgcaccgccgccgtccccgtccaccacctcgccgagttcgccgaccgccggaacaccgtcgtccccgtccacccgagccgcgccgccgccttcctcccctccggccgcctcttccgtcgtcgccgtcgacccgggggtgtgccgtggaccgccgcctccattcccccttcccttccactctcccggctgccgctccgccgtgcctatggccgccgccggcgaccataggggcgcgggcgccgcctcccgccggccgcgctgacgtggacgcctccgggcgcgccgagcagctgccgcgtggggcccggccgtcaaccgcccacgccctcgggtgcggctgacgcatggggcccacggcgccggccggtgtgagcccgggcacacccggtccaccatggaccgtgaggctgccgcgtgagccccactcccgtggacccggtccgcgcgcccctccccctcggctgacgcaataaaccatttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcttgcttgttatatggagtttattacagtaaaagcccttttcttttccgttggtcgtgtagacactgcagcttcggaagatccactcttcgtggaggttgaagccgacgtttgggaaagcgagcaaggcaagtcacatcatctttgaacatattggatcccactttgcgaaattattttgatttaaattaatgcattaccgctttatttaaattcccgcgttatcactgttttaattagccatgcctatttacctttgttatgaccttactattgctattgttattattaccttgttcaccctagaataaacaaaaccccaactagtgggcactctactcatggttccactagtctgaatttaggtatatgcttctcttattatttaggcaacattaggtgattttataattctagactttggggattcatatcgcttggacattatggaatggttggattattgtggaattggatgcacacctccccctctattcaaaaccatcaaaatggttttaggctgggcttgggtgcatggttttgatagtagcacctcggccacataaggaccggt

SEQ ID NO: 11097 - DNA, 1501 bp, Oryza sativa
ccccttactcacgtagcgatcataaggaaggaacaatagtgaggagaaagtacgtgcggtcaaccgtcaccgccgatgtattgctgtaattgttgtgtacacgatgtaaactattttggatgtattgaatatctatacaaatcaattgttgtatggcatatgttaattatgtatgattattagaatttttatcaaattgaaatcatccatatgctagttatatatgattattagaatttttaaaagttttaaatcatgcacgtggtatttacatatgttacttagaattttcagcaatttaatatcatgatatgctaattatatatgattattagaatttttattaattctaaatcatgcatgtggtatttacatatgttaattagaatttttaacaatttaatatcatgcatatgctaattatatatgattattagaatttttaacaattttaaatcattcatgtgcttattatatattatccacttagtttactacagacaacaatattttttcgaaggttttatcattaatttttcgactttaaataattgtaatgcattatttactattttagaaacacatatgtaatgaaattaaaaattcagtgctattatctttagtcccggtttttaactctaactgggtttaaaaataatttggaaatagagggaaaatatctttagtcctggttggtgagaacatccaggagtaaagatatctttactcctggttcgtaagaacaaccgggactaaagatcttttctttagtcccggttgtaggtacgaactgggagtaaatatatctttactcccggatgttctcaccaaacggaactaaagatctaggggtatatatattcccggtgcgccctcgtcttctccaccaacacttagaagtttttcctccgatcgatctcggcttctccttcgccgccactgcctagggcaaccccgcgccgacgccgccgtcgtctcgcggtcctcgccgcctccgccgccgacaacgccgccgcatctcttgggggagagtcgccactgcctctctctctctctcgatctatctctctctctctccaaaccgccgccgcctagctcattgccgacgccgccgccgacgtcgacgcgcgcggccgaccccgaccccgactccgcctcccgccgatgctgaccccgtcttcgacgcggccgtcaccgccaacgacgtaacatccacgcggccgccacggtgacgacgccgacgccactgccacgccgccgcccccgcctcgagctcgccacgccgccgtcgcggcacgctgccgccgtgcccccacgccgccggaccgcgccacgtcgccgcgccgccacgccgccgctccgctgccgccactgccgcgcgacacgacattgccgaacatgaacgaacgtgaacgaacatgaacgaaccgtgaacgaacgtgaagaaattcttcaagggaatgtccacaacaaacaaggaggccttaaagctatcggacta

SEQ ID NO: 11098 - DNA, 1501 bp, Oryza sativa
aacatcataaaagttttacataaatgcaacggaaaattaaaggataactggagctaagccttgacttggactgcagcgggaacaccactccacaggcatcctcgatggcacggacgaagcctacacctcggagaagccatcatctgacacgtactcaaactctggggtttagggaggggaatagagcaagactaagtaccaccaccgtactcagcaagtcataccagaataggagtatgatgcatgatataaccaaaggatagctagagcgggtcatttgcataaagcgagcatttataaacagtagttgaaagcagtaaaacagttgtagtaattaatcaatattaatcatccactgtccaacgctacaccacgttgcaactggcccaaccatcctcctgaactaatcaattccattaggctaatctagggtgagactaatcacagtgaatctggtggaccacccgtaaccgcgggcacggctattcgaatagttttactctgatcagaggtgtacaactgtacccacaagacagagccccacgacacgttactgtgcgccgacatgccaccacaacataccggaaagaggccgtgacaggacccttcgcataaccccctctagccaagcacaccacacctcaggtttcacccccgtccccagcgggcaacgggcagtcccctctcgtgcctacgtaaatccggaagcgacagaggccgtcgcagggcctgtcccgctccatcacgcccacccttgcctggatgtgtcagctagagcaaagctacactacaagcccagccgttacccacgctggcttgtggtaagtacgataagttcttccagggcatcccgcgaaccggtccttaagtgccatgggcgcgaccatcaaaatcatgcacccacagccaaccatttaatatattttaattaatcaacaccattgcggtggtactaatccaaagctatgccaataatcaaagtctaggcattaaagtgatccccctttgtgtactggttgaactaagcatggctaagcattccctaaaccaacatctaatcattttaatacctaagttatcaatggcaaaaggtaaacaatatatggccgagtagtaggacccatcccacatgacattgtaaaacaatgcaacatttaatagaaatacgggacatttgtaaattgggtacaatatgatcaatcgtaatgcatgacttgccttgctttgctgctggaggaacctcggcgactatttcaaagtacaccggagcgtcgggagaaccggaatctaagcgacatacaaaacaaacaatacaaacaggccataagactattgaaacagagaacaaaaccatttttaatggattctatgcatttttcttgatttactaagacttgaatgggcttaaacggagcaataattaaaatccttaattgatttattgcgcaataattaaaatcccagggagagagagggggcggcgccgacatgcgggcccaca

SEQ ID NO: 11099 - DNA, 1501 bp, Oryza sativa
catcggcatttcgacaaacacctcacgcgcgcgcttctttggtgtcggtcgtctgcctcgcggcgggctgcaacgtcgtgacgcgctcctcctcctcctcctcctcctcccatggccggtgccagcggcgagcggccggcgagcaactgggactggtcggactgtgacgccgcattcaccgaggaggccgacggggcgatcgccgcgctgcaggacacaggcggagacgggctcgccaccaagcagctcctcgggaggtaccacaccatccttgcgcaatggtacttcgcgcgcgcggatcagcaaaaggcgacgaatcacctcaggagagcagcatggatggccccgtgctgcctgcacatcgcctttgcgctcgcctttgtgctcatcgagatgggctccttcgatgaggcagacatggtgtgtgcccacaacctcctcgtgccggatctcaccaaccctgcgcacaacttcatctccccgaaagagcaggttgatgccatcatcagctccaaagctccagagtatagattgggacgcggggcaatttaggcattttgaaaaaatactcgccactttcagccgggaaatgataaaataataagctcggtgtcctacggcaaatttcacaaaatttgtagtgtcctggagcagttaaacattttctcggtgtccctcagctaattacgcgttttttgagtgtcctgtagcaaattttgctataaaaatattaaaagaacactatacggtattaattaaaatttggaaaaaaaataaattctgaaattagaaaaagaaaaaagatttaattagaaatataatttataaataactaaaattggtgataaaaaataaatactattgaaagaaaagaccatgtaaaacacatgacgacataaattaagtaacagtcctataaaagaatagagaggtggtggttgatacgacatataaaaattgttaataatacaccaaatagaattataagtaattggcctataaaaatgtagagtggtggcggttgagaaaacatataaaagctgttcataaaacaccaaatagaatccaaatgacgattaaaaggagggacgacaggaaggccgtgaagcaaacgggcaatgcggttgccgggacttcttgaaagtagaaaaaataaaccccattgataatcatattcaattttaaaaatctcaatgacaataaaaaggagaagcagcgggcggggtgtataggagtatagttacatagccgtacagttggcgggacttctagaaaataaaaaatgaattccaacaatagttatgtttgatttttagaatcccaatgataataaagactaagaggcgaatgggtcgtataggagtatagtggcatcgtgtgacgatacttcaaaagttataaaaaaatgaaacccaacaagacaataaaccaatttttaaaggttcaaaacttctacaaagtgaaaaaaacgatgataatcatgttcgattttaaaatctca

SEQ ID NO: 11100 - DNA, 1501 bp, Oryza sativa
cccttggattcgtttggaaaccctcccctaatcccgccggcgccattgatggagcccgagagcgccacgccggtttccttcccctccggccactctctccctcttccaaccctatttaaaccctccccgcacctccttcgtccgtttctgcctctcgccggccttcctcctcgccggatttgagctcgcgacgtcactctctctctccgccgtcgccgccgagcttcggtccgccgccgtcgtcgccccggaccgcctcccacctcggcgccgcctccttcgggttcaccgcatcctcgccaacctcgtccacctctccgtttcggtcgccaaccaccggagcgccgccgacgccatcgacccgagccgcgccgccgcctccctccactccggccgcctcctccgtcgccgccgtcgacctagggtgagccgtggaccgtcgcctcctttcccccttccctcccctctctcggccgccgctccgccgtgccggtggtcgccggcggcgaccatcggggcgcgggcgcgccgcctcccgccgaccgcgccagcgtggccgccctcgtgcgcgccgagtggctgccgcgtggggcccggccgtcagccgcccgcgcccttgggtgcggctgacacgtgggacccacggcgccggctggtgcgagcccaggtgcgcccggtccactgtgggccgtgaggctgccgcgtgggccccactcccgtggacccggtccgcgcgtcccctcccccttggctgacgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagatgctgcagcttcggaagatccgctcttcgtggaggttgaagccgacgtttgggaaagcgagcaaggcaagtcacatcatccttgagcatattgaatcctagtttataaaattattttgatttaaattattgcattatcgctttacttaaattcacgcgttatcactgttttatctagccatgcctatttacctttgttatgaccttattattgttattgttattattaccttgttcaccctagattaaaccaaaccccaactagtggacactctactcatggtaccactagtatgcttttaggtagatgcttcgctggttaattaggcaacattaggtggttttacaactctagactttgggagtattctcatcacctggacactatggaattgttggatcattgtggaattggattcacacctccccctctattcaaaatcctcaaaatggttttaggctgggctcggggtgcatggttttgatagtagcacctcggccatataaggaccggt

SEQ ID NO: 11101 - DNA, 1501 bp, Oryza sativa
gatccgacgcggaggcactagatccagccgtaggagcatcagatttggtcgcggaagtgccggatctgccacctccctcgccggggaggatgtgccgctgccacctccaggtctccggttcacaactcgtcacgctgcctctcccacgctcgagacagggcgcctctacgataaggcccctccaccgccatcctggctcatcgcccggttctccgacgacacgctccggcggcagcgaggtggggggatggggaaggtgcggcagtgggggctagggttttgtccctgagtcgcctaggcgtgggtgacgcgagagcctagaacaatttaacacatactacctctatcccaaattaattgtgattctaggttgtttagtgttggaggcatgccatgaagcccttcgaccggacctgccgaaactatagtaccagcaaggattcaagccaaagatgtcaaggccattcaggcgaagccctatggcgaaagccataagcgaagatggcgaaggctggaaagccgcgtcggtattctgaaagtaaaggcatctcgggtgaaggcatcttcggcgaactacaaagacttcgccatgacgagttcggcatcaaggaggcccaacaggccgcccctggccttttaagcccgtttgccatagaccaggcccagcctatcagcccattaaaggcctatatgtgcaaatgacactgcatacccatgtaaatgtccctttcataagggcaaccatgtaaaatcccctgtaacactaaaccctagaaagtgcaagcttgtgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagtacccgcgtggtacggcgacaagggctgggggcgaaagtgagttaagtccaagttggggggctacgaagccgcccaagcctctggacacctttcgccacatgccacgcccttcgccatagtaccaataaggcacggcgtcaagggctgctggcgaacaggtttcgccaacccacgcccttcgccatagtgccaatatagcacggcgtcaagggctgcgggcgaacaggtttcgccacacgccacacccttcgccatagtaccaataatgtatggcgtcaagggttgggggcgaatataagttgcttccaagctggggggctacgaggccaccctagcctctggagcctttcgccacacccacacccttcgccacagtacccgcgcggtacggcgacaagggctgggggcgaaagtgggttaagtccaagctggagggctacgaagccgcccaagcctctgtcgcgaccgagaaaaatacattttcccaaatgc

SEQ ID NO: 11102 - DNA, 985 bp, Oryza sativa
tccgccgcgccggtggtcgccgccggcgaccatcgggaagcgggcacgccgcctcctgctgaccacgccggcgtggcgccctcgggcgcgccgagtggctgccgcgtggggcccggccgtcagccgcccgcgccctcaggtgcggctgacgtgtggggcccacggcgccggccagtgtgagcctgggtgcaaccggtccaccgtggaccgtgaggctgccgcgtgggccccactcccgtggacccggtccgcgcgccccctccccctcagctgacgcaataaaccccttttttaaattaaaatttaaatgaagaaattcgcaaatattcatttaaagagcatataaacttcaaatggccataacttggccatttgaactcggaattggaccgttcaagtctctaatttttccttaagaagtcaagaaccaatttttgtgctttattcctgcttgttatatggagtttattagagtaaaagccttctcttttccgctcttcgtggaggttgaagccgacatttgggaaagcgagcaaggcaagacacatcatccttgagcatattgaatcccagtttataaaattattttgatttaaattattgcattatcgctttacttaaattcccgcgttatcactgttttatctagccatgcctatttacttttgttatgaccttattattattattgttattattaccttgttcaccctagattaaacaaaaccccaactagtggacactctactcatggtaccactagtatgattttaggtagatgcttcgctggttaattagccaacattaggtggttttacaactctagactttgggatatttatatcacctggacactatggaatggttggattattgtggaattagattcacacctccccctctattcaaaatcctcaaaatggttttaggctgggctcggggtgcatggttttgatagtagcacctcggccatataaggaccggt

SEQ ID NO: 11103 - DNA, 1501 bp, Oryza sativa
accagatcaatcgcccgcaggagtcccccctgctggttcgcctcctgcacgagtcgccgccgccgagcctggagagaagagactccccttcgccagagagaagagactccccttcaccaccccgctccagatctagaaaggagagaagctaggctcccctacaccaccccactccgctgagccttgccgcctccctaacgccctactggggcaatcaccaccatggacaccgccttccagatccactctcgcgagggagagcttggccggccggtggtggatccgccgctccttggcccactgacatcggatctggagcccttcatcgcctccctaacaccctgccggagccgtcgccgtcatggcccccaccctcaggatccgaactcgcgagggagagctcgagtggccggcagtggatcggccactctgtagctcgctgacgacggatccgcggaggccaatcatgtttcgttgctgctatcgccgccaccgagcggcatcaccgcctagcccaaccatgcaccgccggttcagccccacgcgtcaccaccgagtcccctcctcgctgccgctgccggtggacctgccaccggtgggaagggaggaggagatgggtgcgatgaccgacagtgggtgagcaaggtgctgctggtgctgctggctagtaagatattaaaaattgaagtttatgacaagtaaaatttcttatgtccaataacaattatttattaaaagtcagtctataaattcacactaagtatgatcctgtatgtcacgtctgataaattcatcccgaattaaaaatcattctctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagtaacaaaaacaattatcaaagtttattaaaaagaaaaagctaaaaataatccctctccctcctttgggccaagtctggcccaaagcctccctctctctccctcggcccgcggcggaagtcctctcttcctccctctctttctctccctctccttctctccctccttctcttgggctccccttcccctcggcccagcttcctcctccctctctctcccgggctgcctctccctcctctcctcttgggccggccgctcggcccaagccgcgccccctgcccgagccgcccctccctcccgcgtgcacgcgcgtcgcacgcgcgctgagcgcgcgccccgcgtgggacccgcctgccaggcgcttcttcctcctcccgcacagctcctctctctctcccgtgaaccctagtttcttgctctctcgaatccgcgcgattctagcgttggattccaaaattaattggggggaattaatcccctttccttctttttggattcggcccggtttccccttggaa

SEQ ID NO: 11104 - DNA, 1501 bp, Oryza sativa
gagagaggacgcaatgcaagcagaaagagagatggatggagagctagattttgccttggtttgagtacgacgtaggagcaaaatgatcgacagatatatatagtgatcgagcaacgcggtccgatccgcgacgtacgtactagctaacgaactataatctcttatttgatataccgatcgatcgatacacaacaatttgaactatatcttatttgatattctcttaaattttaatttctctcgacgcgcgcaggtcgaaacctaattcaactcggaaggatggattcgttccacaacaatttgaaagagctagctacgtactatacgtaccaacttcatgcatgcatgcgtagaagcttctccaataggtgcgcatgctcgtaccatcttatttgcgttagttaattagtttcttgtcactactgcctagatctccttaattaattcgttggtatggagtactaattaatttgatgtttgtccggtctatagcgagacaaccattattacgtgtgtgtatatacggaaacttctttgttgcattaggtatgtacgccatgctgcagtacgtcgtatcaaccaccttgcatgagctcttaatttggttgtcatccaagagagagaaataattgtggacccagcaatgcatatggtgtgtgagtactgaagaattatatacttattatgcgttttccacgtaacgcaaaaatataaatacaataaatatacttgtgaaatttgtaaagcagtactctatgtgggttgaaaataataactatcgttttaaataagactgatgttaaactttaaaaattttgagtaaaaaaagcttctaaaatatttgccttatcttttcatatgacagaatattcttttatacatatttatataaaatatttttttttatttgtgcacgtaatcgttcagttttattcgtaatataatctcaacgaaattctttcatacacacacacatatacgcgtgatgattgacattttttattggttactcgttctaattaactactccatatatataacatataaaggggaacaagagcagagacatcctggacggttttcatgctatataagtttacttgatgtatatattactgtacgaaagaagaagaatgaagtcttgttgacccctcctaatctcccatggaaatacattggtgtcgagttacttgcgtgtggaaccttgagtcaactgtgttgtaatcaatgtataacaggtatatgtttgtcagttctgccaaccatatctaatatggtttaatttggttatgtatatgacacatttggcatatagctatagcttgggtcattgttttatggaaacacattatatctgcattctcatgggagttcctctcaattaatgggctcttgcatcttgaatagatctatcactcaaatatatacatatttattgcaaacttgatcactaattaatggttcgaaataatactgtgtaatcttaacagttaaacgttag

SEQ ID NO: 11105 - DNA, 1163 bp, Oryza sativa
tattaagccgtcacaaggagagtagggttgtagaagacgatgactagggtcaagttgcattaggtttctagtcaaccaaccacaatactacatgagtccagcaaagatcacaacgagccaccaacacatgacaacaatggaatcccttgacaactaatttgtgatgactaaaccttttttgaactttgtatatctatatattattattagtatcatctttatttgaaaagggccgaggagctccatatctagttaaaattattggaattgatattaatgttatgaacaaccaattaggtaccactatcagccatgagacatgcgctagtcgctaaggaaaacattgaaaaaacaaatttcaaataataattagtttgtattatctaagatctcaattttagtagtatatattaaacttgatgcatgcaaacaagaactccaattcttcccctgcaagcaagcctcgatggatttattaaatgacgtatgattgccttatatataaaaaatcgtatcggatataaatatgtaattactaataaattttagttaccaaaaaacaatttaacatttagaaaaatagcagggtctgtgcaatagcgcaggatacatatctagttttactaaaatagtgacacatcctaaaaatatgtactgtgataatccaacaaagtatagtattccaaaaggaatttatatttttttatatgtggtcttatgataaaatgaatgacgttgtggttatatcagatgttaatgatatgcctgaaaacatatgcacagaaattacgcaaggaacaaaaagcatgacttgtggctataattaacatgacgcgctatgagcgtctacgtttgtacatgatgaacttttgacttctatggttaagcccgggggagggggggagggggtgggagggttgaaaataacattcacttgttcaattttaaaatgcccgtgctaactcttatctctcagtgtgtccaagcgttaatttgttgtatatataatagtttaccatataatttgtagacgttcaataatattattgtgaaaaagaaaaaaatctgacgatgtaaatagtatataagtaaatatcattagatagtctctgcctctctggtctaaaatggtagcaacgggctcttttaatttgatttgcagg

SEQ ID NO: 11106 - DNA, 1501 bp, Oryza sativa
gcgccatgaagacgccgctttctaaggtctagcagtcacgaatctctcttagggatgcagacaaggaacaaggagtgacgctgatctcggatcgatttgttggggtgatcgacatcgatccccacgagccatcagtcctacacttgctcgaagaccactagtaggaaatcgtccatctatggcgttttgctcatgacgttgtataatttcgtcattgaatacagcatatctatgacgaaatttcatgtttcgtcatggatcactcatggcggagggtagacatcgaaactccatgacgaaatttaaaatggtgtcataaaacaatagataatttcgtcataaaatggtgcgcaccattcatgtaacacacttatgacgctcctttattaatacaatatgctgaaatatatttcgtcagttgtaagtaaatctctattctgctgttggtcccaccttgcatatgtggctatctaggttgtcactggaccccacattgtatacgtggctatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccacgacttgtgactaaccataattctagcttaaccactatgctgcaaggagctttcatgctgatgatgttttacttttagttttcctttcaattctcgaacacaagaatgattgaatgctttatgcgggcgacctagtggtttggtcagggagggaggggggcggtggcgcagggtttggtcacagccagggagggagggtggcggcggcgcaggcggagctcagtgggggcggatcctagccaccgggacggcgcagaggaggaggtttcttatcccatcggtgcagggaagggcggctccacaggctggccggcatcgtgatgtggagcatcgtggtgggtggcggcgcggtgaagtgatcttggtcggtggggctgcggagggatcccggtcggcgcgggggatcctcgacgactgagacggatcggctgctcctcgcccactgtcttatcctagcacctcctctctcaatcctgtcgtcagcgcgcacagcccatcaccaacgccgttcagtagatataaggtatgattttccataagtacattactctgagtatgaaatgcaagttcagctatgaaagattatgctttgtgttgtatgaacagagaaacaagtcagagtattatgaacaaatcaacatggtttaagtcatgtagcaaccagctgttccatctaatgttttagaaaatattctgtcctaaaaaatggattagctttgtttgcctaattgctttttttaacatgc

SEQ ID NO: 11107 - DNA, 1501 bp, Oryza sativa
ttcaagttatttaaagtatgacttaattttttttatatttgcatagattatttttagtaagaggaatgtacgtaaaaaagctaacggcatcatatattgaaaatctgttaaccgaagagattgaaccttcgaaatggttataagaaatgttgatgtcttaaaacatttatcttgagattatttatttatgcactaaaaatactcacacagtacaacaaaaacctcatatagagacactttatagaggcacttcaaaaattgcctagaaaacttttactctggagacattttcagctcagtttattagattctattttgtagaggcattctttcggcactgtaaaatgcgcctgatatgtaaaggcattttcttgggatatttcaaactatgtagagacactttttggatgataatgtgtactaaatgaataaatataagcaactaagggcacaaacatacaagtaattaatgacatggatttgagttggttagtgcattgaagataaaaatgattcgtccaagagaccatgagttcaatgcatgacaaaacgcaaaggaactattttattcttattttttggactggtttcatatgtttgtggtacaatttaatgtttctagaaaatgcctctaccatcttataggcattttataaaatatctcttcgtttgtagagacaattcaccataagacacctattagatattttttaaaatacctctacagtattgtaaaggcaattttcttgtagtgacaacactagtgtctgtagtcacctttgttctagtttttagcatttttgtcgttatggttaactcctccattatcaaggcattttgtgaagaccattcatcatggcataatagattatcataaggtttttctttagatgaaaatcgcatggaaaataggttgtggtggcgccagggtactatgaggcttgtccatcgagggatgcttcttttgtgtgatatctttacatgtcggtctagagagtcgccttgtcaacatatggcagatgcagctggtgctgcgcggtgctaggacattatctgtgccgctttgcacttcttttcctacttgcccctacacgtggtagagaatacggtttgaactttttttcacgacttcctcaaataatccaataagacatggcatgaccaccaagtataccaaacaatatctaaaacaaagcatcaaatgcaatgatgcaaaactttacatatcacctctatctgttacataccacttgtacaactaagacgcacaccaaaaagagagaaattgatgagataatgagtcagtcctcttgtcgatactccgccggtatgtggggtccaggcaaagatgagtcaggtggggcccaactcgatgtcgcacgtgcacttcctttttcaccaaccccaccgagaagttgctataaaaggaccaacaatctttgcacactatcctccacaagagaaactaggatcttcaagtatagctagcattgcgccctca

SEQ ID NO: 11108 - DNA, 1501 bp, Oryza sativa
tttttttgataaaatttgttataggaccctgcaacattatagttttagcccatcgacacaaaagaaaaataatcaattttttggaggaaggcactgcgtgggtgacgccagctctggacaacgccttgttaccgtgcaccatggctggacaacctctgccatggccaagtcggccaagcctcgagctagcacctctgccttccgagaaaattgatattatgccatttttagggtggggtttcgctgaaatgctactttcgaatgtggtttcgttaaaatgccatttttaaacgaagccaacttgccggaatgccattttgtccattttatatgatttggaaatgttttgacacatacaccgacctttttgccttggcctatccacccacatgtgtgagaaagagggtcgttggcgatggagatggcgaatgatggcaggaaggggagaagagcaaagcgaaacgaggaaggggaagagcagaggtgctggagacgtcgtgttcgggagatgctcgcacgggcgtgaccggtgcgacgggggcggaggtccacgacagcgagacgactaagaagaagctcgggtagaaggcacatatgcccgcacgggcgtgactggtgcgatgggggcggaggtccatgacagcgacgtcactaaggaggagctcgggtagaaggcacatatgctcgtgcggctgtgattggtgcgaccgtggttgctcctagaggtgggttcagcgtcggagaatgcattgatggcgtggggtggacctcctgggtgagtgcgggcgcagggagtggcgcccctagagcgaattgaggaagggggcatggtgttggcgttagaatgcaggcttggggaggagcaacggagaagaaatggcgatggtggcttgccactgacgaacagaaaagcaattgaagagatggaatctataggggtattttggtcaaatcaccgacaaaaacaaggaaaaaaaatcatctattgataagaaatggatgaaatggcattccgacaagttagcttcgtttgaaaaatggtattttgatgaagccacatttgagagtggcattccagcgaaacctcgttatgaatatgacaatatcaattttctcatcattccctcacctcgaatatggaacattgggatatgtaaaccgcctggtgagtggtgactaatgacttctcggagtctatcgttcaaataaaaggatgtgtttgttgaaaaaaaatattataataacatggattttacttttcttttcgttttaataagcactatccaacttggacttctccggcttcggagttgagagcccttgggtttttggttcttgggccctaccctatccagcctattaccacctgccgagggaatgcgatgcacattccctttgctcgaggtcgaatactcggaatccacgacacgagacgagacgaaagcttttgccgcaatggcgtctaaaccaagcagccgagcggaaagcaaccaggcggcgg

SEQ ID NO: 11109 - DNA, 1501 bp, Oryza sativa
agagaatgcgctcttaaagaatgggtccgtcgcggcctttaaggataatcctgaaaattgaaacatgcgttcaatggcattccatacaacatgaacacgaagatttcatgtttaaggtattaacctgaagaatagaacattctagcaacttcagcatccaatcgagttcgaagtttcatatgaagatcctcatctgcagctttgctctttcttttatttgactgaaacatacccttgcttgtagggggcaagccatctgaataatcgacagatcgttccacaccttccgcatgttcccacaaaggctcgccactttgtctagaagaactatcatcatactccatatcacagtctttggaactgttacaaagatgtcataaacagtttacaaggtgagtatgcaaatgctccttttttgctcgatattagaaaatcccaggaaaatgtacataccgtgcaacactaggttcccccattgaagctccaagttcctctctacaccaacgaaagattttgttaaaaaaagaaaaagaaaacctaccagaaggtcgcctaaaaaatatctaaaaataatataggagatcaacaacaacctcccatagatcacttgatttttcattttgccaccaaaattggcactcccaccaataaaatgcatcggatgcaatatttccccccaatcaccatgcctcaaaatgcacgcgtcaaaataaaaaaaaaacctaatctcaatggggggaaatcactcctcgccgacggggtaaccagtccaggaaacctgtgaacgtctcgtgcgcttcccccctcgcaacgcctccgcatccgaccgccatcgcgaaggaagcacgagcacgcgcacacgcagagggaaagagagagaatggggggcaggggggaggaggggaggggcgcgccggacatgcatacctgttgcccgcggcgagctggctctggcaccgcggcggcggcggcggtggctgggcctaaaccctcgtcgcgagacgcgggaaaccctctccaccttttcacctcagcccgcgcgaaggaagctcactcgccgacgagatgagatggatggtgactcgcgagtagtactagctgtgcattgcatcgcctggcagctagggcccacttgccagaactgtttcctaaggtgattagttttcttcttttaccttttttttttagaaaaggtgattagtttcctaacgttccatttttgcacggtatttgtccgttcccataaaaaaatataaagatttcaaatataaggatttctgaaattattcatggatgtgaagttggtgatatatactcccgcgaatcctaattagcgcatagaggttaagtcgcgctcgttttctggcctctacacagacgcatttaccttttttttgcaacgcgttttccattttttcacaacgaagcaagctctatgaaaaacgttcctattttttcgacgcaacaaatctgccgcatgtacggaaggaaaaaagcgtgt

SEQ ID NO: 11110 - DNA, 1501 bp, Oryza sativa
tcttatttttcagttgtttggaggcattggttggtggtttggtgacggcttcgttgtaggcctggtggcatatggtctcgtatatcggtggtcagtgcagtgtgttagcccattggtgtaagagtcatcgacatgtggtggtgaatttgcttttctttttctaattatagccttcagggtgtgtagcattgtattttttttcctgatatatctatatgaaacatctccctgattggtggtgtttgtttgaaaagaaagtttatgtggtgctatggtagcatgtagcatcacgtttatgtctatggtggtaaaattaacatgcaaatctatgtgagtactttggtttggttataaggagtaccaataacacatttgatagttttgaggggacgaaaaactcagtataactataaattcattacgtgtttgaaggtgtgtgctcaataactatggtgtagtactactactacactataattaagtacacggttgatttttttttcaatctttgtttgcacgaactcaaagcggattcaatgatccagaaatcaagagtttttcctctaaaaactgtcacgagttttttttaaggaattccgcgtgcaatgcattttgggcttgtttactttgatgctattttcaaccatatcatttttaagtaaagttgctaaaaaaatgtctacatttagtttgttgccaaatttaatcaatatataagaaatcctattaaaattttaataatattatcatcttactaaaattaacgcttgggtagccctcactcccgtggatttgccaccgtttaaccgcgccctctttgaacgcgggagcttggactttgacccggtcagctaatcctagcaccaagcaaaaacgacgacttggtcagctggtcctcgtaatgtgaagttgtgaaccgccccacccaaatttcccccaaatcgacgacgacgacgcccccaattgctcgtcggcacaagcaacaaccgccgccgcgccaagctaaccctagcccacgagatgcccgcgcccgcgcccgcggcgccgtggcccgtgtcgcaggagatctcgtccctggccgaccgcctcctcgcccacgccggcggcgacggcgacggcgccgcggggatgcgggacctcgcgggcgcgctcctccggatccagcccgtcgcgcgcggggtcgagcggcgcggggacgcggggcagcgcgacctcgcggactggctcctccagctcaagggcgccgtcgccgaggccgacgacctcctcgacgagctcctcctccgccgccgccacgggagccggctcagcccttcgttagcgtcctgcttagctcgcggcaagccgccctcccgggagctcaagcgactggtgggcaggatcgaccgcatccacgacgtctccgagcgtctcgttgacgccgcggcggaagaagaagccggcgaggcgggtcgcggcgtgaggtcgccgaaccgcgtgaccggctccgtgctcacggaga

SEQ ID NO: 11111 - DNA, 1501 bp, Oryza sativa
aatctctctttctcacaagaattaggctcttgattgagtggagaaggcaagaaaaacttgggagaggctagcaatagctctaggtgaaaagtgaaagtggaatggccaaggaatgagctggaaactagctgtatatgtataacggctaggtgacgtcatctagccgttactcacaaatttgaactggaaactagacaggaagttccggacctggaagaccggaacttccgaactacacttaggaaaatctttttcacaagaccggaacttccggacccggaagacaggaagttccggacttgcatttttggacagatggagtatttgcaaaaatgactcctagggaaacttgacacttagttcacactaagagcacttgatatatctcagagcatcacctggaacccctcttaatagtacggtttttcctaaaaactcaatttcaaaagataaactatcctatgcacttctcgagttccggtccgctttgattttgtaccttttgggggtctccaagcatccatcttccacaccttggactaatgcacctgaaagtcactcaatgaactcattagtcccttaaccacatttgtcattaatcaccaaaacccactagggggattaatgcactttcacacgctccactttcttctattctcgctttgaggagtacgccgtggaacctccgaagatgtgcgagacatgaagatcggaatctgggtacgccgagtccgagtcctgagtggttgcttcagcggccttctcgactacacgtactcacttgcccttctccaatgccagttgcttttccagcgactttttgaagatgaggcaatcctctagagaatgtatgttcgacttgtgtatggggcaccatattctcttcgtgtcgctgccttgtgggtctgggtgtttgggagggcgctcgtattccgacgcaaggacttccgcttgagctttccttttcccactattgccacttttcttcttgcttggttcaggtgcgtcattggttggtttcttctctccccctgtcttcagcttgtcattcttgcgtctcagtgcatcgtctgcgtgagcgcatcgatcgacgacctcgaacaatcttcgagtagttgtgattcgccttgttgccaactcctgggtagtatagcgatctctgacaccggttttcaaagcgcatcacagaggcgtcggtgatttcggggattgtatttctgtactcattaaagcgccaaacatagtccctcaaagattcgcccggattctgtgttaacgcgtgtagatcgtcttcgatcgcgtggcgcttgtaagttccttggaagttggtgatgaattgctgccacagatctgcccatgaagaaatcgagtagggcgggaggtgcatcagccacgaacgcgcagaacctttcaacgccgtcggcaaatagtttgctaacgcgttctgtcacgaccggaattaacccaacgggcgttccttacgtgcgtgtattattccttg

SEQ ID NO: 11112 - DNA, 1501 bp, Oryza sativa
ccgcagcctggtggtccacgagcggcccaatgacgttagtcagagggagagcctgcaccacatgaagttaggatgcgatttaggaagaaaaagataaagggtcattgattacactcacgttgattgcagcttcgcgctcagccgcccctttctcacaaagaggggcggggacgttgctcgccgtcgtggggccgctgaccatcacctggccgacacggtgctccacggtctcgctgttcaaacctgtagatcgggaaccagattttgataagtcaggaggaatgtgcgcgtaagggagggaacccagaatgcaagaaaaatacctcgaggagatactcgggtctcgtcctccggcccagagtagtcaaaggcgggatgggctcgagcctggagcggctggatccgtctaccaatgaagtcggcagcgacttcataccccgacaaccctcgtactccgaggtcatcgatgatatcaataaaagactgaagggatggggtcaaggcgggtttggcggtccaagacggaatcttatctggttgttcctcagggacaacgaagactgcatccgaattctctatttgaagatagaaccacctcgcccgccatttactacgagaagaggggcactggaaggggatgtatcgcgacttcaggccatcccgaagtccgaaaccaacacacccggatacctttttaggttccatccagcgcaactcgtagtagaaacgaaagaggtcaagaaacggctctaccccaatgtaggcctcacagatgtgtgaaaaaatgctgaggaaggctatggaattggggttcagatggagcacagaaagaccgtagaaattcaagacgagaaggaaaaactcagaaggcggaggaagaaaaccacagagaatatagtcctcaaccgcaaccatgcggcccaagacgggttcaggttcagtacctcctggtttcctctccatggtcccgtaaccggggagagcgccttcctcctgcaacttcttcagggatgcgctggtggaagtggacttgtcgaggtccattgccgccggggatcggcggagaagagaccgagacgagtaagttagggttcgtgcggaagcgaaaaaaacgaagagcgtttggaggctagaaagttttcgcaacaagcggactccaaaatggattcacaaaactcccttaaataggcacactaccgacggtgcgaattccaaggaaaggagatagatggccgccggaaatttctgggtccgttacgcgcggcagttttggaacttcaatttaaattcactcataaccgttgaacttcgcatggtgttgtcgactattccttgtctctacggttcttacaccgagaacgaccagtcgagaacgacaacaactccaacatcagaagtcgcgatcggttacatgagttcatttaagcagaagtcgggggctactgtcagggttacggataaggcataccctctacccttggatatacgctatgcggcaata

SEQ ID NO: 11113 - DNA, 276 bp, Oryza sativa
cccacgagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttattctaagcataattttgaggatgtgttttagagtcgttttgggacgc

SEQ ID NO: 11114 - DNA, 1501 bp, Oryza sativa
atagtagggtttcatttgcataaacagcatttaataaacatttcagaatttaataaaacagttaagtaataattaaacaatattaatccaacgctatataacataccctgttgtataggcccaaccattctgaacaaccatacccggctgtacagatctatctccaaaccaggaatataccattccaaaccaggagctaaacaaattattaccagttatagcatcttttattatgatgagaggtgtgagactaatcacgaaagacattgttagacccgcccataaccgcgggcacggctattcgaatagttttactctggccagaggtgtaccactgtacccacaagacacagccccacaacatgtcaccatgtgcctcaataccaccacagtacctcggaaaggagctgtgacaatacccctcgcacaacacaatccaccacagggcacctttcctggatcataatcacccccttataaacaaggcatggactccccagcaacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccactattatcaagttttagttggcaagtaattaattaaccaatcacgattgaccatcgtgaactatcattaagccatcattaaataatagtgaatcataagttaacccaaaagtgtgctaatgtttctaagcatggctaagcaatcatatctaatatctagctgaaccaatatatatatagcccaactagtcaagttataataacccaaggtatcaaggaataaagtaatcaagaacaaaaagggctataacaaacaataggttaattccacccaatgacattcgaaaataaatgcaatagttgaatagaaacagtagctttaaacgggatcaacatgctcaaagggttgtttgggatctgtgtgacttgccttgctggccttggaactcttcaaaatcttcccctgcgaaaacggactctccggaaacgtcggaatctaaacagaaaggagcaaaatcaccaaacagcacataaacaagcatgaacagtacatgtgggtatttttaacatgtagatctcgattttagaaaaatttagagacttgaacccactaaattcgagctaagatgaattagttatgaatttttaaagattaaatcggattaaaacacttatatggattttaattgaattatgacgcaataatgaattatttttgaaaaggaaaagggaattattgcgtcagcggctagggtttgcggtggaccgggtgcacggcggcggctcacggaaacgaacgaccgagatcgatcctatccaaaacggacggccgagatcgaacggtccatgaccgggccacggcagacggccacga

SEQ ID NO: 11115 - DNA, 673 bp, Oryza sativa
aaaatttggatttgttttgttttgaaaacattccgaaaaatccggtgcctgaaaacggcgtggagtccggataagttacgcgcgacttatccggttcggttacgcggagtggagatcgtgcgggcaccctgatcaagcgacctatctctatataaaccgagccaccgccttcacgcaaaacacatgaaatcaatctagggtttgcctcctcctctgtgttgcgtcgtcgctcgtggactactccatcccgctcgtcagtgtgcaccggcgatcgggagagcaggtctccggaacctctgcctttcgacgtcctgcacctggagaaggcggcgataaggtttttgggaagcgcttcacgcgactgctccctgttcgtccgcgatggctcgccttcctctccgctcgcgtgctgcacgccttcatcgacgctcgcaaccgcgagtagttcctgccgagcaatcagtctttccgccacctcggtacgtgttcgacatgttgcgcatatttgatctgttcatgttttactgcttagtttacatgtatagatctaatgatgcgttaatgctagtatacatctgtaatgtcatgatttatttatggaatatattaaatcattatatgactatattctcaacaatccaaaaatcttaatataggcgctatgattttacta

SEQ ID NO: 11116 - DNA, 1501 bp, Oryza sativa
tctgggcgtgacaagttcctatcagcaaaatcaatttccacgtaagttcaccttccgaaaaagacttggccaccacttttttgttgtaatgtcgagcaattctatcgttatctttggtaacttttgcaagggctctcaatcttgattgaaccaagttcgccctctcatcggccatgagattgtaatattcatcggctgccaactcattttgtaagtctgtcttcctcgagctgattcgaacttcccatggtaaaaccgcctcatgtccataaacaagtttataaggaggaacttggatcgaaccgtgacaagccatccaataggaccacaatgcttcggccaatctagtatgccactgcctatgataatcagaaatcttcctctgaatcaatttgatcaaactcttgttagacgcctcggcttgcccattagcttgtgcataatatggtgaagaattcaacaatttaatacccatgctattggcaacttgaacaaactcatcggacactaagatcgagccttgatcggttgtaatgatctgaggaataccaaatcgataaataatatgctcctggacaaattgtatagcatcccccgaatcaactttcttcaaaggaatcgcctctacccacttgataaagtaatcggttgccaccaatataaacttgtgtcatttgctcgataaataatatgttttttttttgttttttttctgttttgttttttcgcgtttcgggtttggactcgcggggagctcttaagaaggcctgatgggcccttgtgggcttgggattacagtcgcgtgcggcccatgggccagaacgggattgatacttggggtgacaaatttcacattggggccagggatcccgtgggggccgcccctacggggcagtggtgggggttctcacccatgggtgactggggatggggccccgcaaatttctagggacggggatgaagatcattagtcatacacgagtaaaccgatgggggctctggatatgagatatgtcttaaaaagtagtccattccaacaatagaagcttagttgacccaataagtgagccatatttactaaacccaaattcctcgatcccccatcctctacccccactcctgtcacccatcccccacagccgccatcggttggcccacgtcgcgccaccttcgcccgtcaccgtgcctccaaccgccatcgcgcggcctccatctcactccacctccacgcaggcatgcctctacccgccgccggtcagcctcgccatctcctctcgtcaacgtgacgtgcggtcgcaccgcctcctccaagcatccttgcatgcgagtgcagcaagcccccgtcgtgtggcgggtccccagagagggtggggcggggatcgatttcaaatctccctccactctgggggtaggggctggatggacccgcggaggagtggggctggggccattccagcccaactcagccctgcccagtcccgttgccatccctaattgcgac

SEQ ID NO: 11117 - DNA, 1501 bp, Oryza sativa
ataaatgttctctaaataaaatactgtggtataacgctgtcactgaaaaaaaaaggttttcttccgaaaaataactcttacaaaacatagaataactgaacagggaatttttgcaattaatctgatttatttcaaatttaaatatttgaaatgccataactcactcgttttaaatcggatttcgataaaactttcactggaattcttctaaaacaagacattcccgatggcattggttggagtgccatggagtgcgagattaaaagcatacatacactgcagtgtgagcgtcgggacgtgtactagtcttgactagcctcataagttttaattctacttagaatagtattggaaacgattgtgtgacctctcctgacgtgtaggaaggtcagaatggtgagaaatgtgggaacctagatacgagggtaaaccgaaccaagtgaagcttggagaaggtggatgaaccttccttaattaacaacaacttcaacttttttatttaaaactgccaagtgataggtttgtgaaatctagctttatgttaataaaccaagctattctttgaaccccttatgtgtactaatgcattatgtagtattggcttactgagtacaggtaggattccacccgtacaaatgctacatggacgaggaggagccgaagaagatagagtagggacctaggtttctccagtcatcgcctgtggaataagatggaccatcgcagcttcttttccactatgtcatctactccttttggtgtttggtatggtaatcaaccatgtttggtcttttttatttgagttctactcgggcaactctagtattattaatgtatagtgagacctttataacgatgtcagttaaacatgatatgtaattttccatgtgtgtgcaatctactgatttataaaatagtattataaatacatgaggtctccgatgtacaaaacctagggcccacgttacgttcctatttctggcatctaattgcatcaccgtgattccctactagttaaacaatatcagatcgattaacaacacggtgcaattggcaaagcggcacatgtctggagctgtacttaactacttaatcgcgtgaacccaaattttttactactgacgaagaactaacttgatggggttgatccgtgagatgcaaccatgtacagtcacatgaacagggcacatgggtgattcatcaatattctgaacttttttgctgtttctttgacttcttgttgaaagtggatgtgaagctcgtcatattgtttgttgcttaggaagctcctcccgtatatagctctcaatcaggcgcagccttgacattgtatgacggttctttgtttctgcactatactaattcgagcatcatatagctaggctaggctccttacatgctttttccattcatgttgctaattaacagtgtcacacgcagacatctctcaatttcgtactagtgcagttctgttgcaggatctcctgaagattgatcgcaa

SEQ ID NO: 11118 - DNA, 1501 bp, Oryza sativa; identical to SEQ ID NO: 1065

SEQ ID NO: 11119 - DNA, 222 bp, Oryza sativa
cacacacacacacacacacacatatatatatatatatatagctaatataagtctattttatgtccctacttgttggcccatgccatataatatgtgtatttttcatccctattctttgtgccgtatcttacatatggttgaaaataagtctgtttcacatccctgaacttcgtgtcgggtcctgccggcccagcgtgccaaggtaacagcccagacatggca

SEQ ID NO: 11120 - DNA, 559 bp, Oryza sativa
atgtggggtttcttagtacaacgaatctgaactattatgttggtttttttttacggagggagtatgttgtttggttaaataaaaatgatattgctttttagaaaagacgaaaaaaaactgcatgtctaaccctataaatggctgattttcatgtgttatttggatgagtacgtttttagtctttgctcaaaatgaggcatgacaatcagtcattgttacgtcaagtctcacttgttggagcagacaacaatagaggtgttcttcaatggtgatggacagagacgtggcaaccggatttgcgaaagttgtttctctttcatatcgaacttttgccaaacttgtttgtgtggtacggtagttctactgtaatagtgttgatcgctgtgtataccatggtcagaatgttttgaaagaaatacgaagaagggtttttttaatcattatatatcctgtaattatcatggaaaacatttcgttttaatttggaacggggggtgaaatagctgagtggactaaatagacagaaactcagaatgtgatagatagatgcatgcatgca

SEQ ID NO: 11121 - DNA, 468 bp, Oryza sativa
gaaagctttttatatgaaagttgctctaaaatatcagattaatccatttttcaagtttgtaataattaaaactcaattaatcacacgttattaccacctcgttggtgtgaaacacttaatctttatctcatcttcaggagattcaaacaccaccatattacctaaaaatcatgtacatggtgatcaaagatgctcttcattacacatcaaacacgcagctaaataggggcgaatctttattatttatagcgagcgtgagtggttacggtatgcaattcctttcatcagcacagtgtgagcatcacgcgtccccgtcccgtcggcgcaccagcacagccacaggttggcccagagagggtgcttcaactgtcggcgcttgcacatctggaccgtccatcgcggcgatcggacggccacccgtcccgcaaccccgccccgcgtcgcctatacaagacgtcccaccccccc

SEQ ID NO: 11122 - DNA, 1501 bp, Oryza sativa
tcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaagtatctaaaaaaactgtcgcattttctttaggaaacactttcaaatataaatatattataactatattgtaactacgatataacttacgtaaaacttgtattttcaactatggtttgtttggctagtgccgggatcttacgcatgacatgtaaaattttctttatagcaattttttctcttcatgcagaaatctcaagatgatcgagaacgaccacaaatctataagttttggaggaaaaaactagcgaaggttttctagcgattccggtgtcaatataattgcagtcctcgatcgttacctagatagtcttgtgcatgtgagtatccgatcaagatcattcataatgttctcaaaaagaagagagagaaacctttcggaaacgaaactgaagtgtctctttcattttaagttttgcaatccttcattaagtagcactaagatactaatcacttactcacttatcactttcattttaagttttacaatccttcgttaagtttgcaatcttattaattaccaccttatttttaaagtgtacaacgttattaatttttctcataaggtttaatattcttcttattaaaagatttagtataaatatataaaattataaattaagattatattttatttgataataaaacaagtcgtaacaaaataaataatattatactacttttaaataaaacaaatagtcaaacgttacatgaagagttaacgatgtagtagcttaatttaccagtcctatttagagcaggtactcagattataagctagctagctataaatatattttatagaaataaaagagaagagagaagagcaacagtctatctgtagccagctgcagtacggactttaatacgta

SEQ ID NO: 11123 - DNA, 1501 bp, Oryza sativa
ggaacaaatgatccaaatgacaaatggaggtttttttttaggatttgggtccctgtataggacattgttgtcctgaatggcactttgagaaacgcctagggattttccggctagctccacaaggtggtgggctagacgacctgggtttaaagcctcacacattctaattatttgttattaggtcattccctaatatttgtgtctaaatgacactttgagacaaagaattggataccattaaaattctagctatgaaatgctcaacgaatggagatctttccaggatagttagcataaggttcaaactctcaaaaaatttcatttgggtccatctttgccatctaacccctatgtttttccatgtggtctatctaaatgattgtttatgtactactctacctccgttttttaatatatcacgtcgttgatttttttataaacatttgaccattcgttttattcaatttcttttgcaaatataaaaaaaataagtcatgcttaaagaacatttaatgataaatcaagtctcaataaaatgaataataattatgtattttttttataagatgaatggtcaaatatatctttaaaagtcaacatatcatatatatatatatattaaagaacggagagagtatacatttatcttgaattttacgttcctctattctagataagcatgtatataaaaatcctatttttttcctatttatatgcttttagcattcctacctccaaagagaacctaagtggtaaaaactaacaactgatagtgatggggtgtcctgccagattaaggatttagagtggaaacttccatatataccgaacttggggcgatggaaggttgacagataagtggtaaagcagaagtgatgcctccaaagccgtggttgggagggatatatagaagaagggcaggaagatagtgatagaagccaattggaagctggattgatatgtagtggtatagattcggtaacaaaaacgatgtaatgagaaagatatgttctagtgctcctcatctaacaaggaagaggaaatattattcagttgtatgtataatgtattaaccatttcatcgaaaagaataatctaatgaggagatctatataggtgggccagcttaatctaccttctttgacaaatgcgcctaattaacttgtcgagcaactggcttaatgatcttattctaattgtgcacgggacttaatttaaattttgtcaatttggttttgttggggtgacattgattttttttgtttttttttaaaaaaacaaggtcaccatttattgtaggtgtatgtgttggctatgtttgtagccgacgatgtaacttttagaggatgattatattggaatcatattgttggaatggactgtgtcgagagcttctatattgattttgtacgttactccctacgattaaaaaaggtgacatttgaactgtttttttgtcagtgcaaatttggtcataattttgtacaaaataaatttacaa

SEQ ID NO: 11124 - DNA, 1501 bp, Oryza sativa; identical to SEQ ID NO: 3898

SEQ ID NO: 11125 - DNA, 1501 bp, Oryza sativa
attgaagggaagttttccaagaggttagagtggatgctaaattttctacgtttttcctctagaatcgtgggaataggaaagtttcctacgttttttcttttctcttcctacaaatcaaagacatgaatagtgtagggtttcaattcctttgcttttcctctatttatcctccaattcaaaggggttatgtttagtttctgaaattgggaagaagtttgggaaaagttggtagtttggaaaaaaaagttgggagtttatgtaagtaggaaagttttaaatgtgatgtaatgtgatgaaagttgggagtttgggagaagtttggtgcgaaggccttaacagggttagtaaaaatgtaaaatgcaggagcagaagccatggaggaccttgtcctgtgctgtgcaagaagctggctgtgcatagaaaattggagtagcagtagcatagcacctgtgctcccttgtgctgttcctctgaagaggggcagtgatgagagattttggggggcctccactactctatagtcaagctttgaactcaaaatattgcaaggtgcatcgtgcatggatacatatatactacagtagtatttgccagtactctctactaggcgtactacggagtactatactgtagtatccgtgaagataacatttttatgctgttccttgtaatctactcaagtagttcagtaaacaggggaaccagcgcttctaccaaatcacccttgctctgaactgtcgcgaaagcttgaaattatctgatgcatcgagtagaccattgcagcgtgtgctgtactccgatgtaatgttatccattcggagtactactatcagtgttccgtactgtgtcttaagcctaaccatgagagtgtgttttgctgcagctttatatggtcgctgccactgccactatagctgattcccctgatccgtcttcaggtgccatccaatcaaacaaagcctatatgtttagatacaaagtttgaatccaaacttcagtccttttccatcacatcaaccagattacacacacaactttccagtcacatcatcttcaatttcaaccaaaattcaaactttatactgaactaaacacagccaaagttgaaggtatgtttgaagagtttcacagctacggtttctcctagaattagagggtgttttggtgaaacacccccttaaaatcttgctaaacagtttaattttttttcaaattgagaagctatggttgtacaatctaaaacataaatcaaaatttagaagttaaagaaacccagattttatatattttcaaaagttgactaacaaccagttacttccaaaatctcccgagccccattggttgccctaataaaccaaaactgaaactaaaatttgaattttcaattctcaacatggtttcttttctagctttgatttttaagttgttaagaacacacatataaatattttacctatacattattttttattttttaataagccgtttttgttctactaga

SEQ ID NO: 11126 - DNA, 1176 bp, Oryza sativa
catatatatagacatatatatattgtcggtgatatgggaccgggagtattgcgcccggaggcttgaggcagattgaatcgcccacgtggcctggcaccttcggggacgtcgggcccgagggtgaggtgtccgccctcctcctgatttccccgaggggggggtcgggttgcccctgccccggccccgaggcccgaggtgccccgaccccttgtggggtatgcactatgtacataggttgggtgaacacggtagggctcacataaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgttccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaagaaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaa

SEQ ID NO: 11127 - DNA, 1501 bp, Oryza sativa
ctccctgttcttcaatgttcttcaatgatttctgtgttagtgacagatctctgtgatgttcttcaatgtttcttgttctgtgatgtgtttgattggggattgaggattgtgaatgatttgggagttggggattgtgattgtgattcatcgcagggtggatgagcttcaagtctttttttcggctcgattcagtaactttttctatagatgtccgtagatatattatttgcttgattccgagtccgtatgagaaagttacgcctgttttaataaatgacacccattttcggtagatatttagaaaattctagatgtcacatattttgtttatttgagtttattttttccatggttggttcttatgtgctcctaagtgtgaaaataaatataaaaatgttggatatctctctcttctacactatagaggacaagggaggagaaaaatggtggcgctggggtgggggggggggaggccccaaccacattggcgcgctccccatgccacctcagcaccgccccgccacatcggtaggaggacggcgccagccactctgacgtctaaaaaggaccatttctacgttaagttttttcagaggtatatttgcgaaataaatatttcaaaagaagcaaattgtgaaaaatcctgcgcatgaaatctctaatctaatccggatgatcgatacgattaagctactaataatttagtgtggtatcatgggcatgacacggatctcaaggaaaatcattggctgaaaaaacgtgcgagattgagaaagaaaattgtggagagatgtttagcaatatcggcatcggtaactgattctttagctttgatatttgtcatacaaggaatgacggaaagcaggtcgtataggccgtggcaaagaaggcgagacaagctatattctagtccattaattagttgcctcagcttgtttccgcacatccaaaagctaacccaaggcaaaaacgagccaattgttcccatttctcttcatcccatcagcgagcctatcatgctaagctcgttacggtattatcagaactggttgagttgagcataggcgatgagaaaaaaacacacgagtgccatgtcggtgagatgcgcatctatggcgtcctaattgcgtcggatcctagccgtcgccgtgtccgggtgacctgctgctccgacgagctgtagcttggcttacccactcccgttggttgtcccttagggtggtttaatccatgtttcggctcgagttcctgatgcgtccaatccccaggagatcatgtcttctgatcttcatcagacagctggaagaaattggatggaattgaagttgattctgtcccaatttcacatgaagtctcttatatatatatatttatcgccattggttggattaagacgttgcaacggaaattcaatgctacaccaacccatttgctggttaattaattacttatcactggtggagaaaccctttgtagtcccggttcgtaacccccctttagt

SEQ ID NO: 11128 - DNA, 1501 bp, Oryza sativa
tttgggtagggatgtgaatgagtgggactggtaagcggcgcaagggcagctgcgggggtggggcccacgtgtgattgggttgggccgatcaagtgctggaaggaagcttgctagaggaaaaggtccactatgagtcccttaatgtataggtcgaatctgattcataaaaccgggtatcttgacattctctaactattaaaactggtgtaaaacaactcctctggcgctcctctcatcctaccgccactgtcgagaaggagaaagggaatgggagagagagagggaggaggaagggaataagagagagatgatgacaggtgggcgttgtcagtgttatagataaggcatacccaatacttttgtattaagcaaagtgaggctcaccatacaccaactattatagtcttatacggaatcatgcctcgtatacggaagatattccggataagaaaggagaaatatagttctactcggatgctacaaggactatttaggtcagcagcgactagattaggtcatcccagatattgtactatatatggtactgatatataaaacactagatttagccaacgggagtagggctattgtctatcaggtaaggaggttgaacatgtataaaaatccatgcctcctatctcttttacctcaaactcgcgtataccctggcaccaatgattctcatactctacaaatatcctatttggttacagcccattgacgggcatcacatgctgactcgatgtttggactagtaaacgagccacgctagtggaaaccacccttaaaaccaccgaggaaatcattttgtaccgattttatttgttaggagttcaagatatctagtattactattgatggatatgaattagattagatgtatatttgagggagttaaagtggaacttactccactgctataaatgggcctaaaatacaccccaaacacgaagagaaattgagcactttgagtacttactataaataaataaatttaatatcgaagtatttggcaaatttcccctgaaatgtaggaatggagagttcgaaaacaaagtggcacgagtaatcctccttaggctatattcggttaatcccaagagagagggattgtaggggatttattccacatctattgtggtgtggaattattttcccttaaaccccttcaatcccctttaaccccttccaaaccgaacaaaaccttagcgtgcagtcacaagtaacaggaaatggtctcatgtacttgctgataaatgatgatggcggtgaagcactgaagcgtgagatacctaaattgtgccgaatctgagccgttgatcctagatcccaacgccccataaagtgccacgtagtcggtttaccacaatcggaagccgttaaggttggaattgccaaggacaataatacccccccaactagcctcgtcttcctcctcccgcccaaacccgtctctccaaatcaagaagcggttcttggtttcttggccccgcggcagcaa

SEQ ID NO: 11129 - DNA, 1501 bp, Oryza sativa
ggtgacggcgttctcccgcggcgtgagcccgaacctggcgcggaggaggcggccgtagagccccgtgagcgtgaggtgttccccctcgcggcgcggcgtccacaggaaggcgccgtcgttggggctgggcggcgagcccgcctggatgacccagcagcacgccgcggagccgcggcagccgccgtcgagcgcggcggggagctcggtggcgcagaggtagaggccccggtgtccctgcagcctgacgtagtcgtcgccggaggtctccacggcccagacggtgccccggcagttgcggcggtagccgtgggtgacggcctccccgccgccgccgccgccgtcgtccgccgcgcagaggtacgtgcccaggtggctcctgagccgcaccgacctcgcgttctcgaagacctccattgctgccgcggggccaagaaaccaagaaccgcttcttgatttggagagacgggtttgggcgggaggaggaagacgaggctagttgggggggtattattgtccttggcaattccaaccttaacggcttccgattgtggtaaaccgactacgtggcactttatggggcgttgggatctaggatcaacggctcagattcggcacaatttaggtatctcacgcttcagtgcttcaccgccatcatcatttatcagcaagtacatgagaccatttcctgttacttgtgactgcacgctaaggttttgttcggtttggaaggggttaaaggggattgaaggggtttaagggaaaataattccacaccacaatagatgtggaataaatcccctacaatccctctctcttgggattaaccgaatatagcctaaggaggattactcgtgccactttgttttcgaactctccattcctacatttcaggggaaatttgccaaatacttcgatattaaatttatttatttatagtaagtactcaaagtgctcaatttctcttcgtgtttggggtgtattttaggcccatttatagcagtggagtaagttccactttaactccctcaaatatacatctaatctaattcatatccatcaatagtaatactagatatcttgaactcctaacaaataaaatcggtacaaaatgatttcctcggtggttttaagggtggtttccactagcgtggctcgtttactagtccaaacatcgagtcagcatgtgatgcccgtcaatgggctgtaaccaaataggatatttgtagagtatgagaatcattggtgccagggtatacgcgagtttgaggtaaaagagataggaggcatggatttttatacatgttcaacctccttacctgatagacaatagccctactcccgttggctaaatctagtgttttatatatcagtaccatatatagtacaatatctgggatgacctaatctagtcgctgctgacctaaatagtccttgtagcatccgagtagaactatatttctcctttcttatccggaatatcttccgtatacgaggcatgatt

SEQ ID NO: 11130 - DNA, 1501 bp, Oryza sativa
gtgacgccgaaaacaaaaacaaatcaacccagcatcaatacctggggagacagaaccgtgcttcaaaaaagtctgcaaggtgttatgtatgctcaaatccctgctaacccttaacatggccaacccataaggcatcaacaacatgtgtacttagagccactaatccactacagtatattttcttatgctttgtttgtgtcgttgtggcacattgcagcgttttgctgcaactttataatgatgcagtatgcataaaaactccaatctatatatactccttgctctacttaaatcatcataccgtaaaatcatacaaaaccccgctaatctctaataagaaaaacacaatcagagcgaccaaataacactgtagattaaaccctaaatctcccgaattttcacaacccaatatcgtccagattccaaaccccaggctttatagaaacaaaaagaaaaagaaggggtaaaaaatgaaagaccataacctcttggcgacgtagaggaggagctcatcggtgacaaagcgctcggcggcgaagtgctcgaggcgtccgccggcgcggtcgacggccgcgcgcgccatggcctccatgtcgacggtggggtcgaagcaggcggtgaggtccacccggcgccagagccgcggctcgcgggtggccgcgcggagccaggtgcggcacaccaccccggcgcccatcagcacttccgccgcgcccagccgctcgaacaccgccaggaccgcgtccaccgggaggtcggcccactccggcggaggaggcggcggcggcggcatcgatcggggaaggagggtttcgggagggttattctcgcgtaaaggcggggacgccgagagagagagagagagagagcgaagccgtttaggcgcggaggcggagggtgctacgcgtccctctcacggagagatcggtgcggccgcttcacttgtggctttgtgggttgtggcagaacgcgttgaacgttgttgggacacgagctgaccgaaatgtgaagggtcaagagtcaagacccgtccgatgacgacgtccgatggttttcgtccgtttgatgactgctagtgttcttacaatcttacaccacctttcccgactcataatttttaggaggagctacagcatgtatttatattgtaagtttataaattacatatgtaattttagtgtatttacaatgtaagtctttaaattacatatgtaaatagtatataatttaagtgtaattagtatgtaatttcaatttaagccaacatctttgctcgatcagttggttaggaccgctggataagccaccggagatcataggttcgattctttgcagtacaattttattttcgtcaaccaaaatagcacgaatcttacagttgatctaatggatcagaaatcgacatatttctaaagaaaaatgcgtcgacagttttttagcctttccgtattttttccacacgtacacttcccaatctactaaacgttacgtattttgtaat

SEQ ID NO: 11131 - DNA, 1501 bp, Oryza sativa
tttgtcttcttccttctctctttgcatcatcttgctttgctatggcggtgatagcagtcagagcaccgctggtgctgcagaggaggtcagggtgcgatgatgtcgacggtgggcggtcctgctagccaccccctccttccctgtgccctaccttgcgatgcggttgtgtcggtgtaatcaatgacactctccacgaaccgtcgagacctcggcaatgcacgcgagcgtctccattgcatccactccgacgctccattggagctggtgcgacgcaggctagcggcttgatgcgatgctctactatcctttttaattatttattttaaaaattctctagttcaaatatgctaccatcatcaaatggccgatattcaactattttttctcaacaacaaaaattttaaataatcagaaaaatatcaacaaaattttttttctcaataacaaatatttaaattaacggtgtcactcttagatggtgtcaggacaaggcgtgtgacaagttagccctcaaccgctatggtgatgtgcagtttaccatcatcccacaaaggataaaaaaatatgtactgttgaggacaaatgcattttccctttttcccattacaagaattaaaattgtgttcacccgttgtaacacacgggtatttttgctagtatacatatacatatacatatacatatatatatatatatatatatatatatatatatatatatatatatatatatatatatatatatatatatatatatatatatattacaaaatacgtaacgtttagtagattgggaagtgtacgtgtggaaaaaatacggaaaggctaaaaaactgtcgacgcatttttctttagaaatatgtcgatttctgatccattagatcaactgtaagattcgtgctattttggttgacgaaaataaaattgtactgcaaagaatcgaacctatgatctccggtggcttatccagcggtcctaaccaactgatcgagcaaagatgttggcttaaattgaaattacatactaattacacttaaattatatactatttacatatgtaatttaaagacttacattgtaaatacactaaaattacatatgtaatttataaacttacaatataaatacatgctgtagctcctcctaaaaattatgagtcgggaaaggtggtgtaagattgtaagaacactagcagtcatcaaacggacgaaaaccatcggacgtcgtcatcggacgggtcttgactcttgacccttcacatttcggtcagctcgtgtcccaacaacgttcaacgcgttctgccacaacccacaaagccacaagtgaagcggccgcaccgatctctccgtgagagggacgcgtagcaccctccgcctccgcgcctaaacggcttcgctctctctctctctctctctcggcgtccccgcctttacgcgagaataaccctcccgaaaccctccttccccgatcgatgccgccgccgccgcctcctccgccggagt

SEQ ID NO: 11132 - DNA, 1133 bp, Oryza sativa
gtgtcctatttccaacactggaatacctctgcacaccgccgtgttccacatgctcgactcaatgcctaaccggacacctctgcacagttgatttcaactgccttgttcacgccatacctgttgtggcatggtcaacattcagtgaaggcaattaaggagctgaggaagatatggaccaattaatggccagtggagagggttgatagagttgagctggacaacaaagggtgctcacctcgcaaaccagctgatgatcgagatccaagatccgacgttgagatggaatgtggtgagtgatttctgggcctcttcttccaaaggccacatgttgagaaattagagatgaacaaatttctgtaggggaaaatttggtatttcaccaaatgaaaataaatgaaaatccttaagcacaggaagaaaagaacaatagtggtgaaatggaaacccaagaaaatttgagaatggaaatcgaagaaaatttgaatatcaacatgtactaccaaatttcgctgcagtaaaactaaaatgtccatattttgtggtattaaacgaatttcccattcttttcttcatataaacacttgctcgcagcaacatggtcctttcctttttgttctttcctcttctgggctggtgattagtgttaataccagaaaaatgtaactgattagttttcatgccagggaatcctaagcataaccaatttttcttccctaagataatgactaataattgttctaatatgcctagcattctggcaatacaactacctgtttattggtaccgctatttgaagcccgagggcggtaccagcaccccatttcttctgaaatcctaaaccactacctgtttatagtcacgagctatgaattcccattgtgactataaatacctcccctgaagttgtaaaatcattagtttcctcatagttgttaataaataaaatgcccatacatgaagaaatcatgaccgtgaatcatttccaaaagtagtgacatatgcttatcttactcttgcattcacaaaccattcagcttatagtatttgcaactagaaatatagaatttacatacggggtctacaggcatttagcacctaaattttgcagcatttacatttggtaacacaaaaaa

SEQ ID NO: 11133 - DNA, 1501 bp, Oryza sativa
ccggttgagaaccacacatagatgcaagatttcataacggacacctagtaggttccactaacaaggaggaatcaaaggttccagttttggaaccaacacctttgaggttccatgaataaaaaataattcgagccgaggcatcgagcagctcctgatcacacaaagagaggaggtcgctgctgccactactactgtagtcgtcgagtggcatgccccgcgcgctgtggcagatttggccgcccccatgcgcgcggcgattaatccggtcgcccccgattggagagaaggaggggcagccatcgccatcccaacaggtgtaggtgcaggagagggagaagccgaggagtgcgaggatgtgggctgtggcctagaggctatcccaggcgagcgtgatggctagtgtcctcacaccattcacgcatagtgtgggatgaagtggaaggaggaggaggaggaggtggcgacaggcacaactttgaggagcgaaggtgatgaaccctgagttcctctcgacactcaaggctgttgttggcccgatctttcggtgagttgtgataactacgatttgggagaaacgttgacgatctgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttctgaagaacaagcagacggacggtctagccgacacgcgcgctgcaagcaagtagcaatggctaaactttaatctaacaaaacccgagaaaccctgaaggggtaactagctatatatagggtgggaggatgacctaggggtgcctagggtcgtgctccatcagcttggggcgcaccccacatgggccccacctgggccgggtcccaaatgaagttacaagcccataggcccattataggtgatgcagcaccttgttcctatgattccggccacacgagatggaattcagagaagaggctggatccgttagaaagagggctccaagagctttccatcaagtactcacaggccgaaaacggaggtcgtatgcagattcggtggccgtttgaagtcagtagtgtagtaggtggccgaatcggattccagcacttggagtacttgatctcgatatcttcttgttcatccatgatgtgagcaatggttgcatccgtgttagccatggtcacatcagaagggtagtgcgcgcgcgggggggggggggtgggggggacgggaataggtgagaacgtgagagagggagaggataggataaagataacgaagtgataggctcaactcctacactcactaagaaaaatatgtggtatcggacggttaagaaaactgacacaaatatttgtgtgtatgtggagcactttaaaaagccacaccttaatagacaccagttttatt

SEQ ID NO: 11134 - DNA, 1501 bp, Oryza sativa
cggactccaagacgtagtatgtctatgacaggtgggaccaggtattaatagtgtagtatgtaactattgtatgaataagctattagattggttatagatgtattggagctagtagttggctatactattaaacttgctctaatgatgtagtattttttcatagttaactattgtatgaatgtgttattagattagctatagatgatttggagctagtcgttggctatactattaaacttgctctaagtattgactattataaatttgaaaaatagatttatttttttaaacaacttctatataaaaactttttatcaaaaacaccacatttaatagtttgaaaagcgtgctaacagaaaatgaaaaagttgaagtttgaagttgagaaaaagaaccggctttgacacgggttacccatgggttgggcatgggttatccatgggtagaaattaaaacccggttgctgcccgctactttttcgggtctcgggcgggcgtgcccatgggcaacaaaatagacccaagcctgtgcccatcgaaccgggtattcgcgcggatacccagacccatgggcaaaattgccaagcctagatctgcccacgggaagccatcgagatctggagggtggagaaggtgccgtcgccgacaaaaacaaagaggccgagagggagggacgactgtcgccgccgtctccgggccataccccgctgtcgtcacgccgtgccgacgaaacgggaaggagagggggagagggcgtggtgccactgatgggtagaggggagggaagagaaggggaagaggcaccgtcggtggggtgagaggtaagggagagacggcgccggtgaggggcgggggaggaggagaggcggcgctgggtgcggggaggagggcggcgatggcggtgggggtaggaatgaagcttgggttaggatttttttggcaccagggttttaattgattcggaactaatctgagccatctatcaaaacgaacagctcatattgatcgagcattaggctccaacgccgaaccgcagccctgttgggccacgcgcgggctaattagatttttggttatggtccacaagataagtaagaggaggagttggggaggctaattagactttggttgcttccagggctaggctcttgcttgcagcctagggaaagtgggccggctcggttgcgggctgaaagcgggatttttatttaaataaatgctaaaatgatgtttgtattatcaaaattagcaattaagctatggaaattctaataaaaattcaaaaagtgtaattaatatggagaatttcataaaaattaaatctaaccataacattttatttgtcacatttactttattagtaaaataatttaatcatatacctatctacttaaaaaaaacctaaatattctggaaaatttgtatttcaagtattagatgatgtaaatctttatcaacctttcatcaattttctcatcttttcttcccgttgcaacgcacgg

SEQ ID NO: 11135 - DNA, 1501 bp, Oryza sativa
tataatagcatatatgttttctcaatgtattattcaaatatattaaaatgacaacataattttaaattttatagtaactttacgaaactactcatgtgtaatattcatattgtattatatatatatatatatatatatatattagttattaattatttttaatattaaattttagttatttgtaaattatatttttatatggattctagactcgtctttcaatatttcttttttaattctaaattttcattatctgtaaattgtatttttatatagactctaggctcttcttccaatattatttattttttaattctgaaattttattatttctaattgtatttctatgtggactctaaactcatctttcaatattctttaatttttaatttcgaatttcagttacttctaaattgtgtttctatattgactttagactcttcttcccatattttttttaatttcaaattttagttatttataaattgtatttttatacgaattctaaactctacttttaattttattatgtttattccgaattttagtttgttttaaattcctatatggactctatactctacttctaatattccttatttttaattccgaatttatattatttcttaattatatttctatatggactctatatatactctacttataatattccttatttttaattctgaatttctattatttcttaattgtatttctatatggactctagtctcctcttccaatattccttattttttaattccgaatttcaactatttctaaattgtatttctatatagactctgtttttctttttctccgattaatatgagaatttttaggccgcgagagcgaacgtggagggtcctttttctattcctttaataagttaatagattggcattagttccaaaagagaaatttttcgcgcatgcaaaacgagaaaacttattaacacatgattaatctaatattactaagtatgaacttgaaaaaggatttatttgaattttttaaacaacttctatatatgatttttttttaaaaatacgtctttgaaaaatgtgctaatagaaaacgagaaagttgaagaaaataactagacctaagtgaggatgaactgtataggtttataggatttctggtgaatgtgtgttaaccgtgaaatttggtaaacccaaagtcatcatcggcctagagtcagcatcggcttcatagtcctggaatcggccgatgagaattatcaagttgccaggattcttgctatattcggttaaggaaattaatctattaaataaagtttatccagaagagaccgagttcaagaaagatgcggcatgacagtttatctattaattaggaatactctattaatttccttttatctttagtaaagtatgtttagtgtccgataaagactttatgttttccttttatctttatgaaagtttctctcttgtccaacaaggactagtatctacccatgggtataaatatg

SEQ ID NO: 11136 - DNA, 1501 bp, Oryza sativa
cctcaaccgcgtcgtcgcgtgccggctgcctcgcacgcgaccgcccgcgccgacgccactgccctgagctcccccgtgccggcctctcccttccatcgccgccgcccgtttccgctcgagccaagacgacgccgccgccgagttttcctctcctctcgacagtcgctagctcctctctcctgcaccgccgccaggtcgccgaccccggccacagcctcctcgcaccggtcggcaaccgcctctccccgcctctctcctgcgccgccggcaggtcgccgaccccgcccacggcctcctcgcaccggtctcgctggctccctctctccctttgcctgccacatatgcatctagaggtggaggaaggagagaaaaaaggaaaattaaaatttgtgccatgtcatcgtccatgtggcgtgccacgtaggcaagaccacggtcaaacgcggctttggatcgggatgatacaataaaccaagtttagagacctcgatgtgcgctttgcaagttcgtggacctaagtgaaacctcgttacaagtttaaggaccgctagtgcaatttaccatggtttccgtgtccaactttgactgtccgtcttatatgaaatttttttataatttgtattttcattcttgttaggtgataaaacatgattaatattttatgcgtgacttgtctttttaattttttttcataattttttcaaataagacggacggtcaaacgttggacacggaaactagggtttttcttttttttttgactgagaaagtagtatcttaccaaattgcaggcccactagtgataggatattactaaaaggtttcatgaactctcttgaacctcatcttgccatttcataaagagtcgcatttaattctaccaaagtgatttttatagtccttgtttagccaacctctcctctatagtatgtctgctgtccagactctgttccacagaaccagccatgtaaagaatttgcatttcggtggcgcccaacattttcaaattgtctcattgaaaattgttctcgctgcccctaggaattggagtctgtaaactgtgctgtgtattccctgctcagggtgagcttccagacgatgctgttgtggcgttgtcccaatggggccatattgtgtatcgaggttcatagctcaacttattgtcgaaggtgttctccccccgtaatttggaatgaatttaattgatctcatacacattcttgctgaggtcagggtccatttttggttgaatttttttgtatggtccattcttgaaataaatttctgaaaagatccaaatagtcaaaatttcagcaaagagacaaccacttccctcttcctgttctttcaccttcaccatagcaaaatgcctaatgaaatcataacctttaagcactgattcaaatctaaaatcctgcaggtacttagttgtaatagatgatgtatgggctacagaagcatgggaaactattaaacttgcattgctgagcaacaactgtga

SEQ ID NO: 11137 - DNA, 1501 bp, Oryza sativa
aacggtaggagtgggatgacggaaagtgcggatcgtaaccagagaagttgattttatcgaagtaaattgttactccgataacggtgggagtgggagtgggatgatcgaacatggggtgaggtgggcctggctgatacacgtttggcgcttggaatataggagcgcgcagcgctcccaataatagttctatgaaattctttaaaattcctatgtttcctccaaatcaaagggtagtaagtaaaagagactcggtaaaagtagagtaaaaggaaagagttttcacagggctctacgagggttcgcaaagtctccctcgtcgttccagtcctccagtcctcctgccagcgtgaggatagtgcgttgaaatactctggttatagggtaaaaatggaaaggatgcatgttttacatgcatatgcaaatatctttcatacaattttggtaagtaaatatccccttcgttctaaaaaatatatttagtattattgtttctacatggtctttaacattatattttgattgttgttttctttcataatattatcaagaacaaagaattaaatccacatcataagaaaatattttaaaatctaatataataatactacatgcatgcataacactaagcacggatatttttagttcatttattggtcaagttttcaagtgttgattttcgtgaaagcaagaacacattattactttatcatataataatttactcccgtctgtcattggtggtttatattgtttggcttttttccggattaaacttttaattaaagttcagttctatctgccaagaaaaacttgataattgggcacctatgcccgacacataaaacacacttctcagacaggtattaatagagtcgtgcaagacgcgacttatgtacggctagtattgattgatgtcgccaggcgttagctagatggctaagctgctttgctatatcccggcgcctggcctattctcaatctaccgacaagctaattctctaatgaaagaagcaaattcagattttatggacgatggttgtaatatttgttaatttaatttcgaattaataattgtaaaattatgtttaccttgagtaggtaatttagaaaataaccaacatatttagcctacaattaaatatttactatatatataaaagaatatgcccccatataaaagcccgtgcaatgcacgggctgatgactagtattactaattggtgaaatcccatattgataacatatattcacaacgatgattcagcattgtgggttgtggtctgaagaaaaaacagtcagtttccattaattaatgggcgccatagctgtgtaccattgtataaatagagaactctaaacaaggaaaaagaatgtagggagggtattcgcagccatacttgtgaagtcctccggttagacagagcctaattaaggaggtcacttgttatactaatatatatagatatataaataccatgcagagatatcgtggcgtagagga

SEQ ID NO: 11138 - DNA, 1501 bp, Oryza sativa
ttgttggcttatacaccaaatatgtaacctagcctagaattagaaataaatgaaaataaatcaaataacttaaaacagtgggacaaacccagaacatgctatagatagtaaacaagtgaagaagtgtcaaaagaaaaacaataaatgagaaaacccgaaaaacaataaatgaggaaacccctcctgctggaagataccagcacacactgtagaaacacacagccctgccccttcagttgtgctcttcagttctacatgtaaagtctgcaactcaggataaacaaattcatcagccaatctaagatattggaggaaaccaaactagataaacagagtttctagtttgattccctccaatcctcacgttgggtgaccgaatgtcatcatctctctgaattttgactgaatgtctgcacctctctgaatttttaccagtatgtacgtgtaaccattcaatgtgagatattagaagaaactgaaccatccatcttttgttccagatgggtgtgattcagttccctctaatcctcactttgaatgacacaatcgtattcttcgaaaatcttttctttatctgtaggctgtagctacaagtcaatttgctgaaggtgagatattggaggaaaacaagctgatcagtgatctgctggagttgtctgatcatcagtcagtttgctttcatccaactctcactttcagtgcttgacaaacacctcaaaactagctagaacagtacagctcaggaacaacaaaaccatacatgttcagatgctccacactaataaccctgcattgaactctgaaggaattgctctgcagctagacccaatttatagccatcctggaaataagtatattcctcagagttgagaagggcatttgtttctgtttcatctgtccttcacgcccaaaatgtgttatgtcctgaaaaagaacaataagctgtcagactttgtgctctgtactttgtactagtgatcctgtacatgcagcttattcagattgtgagttactggatgagaccatatcatctttttctctcggaagactgaaattctggcctaagtttcaggttgtgaggaatggaggtgtcaagagttaacctctgtactaattgcacattgtcatacaagaatatgtatacactagctttaatcagtggatcaaatcacacaggcacatctagtcgttcacacaaatttgttaacttaagaactcaaaatgcatctcaaagcatgcgaatgtgacaggcatacacaattgcttaacgaatgacagcttgcggagttgagaagtttctatttccagtaaagattagcaaactttcaaaaatttggttcaagcactacaaatgcagagtttaccgatagaatactcatttaggtacatctcgcatctcggcacatacagaacactagacattatacttaccatccaagattccagaatagcaaggaacaatgttcacctttatttttttaaatttcttgtggaggtggta

SEQ ID NO: 11139 - DNA, 1501 bp, Oryza sativa
ttataggacacctaaaaacctcctaatgtgctaggagacaccacaactactattttatattatttccaagccaaatggagtaaaaaatatttagaaaagacaagtttgttcatgtggcaatagcttgtaatggctgccgccattcccgctaccaccaatttctaagtttcggtgagggcattgggaggggaatatggctttaggtctgatttaaaccacacacaattgtattacaacctgttgtctcgaggggcaaattaaaaaaaacatctctttttttcagggttccctctatttgctcataaataataaaataatggctacaatatccctcagtaaattactatgtttatgagtatcctagaccccgtcacgtttttaaagtttccagcagcaagaacataagctaattatcctagaacaaattttgtcaaaatattattactcctacagcttccttggttggaccaaaatgacctgtagacctggctaaaccatttcccaaagaataccgtcgaacgaactcaactcaacattcttcatgttcacgagtttatgtttttattatagacgagaagtccattctactgtctgatcactcgtaatgcatgtatcgataaatatcaccttgttggctgtctccacatgcgacaggctacctggcacaattcagattgaactggaccttagtaaagattctctcaccttaggcactcagcatgtcttcccgaggcccgagcaaactatacagggaaccagacatgtgcaaatcaggtactacctctatccacaaatataaatataaaatataaatataagtacttaaaacatttaaaatttatctacaaatataaatattttataatactgattgtcccatcaatcactttacttatggagtagtaatcctgcctccgtcttataatacatgtcattttaggttgtttagcatgtactaaggttaagagaaaaaaactataatatctcttaataaatactttatctatttcatattataagactttctagcattgcccacgttcatatatatatattaatgaatctagatatgtatgatgcctagattcattaacatctatatgaatatgggcaatgatagaaagtcttataacctgaaacggagataataatgtatagttgtatgtgagatggtggttgagggtagaatgagaagatatttgaattgaaagtggttgatgtgataagtagtacttccaagtgataactattttgcgacaacttttgaatgctagaaagacaagtattgtgggacggaggaagtactattttttttctctatcttaccccaattgtccttttattactatccaatacctcatttaataaagggccaaagtctttaatttttcaacattaatctctactaagagcaagttgaatagtatagctacctagctccaaatcatttatagtcaattgaaacatacaatagttaactataaatatataagatataaat

SEQ ID NO: 11140 - DNA, 1501 bp, Oryza sativa
ctatatacaattaatcaagaggggcttgcacggtgatgagaactgatgatacttaccgtggttattgttctcttaccatttattcttgccatatacgggttgattgggacaccagtacaccactggtgcaccaccatttggagcatctgccgattggagattttggcaccatcttctttttaatgggaccattctgattcgataccctgcgtatctcaattggattgtgtggtctctccgtccctcctcactcacagtgcgacctgcacatgtaacctttttatcctttgcatgttttcctaagtgattggtgggaaacctcgtaggataagtgtccttaatagtcatttcattggtatatgtagagaactgtagacctataatgtctctcactctcactcgcagggacgcaggcaacatagccttagctaatgatgaaggatttgctggagttagttggtaccactttcacaaatcaagcacatcctcacactgggtcccgaaaattctgcaccggcctctcttagggtttctatcagagcaatgtgttcttttttagtggcagagagtagtgataaggatgatgataactgctagtgggcccccgtgccgctccaggggcaggggcgacacgggcggcgaccaccgccgccttcctccctcctccacctcgccgccgcccgagcagaccgccggaaaccgcgtggctgcgaggaaggcggcggcggggccttccttctccctcgagggcgcgggtcggtgcccacgaccccgaccagttgggggcggcgacggtgcggcggcatcggcgtcggcgtcagggcgttgggctgggcgcgcggaggcgacagggtgcggaacagctgggcggaggcggcttggtgcggaacggcggcggcggcgccggatttggcgtccctcgccagatccggcggtccggtctcctcccgggacgatggtggcacccaaggaggcggggaagggagatgcaggcggcgggaaaggtggagcagcggcaacgcgcgtcgcctctccagatccgggctgggggagtggtcggcgccgaggaggtgcggagaccggcaggcagaggcagcgtcacggtggtcaggcgacaacagcggcggctcgctcccgccgtggtcgcggcgccgccgtcggtgtctgtcaagcgttggtgttggcttcggtaatgctgcggcggcgcgctctagctggtcatcccctgtacctggctggatctggccgtccgcggccggatccatcgcctccacgccgaatggcagctggtcggcgggacggctgcgtgtggacggcaagcgcggcggcggctcgctggcggccagcctcctgctcggcagggggcttctgccggtggtgggtcttgtcgttgttgatgggcggcgatgtgcggatgtggaaatggcaggacgacggcttgtgctggcgtgaagcaggaatggggcttgatgtccgtgacggtgacttcctcattgtcggc

SEQ ID NO: 11141 - DNA, 627 bp, Oryza sativa
acgatttgacgctgaacaaaagggttattttttaaataagttttgatgaggattcatttgtaaaattagattttttaaagggttaaattgtcaaaatttgtggcctacactggccaaacctcaacatcacagctatccctttttcgcgtgaaactttttgtttcgttcctacgcatgattatccgcttatcgtagtactacaacaagagctgcagatcattatccaaaaaaaagagctgtagattgtttgtactacgaacccatcacttcgcacgccttttacccactgtcactattacaacactcactgtcacctagaaaagatttttttttcctggacgagggtccctctagactgttcgcacttgcaaaattcgtttctcctaaaagtacaactttcacatacacaccgtacacgtttattttaccgacatgtaaaaatacatatttttttgtttgcatacaccttagggggtggggtgtttgggagagagggacaagcccctctcacaaaacgataaggactcatgtggatcacccactacttacctatgaaaatctattttgatcgtacgaaaaaatcgtcctgtagtagtgtgtcccatggtaagagaaaaaaagacaaaa

SEQ ID NO: 11142 - DNA, 855 bp, Oryza sativa
cgccgagctgcccctgacccctccctgtccgcggcgggacggcagggcctcggctggacgccccgggggggggggggggggcctcctagctgcgagcacctcccttaaagtagtttaactacatctattatctattaatctattagttaacacttaatactaatgatactagtagtaattagaaaagattctgaagattttttgagagatatttttactagcaaattgagaaaaatttaagttagatttgaaaacttttgatttaagtttcaaattttaaagtcaaatttggaaaactttcaactcagattcgaaaactttcaattcgagatttgaaaactttcaactcgagaatcgagattcgaaaactttcaagtccagatttaaaaaatttgaaaacttttaacttgagatttgaaaattttcaactcgagatttgaaaactttcaactcaagattcgaaaactttcaaatccggatttgaaaattttgaaaactttcaacttgagatttaaaaattttcaagtcgagatttgaaaactttcaactcaacattcgaaaactttcaagtccagatatgaaaaatttgaaaactttcaactcagattcgaaaaatttcacttgagatttgaaaatttcaaggccaaattaaaaaattttcaagtcaatatttaaaaactttcaactcaaaacatttgaaaaaacacgtgtgctaaaagattaaaaaaaacgcaaaaaaaagcgaaaagaaacgccaaaagaaaaaacgcggaagaaaaaacggaaaaaccggcgttagagattggttagagaaaaaaaaaatctcgcgcgcgcgtgggccttgttggccgggca

SEQ ID NO: 11143 - DNA, 1501 bp, Oryza sativa
attaatcatgctgccagaggaccagtggtggtggttgcattgcatgtatgtagctcaaaaactcgccaattaaaccaaaccaaattgctgaacttgttttcagaaactggtaatcagtacaagacgtgagatgcacgcgtgttggattaagcagctaccgcggtgtaaatcagccagcaacacagtttggttaggacaaattaaaagattctgcaaatcagcgcttatcttcaagcgcggtataagaagttcacacggttgatcccttgtacagcttctactgcctctcactgtctggacgatatttcccacgtttgggcagaccagactctcaggaggcgacgacgcgatggcagctggtcagtgcatctgtgcatgaacgagcaggtttgatgccgacgcgcagcatgaagaaattcggcgccggcccgttgttgaggcgcgcacgcacgtttgatgcaattgatgcgtgcccgtagtccgtagagagagtgagagactggctgaagcgtcaccgagtccacccgctgtcttacgtgggagcgttgtagccgcaattggcaattaaaaggcacagctctagattttaaaattataatattagacttaaaatttatatgttaaattatagtagtttgaaattttatatttcatctaaaatatataaatacaataattcattcaaatgttaccaacgaaatcacgaatctaatatatggatttgtgaagctaaatcttgatactcgtctaaattcataccccatcccaaaataattttatttttcaccgtcttattatcttgaaataactttatctttcaagcaatcattgtatttgagtttgtgaaaatgagaacaaatgcattaggactagttaaagcaaaaggcaattgcattgagatttgattaaaaaaaagaacaatagttttttattggtacgtataagatgtgtgaaaaataaaagagtaaatttcagaaaactgtaactacagtgacaaaactatcgtttgacaaaactatcgttttgctacaacattagtgacttgtttcagtttgctgcaacaatagcaaaactattggtttgctataacattagtgacttatttcagtttgttgcaacaataacgtgggaaattatcacaaaactacaaacttttacgtgctatactgctacaggacatgtaggtgacaaactgtatcagcatatcacgaaaagttacagttttgtgataatttctcatactattgttacaataaactgaaatagattactaatgttgcatcaaactgatagttttgtcactaatgtagttttctaaaatttactcaaaataaaactattttgggaaaatattttgtgatagagataggtaccataaatccataatggcactcaatcaaatggtttaacccatatatggatgctcacccagggggttcacaacattcgctacctctcgaagggctaggcttggagcatcctttttctcgtagcaagagtc

SEQ ID NO: 11144 - DNA, 1501 bp, Oryza sativa
tctgacgctccgctgcctgcctacctacctagggatgaaaacggtcggaaacgatcggaaaacagcctcaatcatttccgtaaccatatttttcttggaaatgaaatcggaaacggtaaattcggaaatgaaaacgatatcggaaatatcggaaaaccggaaacggaacaatacagacggaaacatgtcggtacagatcgaaaacaggtaacaaatacggatacattaaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaattttcacaagaatacggtaaatacggaaacgatcggtataacagtaaaaccatttctgttttcatttccatattttttaccatttccatttttgtttcgatcgattatcatttccatatggctcggccggtagaaagtcgaaaacgaacgccggtcggccggtaattaccgttaccgttttcacccctatacctaccggctgccacaagggagcagcagggcccttacagaagcagcagcagccgctgccgtcgtcaccatagcagattagagcgatggctgcctttaagctgcggcctgcggctttgactcgtcccaataggcgtcgactcggctccagcaaaaatcgcgataggcatcggctcggctcaaagaaaaatcttgtgcggtcggtagctgtacatacgtcaccagttcgtacggtgtcgcacgagaagtgccatgcgaaactgccgcacagaatttttttttcccacccctcccccccccccccctctactcctacccctgaaatcacccacaggaaaaaccactcggaaaccgtagctaaagcccggaaaggaggataggaaaaccgtgcaaacggggccagcgagcagtaatgacagcggcggcactgcagcagcattgccagcgagctcctccactccacctctctctcttgtctctttcacgctctccctctcctctctctctctctctctctctcgctcgcttgctttaccctctctctctctcttcctcactctcactgtctcactgtctcactctctcttgcccacatttttttcccccggagagcgacaactgcagggcccaaaaagaggccggattctttggtgttttctgaaccttctttacttgtcctcaaatggccacctcttcctcctcctcctcgcatttcctcccatagctcgcattcgcattcgcatcgcactcaccctctcctgcaagcaaagctaaagcttcggtttggttatttcctttcctcgccgcttttttctttgcttcttgcggtggccatggcggtaaggaggaggaggagga

SEQ ID NO: 11145 - DNA, 580 bp, Oryza sativa
gatgggccggcagctaggcccgatacacaaaaaaataggggagtaaaaatagacattatatgccatgaacgaaagcatagggatctaaaatagacttttattatctatacatatgtcagccaaagaggagggacagaaaatagacttattttagctatacacatgacagcccaaagaggagggacggaaaatagacttattttagctatacaaatgaaatagcctagagaggagggaaaaaaaatagacttattttaaaaaggcccgatgggccacccatgccttcgggccagcacggcacggcccgacagctggtaggtcgtgcctgggcaggaggtgcagcccatgggcgggccgtgccggcccgatggctgctgggccgtgcccagccgtgcctgggcggggccgtgccgggcgggccctttggccatctatactgatagagaacaaagagatacagctgacttgtagggttcacgaggggtaagataaacatttcacacgtcttgtccaccgtgggagtgcaggctggcatgccatgcatgtcagcaaagagtgaaaaattacttatcataaaagt

SEQ ID NO: 11146 - DNA, 329 bp, Oryza sativa
cctccacacccttctcccccccaccttcttcctccggccgacggctggcgccgcacagtggcgggcccacttcaattcatgggtattcaaatgaatacccaaaatttttgcacaaaaaatacatatatgaagtatatattccatatgtatatataggaaaaaagaaaaaaaatacttatacccattcaaaaatcaaaagaagcccaaactgaaccctcccaccacccagcatttcaggcccattggcccaatagcaaagaaaagcccacttcctttctaaccctatctcttctcctcacctcccttcccatccccttcccattcccagc

SEQ ID NO: 11147 - DNA, 1074 bp, Oryza sativa
  unsure (1)..(1074): unsure at all n locations
gattgagagctctctctataggtgccggttgtttcaaacggcacctgctaagcggcactgatgaaaccccaagtcattgatgtaagtttcacaaccgacatctttgatgtgcacgcgaggcaaaagaaaaatagcttgatgcattagattgattcgactcgatgctttgagctcataactgaatccgaaatcatcacaaatttaattcaaaaactaaatcctaatccaatcgaaaatcacatgatcattccaaaataaatcacaagacaagagacaatccaatcagaaatcacaaaataaatcacacatgagatgagaggagaggcgaaaattacaaaataaatctcacaggagatgagaggagagggacgggcgagcgggaggccactgccgctcctagccgaaccccctcctttcctcctcgctgctgtggaggtcctgagctcgggggccaaatcccgcaccgcggggttgccggtaaccagccacagcgccacgaagatgctgagagggagatggagaacgaagacgacgacggcaaggccgaggaggcatggcggagacaggtgggaggatgtagcgggtaggggtggtaatgaggaggtaggcgtgcggcgacagtaggggcgggtgtgagtgaggcggcgggagcaagtgtggaggaagagggaggaggaggaggangagacngaaaaggaggtgtggtgataaggatgactagacaagggagcagataaagtggttggggggcccgtttttctataggtgtaaatttaaaaaaataacaacacgtatattagtgcgtgtactgtaaattgagacctataatatattatagtgtcgggttctttaaaaaatcggcactaacaatatagtggcatgtttttatttaaaatcgacatctatctctccacaaaggtatttgttctagccgatggcgctatgccgaccagccttgggtgagaaaaacattattgatgtcgggtttagtattttctgtatatatagtctgtatatatagtgctgttatttttttttgcatttcggtagtagtgggccttttggccacctatg

SEQ ID NO: 11148 - DNA, 1501 bp, Oryza sativa
tgcggtacacgcctgtgttgttgaggtctaccgcgccgaagaaactctcggtgacgctgtcgctggagttgtagcactggtacgccaccggcagcatcaccttgacctccgggatcggcgctacaaacaggctctgcacatggatggtgccattggcggcggcgagggtcggcaccaactcgccgctgccgtttcgggttcgggtatcgcaggcgatctcgaagcccttcccatgggagcagttggggccgatgccgaacgggtaggggatgctgacgtcaccgcaccgtgtctggcaaccggcggcaggccggccggagatgctctccgcggcagaagccagaagaatcagcaggtctgcaagtagccagaatgccatgaacgcatgtaagttgtacaacattaactgggaacttatttcctagatatatgagtaggagtagctgcagctcttcctttaattagtttcccttcaataagctccaattgtctgtggcgcgtgtatttatagatagcagagctgtgtttgtccacctgctacgatctactctttccctcttaaaatactatattatagctatatatatttggtattcaaattttgttttataatataactaattcttcacctacccgttgatctaatataattttttttaaaacaagtaacatgctttttcaaaacaagtaaaacaaatatgtgcactcgaaaaacgagggaggtgaagttgggaaagtgaacttaagaacgcaacataagttcgaggttgaggagtacaaaaaagtacctaaggtagtaagtggtcaaactgaaagtataggccaaaatacagaggtcccatactccaatgggaagcattggtaaataaatgtgtccaaaatcttaaaattgcagttcgttcttattttttttaaaattataatttcaaaattaattccttttcccatcaataagtaagtacacggtacacatgacctctacgccgctcgcttgactcgatcttcgtgtacttactatacaaactgcagtccgcacccgttcaccagactggaggtaggaatgagtacatatatacattgagaaatattaggaacttaactttgaagggaagaagcatatgtatatggatatatataaatgagagatttgcaaaatatatcaagtcacttgtttttttatatcaggcaaatacattagggttaattggatacatgccaataaaaatttatcagtttcgaaatatgccacttgtattcatgtatttggaaatatatcattataattttacacatatttaaaagataccactacttacccctcggatgcatttccagaaaaaattggaccaaactaccccttttccctcttcttctttcttcccctttcttcttcctcctctcttcctgcttagcagcacggcggcaagcagcagcagcggcggagcgtgagcagcgtggtggcagagcaagaagcactagtggagaaatggtctttaccccc

SEQ ID NO: 11149 - DNA, 1501 bp, Oryza sativa
gttcctaagaatttgccagttaaaaaatattttatacgtggtttataatcctggaaaggcgaagccatcttcacacacgtgattttcattttgagttgcctgtcaagagaaaataaaaagaagcctaagcctacgattttttttactagtgacagtggatctaacgactaatagatatgatcctttttatatgcacagacatcaagagtggtgatgtgtccaacaagaagaaatatccctggtagggcgtgggcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagct

SEQ ID NO: 11150 - DNA, 1501 bp, Oryza sativa
agaccaacaccatgtagacttctcgcagcatgactgctagcaggcaccacatgtaggcgtcagcgttaatgaaggaacgttaacatagagatcgaacgaagaaggcaggtagatcgccacaacccaccttgcagcacgggatgacttaatgttgacatccccaaccatgagtggcgttggacggttggagtctgatgatcattattggtggcactagcattatactccctctaacgttttcaatttttttctaagttaaacttatgtatatttgatcaaatctatagaaaaatatagtaacattttcaacataaaataaaccaatttaataaaaccaattatattcaatgctagatttaataaaagcaatttggtgttgtaggtgttgctatatttcgttataaatttaattaaaattaaataagcttaacatagggaaaaaaatcaaagtgtataatatggtacaacagcagcagccacagccatcagagggttcagggtatcaccgcctccgtgcatcttcatatgtgatttcctttgccttccgcggagggcggttcaaggggtgcagactcggcggcagctgttaacctttgactgcttgcctttgacaagatgatgacgggaagaggctgacggcgaaggacgtcgtggagcaccggtggttgacggggaggcgcctccctgattttagattcacaattttttcacattgttttgattagcattgtaatctgtcaaacgagactatttaaatgttgttggtcgacttaagtttatttaatcagattgattgccttcaaaattttataccaaatttgtttgtaacagaagaaattcgtccatcctattgccttacatcttggcaagcacgctacaatactcttcctggacagaggagcaatgatggggtaaaaaggagcgtcatcattcgtccaattaatggcttatcaaaacttgaattttaaaatttgattttaaagttggttttttgatttttttttcaatgtagttttatttttcagctttggcttttaaatcactaaggacacatgtagtaatttttacttgcaaatcattttttatccctaaaaataagctgttacggcttatataagcagcaaccaatgacccaaaatcacaagaagaaaaactggcaggtaggtccaactgtatgtctgcagataattctttcatcccatcggtttaccactacagacgctgccgcgaccgcgagatacaaaacttgaacacgactgttttcaattcacaagcaccacatgcatggcacataagtataactgaaagaaaacgacggtacatgtcttaggctattgcaggtgttatgctggaacagcgtctaagcttttatcttgtttcataattagttaaacaaatccatcacattgcgtgatggctggattggcggcaccaagggaacggaaatgaagatattgtatatggtaagacttgtttgcgactctagggcagcagagattat

SEQ ID NO: 11151 - DNA, 1501 bp, Oryza sativa
tgacaaggcccaccaacattcggcccgaatcattttctccaattataatattgggcctggatctgacaggagatttgtggatgggtggctgtccttaaatgatctatgggcctttgatttggaagaaaaatatatgaattttgaagaatttgaatcgtatagaaattttttctataaatgcctttgaaacaaaggatttaatcatatcctatattttaaaattcctatggaaaggacaattatatagaaattttggaggaaatttaacaagagcttcaacctgcggaaattttctttgaatttatttctcttatcttattcctacgtttttcctgcgatccaatcaagcagtcatttctatgttttcctatgttttatacttgaatttttatcggaatcatgtgtttttcctattccgccgtttttcaattgttgtgtttcaaaggtaccctaagaatttgaatctgacattaaccttttccaatgtattacctccaaaaaaagttacactattataaaaaaaattactcaagtttattcacctcagttaaaatggaaaagtaaggaaaaaaattgtaacataaagcgtattttattgcttgtttcctgaccctaaatatgcttgttaccttacccaaaaaattatcatggaaaacttatgaagaagcgcgacaaaataacatactgcggattttattcaaaataatgaacacaaaaatgtcttatattctcctattctgaagtcactcgtacattgcaaagcacactactcccatcgcaccgtaccaccagctcaacagatccatgttatcacatcaaagggaaataaattatcacgaaaaatatctcttcaaatcaaagcaaacaaaaaataatactaattaaacaaacgaaagaactaaaaacaaaaaaaatgtcaatttaataaatcattgtgaagaaaaactaatttaaaaaatagtagtggtggtgacagccaccactccgaactaacacgtgggaaaaaaaaatgagaagagactttgctttttttcccctagccccatgaatcagatacataaaaaattatgagaatcaaatatttttattatgaattttttcatcgctatatgttagacaatatgaatacttaaaatttatatgccacgaactattttttaaaataaatcggttgcaacgcacgggtattatgagagttattattgtgaagaaaatagttgagcaaagtgactccccacccccatgaactgttcaacaaccttagcttctccaacctctggaaaatggcacaaagacatcagcatacacaaaaacaagtcaacaccaaccaaaccctaattgcttagaggacaaagttagctaggcagctagctaagctagtcacacatcaccatcacacacaccaagccacaccagcaacagcagcaagcaacccaatccaagaaccagagaaggaggaggagatctgggtggcaatctggcggatcaatggggaagaaga

SEQ ID NO: 11152 - DNA, 906 bp, Oryza sativa
tactagaactaaattgaattgttctatgacatggtttctctgcacgactatatatcaagagtagtattgtacacgcctatatatcaagagtagtgttgtacatgattactataaattgcaaaatataacatgtgatcaatacacatgtcttttacgattaactataaattgcaatatatacatgagctttacatgtaaggctaaaaaaaaaattgtggctgggtttcctgttaaatgatcttcctctatctaaaatgaaaggttcaaagcggtctctctactcccggatataaacctttcgcgcacggccaagttgtactaaaaaaatagccagagtactccctagttcttcacacagaccgaaaataaaaatcattttctcgccttccaggaaaaaaaaggcatgcatcagtggcacgataaaaacgtcattttcttatggtctcaccggtacagtgaagacaaatttagcccgttggcgattgcgatgctccaagttggttacaatgtaaattgagaaaatatctcgagaattccaaccttccaagtactccaactccaagatggagtaagatgtagtagtaacatgtaggtagaaaaaaactgcagtggatgcagatcggtactgctgaacagctgaccacacttgctcagttgatctgaattccatgcatgaatggtcacgacccatctagtttcaagcatagaaaaatcaacgcgcacaacatggaatcattccaaatgttttcacctatataagcgcaggaactcgagctaccacacatatatctctcttcagtcttcaccagttgattaattactacgacgccgcatcaaaagctccagcaatggcggcatctcctccgggcgccatcgtgatcaacatggcatcgaacaccaacggcg

SEQ ID NO: 11153 - DNA, 1501 bp, Oryza sativa
cacgggataactgagaaattggcgtgtatatattttgtgtataatgatgatcatcttgtaagctgtagatgccaacaaaaaaaaattcactactttttaggtagctgacgtttgaactgtcgtaagcactcacgttgcacaaagtaacggtattaacaatttggttaaggaggcaattacaaatcaagatgccgacttagactgggcaaagcaccggaattttataatgaaatgacagcgagccatgaggcaaatacttcagagaacttttgcagtataatttacttacagtatataactatatattgtcaatataaaccattgacgggtatagattgatcatttgatctgatctccaccttaattgggttgcaatataaaattaaatgaggaaaacttgacaactcggttctgggatcaggagtggaaaactagccgcctgacattggcatgatcaaaccagagagccgattccatcttgagctattgcgatagtatgatttaccccttaaaaaaagagatttcgagagatacgtccctccaaatattttttttaaaaaaatcgttaacatgttggggattgaatacagaacctcgaggttaaaactacaccccccctttgccccttaaattaggacattcgacatctcaaactcttaaatctggacgaattaccccccgcccccagcactatcttgggcggttttaggctaggctagctgaccaaggagaaaagcacaacctcaaatgccatgttgaagaaagacctatggcgtttgaggttgtcacgtcaataaactttaaactttgtcatgcgaacacattaactttgcgtggagaaaaggtcatcttcttgcatgcaaacgggaaggccatgggctcatgtatgggaaattaactcggctgcaaaatcgaacagcctttgcaccaaaagaaattaaatctgcatttagattgtacaatacgcttattaatttggatctttttgtttttgcttatgcggcgatcaaacgtgaacagagggactattaattattttaaatttagaaaattaatatgcttttttaaaacaacttcgtagagtaaagttttgcaaaaaaaaaaagcgcacaaagcttggggaagcatacgcatggagaacgggagtttttttttatctactaggaaagaacacagcctggagttttttttatctactaggaaagaacacagcctaatattagattagatttgctagatatattttttacattcctttaagaaaacaaaactgagaagtgagaaagtatatcggtttccaagtatatgaaattgattggcataatacgggtctaaattatcgggagcaatagttaattgcacgcggccgttgtttttctccatggtgtccgtccgtagaccccaaaatcgtcacccaatcataatctgcctaaaaatatgttgttatgtatggaattggaaacaacgacccagataacccaaagcctcgtggcttccttcg

SEQ ID NO: 11154 - DNA, 1501 bp, Oryza sativa
gccgacgccgacgccgccgctgctcatctgcatcgatccggatgctcctcctccgatctggcctcttcctgtgaacactctaccgatgatttcttgatctggtcttcttccccattgatccgccagattgccacccagatctcctcctccttctctggttcttggattgggttgcttgctgctgttgctggtgtggcttggtgtgtgtgatggtgatgtgtgactagcttagctagctgcctagctaactttgtcctctaagcaattagggtttggttggtgttgacttgtttttgtgtatgctgatgtctttgtgccattttccagaggttggagaagctaaggttgttgaacagttcatgggggtggggagtcactttgctcaactattttcttcacaataataactctcataatacccgtgcgttgcaaccgatttattttaaaaaatagttcgtggcatataaattttaagtattcatattgtctaacatatagcgatgaaaaaattcataataaaaatatttgattctcataattttttatgtatctgattcatggggctaggggaaaaaaagcaaagtctcttctcatttttttttcccacgtgttagttcggagtggtggctgtcaccaccactactattttttaaattagtttttcttcacaatgatttattaaattgacattttttttgtttttagttctttcgtttgtttaattagtattattttttgtttgctttgatttgaagagatatttttcgtgataatttatttccctttgatgtgataacatggatctgttgagctggtggtacggtgcgatgggagtagtgtgctttgcaatgtacgagtgacttcagaataggagaatataagacatttttgtgttcattattttgaataaaatccgcagtatgttattttgtcgcgcttcttcataagttttccatgataattttttgggtaaggtaacaagcatatttagggtcaggaaacaagcaataaaatacgctttatgttacaatttttttccttacttttccattttaactgaggtgaataaacttgagtaattttttttataatagtgtaactttttttggaggtaatacattggaaaaggttaatgtcagattcaaattcttagggtacctttgaaacacaacaattgaaaaacggcggaataggaaaaacacatgattccgataaaaattcaagtataaaacataggaaaacatagaaatgactgcttgattggatcgcaggaaaaacgtaggaataagataagagaaataaattcaaagaaaatttccgcaggttgaagctcttgttaaatttcctccaaaatttctatataattgtcctttccataggaattttaaaatataggatatgattaaatcctttgtttcaaaggcatttatagaaaaaatttctatacgattcaaattcttcaaaattcatatatttttcttccaaatcaaaggcccataga

SEQ ID NO: 11155 - DNA, 1501 bp, Oryza sativa
gccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgttggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggccgtttgaaatgttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataacccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactatttcctgggactggtatcgattaacaggttaatttggagcgtcacgggctagttccggtcgggaatagttcggggcgtgacaacaacggtcaccacaacgacactccggacgctcacgccacgtggggagtcctaggggatttacgtaccattctaaagcctcagcagcaattcgacgttcatgctcatccttccgccttaggtagtccgatcttgtttcactacgtgggtaagcacgggttccgtcgttttgtgggttctccatgtctacccactcaatgaagttgcacattggacgatatgtctgtgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtacccatggtggaaaccaaccagcaaaaggatcgcttcgccagttgagacgctcaagg

SEQ ID NO: 11156 - DNA, 1501 bp, Oryza sativa
  unsure (1)..(1501): unsure at all n locations
taatggatagatatgttgaaatattgtggatatgatgtgagaggtgatgattcaacatatttacatattgatttgtataattaaataaattatatatgatattgcatgcttgtatgaactttttaataagcagttattgctagtgcgtggatgatgagatgacatgttagcctatgttgaattttagagttagtggattgtaactttatagaaggtgtagataaacattaaaaaataaattaaacaataaaaagtaattatatgtttattcttaactgcctaagctaggactgaagtctgaaaagtatctagaataaactcttcattactaattacatgttcaataggcgaggttgtggatgtaattgcacgtttttacactgttgttgcctactacttgtagcactattccggttggttatggcatcaaacagttgaataagccctaaatttaaatcctgattgtggcttataaactaatgagcagataatgagagatgtacactataaatgatttcacgcttatcactttaacgacgttgcagtgtcgatgcggaaatagtaagaatccagtaaccctaccaagttaaaaaagaactttctgataaatttttatttggttttcactatttgctatggtagccgtcccccaaaacggtaaagaaccttgggctgttgccagttgagttgcgactggaggagagcgattgggcttaatcacatgtgtgagaattgttttcagtnnnnnnnnnnnnnnnnnnnnnnnnnnnnnnnnnnnnnnnnnnntaagggagcnaaccaaggattaagtgagcgaaccagcagggcgtcgccgctccccatcggcagcccacccctcgctctcaatcgtgtgttattggaccgttagtgataggaatgagactgccaagaggaggggcagggcgccacaggggggggctccaatagcccgcccccggggcggcaggggggccgcctgcaaatgggcggcgagggggcatagaattttgcaggcggcccccttgccgccctgggggagggcgatttttgcctccccctataaagcccagtcccccctctctgaaatttcattatattcactaaaaatccaaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtatagaatgtaacttagggcgtagtacagaaatgcgaggttaacgcagttattgttttcatcaggcacaa

SEQ ID NO: 11157 - DNA, 247 bp, Oryza sativa
caaccgggactatagatttagtcccggttgttctcaacaaccgggagtaaagatcttttctttactcccggttgttctcaacaaccgggactaaagatatctttagtcccggttgttctcaacaatcgggagtaaagatccgggggtatatatattcccggtgcgccctcgtcttcttcaccaacacttagacgttttcggccgatcgatctctctcggcctctctccttcgccgccactgcctagg

SEQ ID NO: 11158 - DNA, 1501 bp, Oryza sativa
acgactagtcgcgctcaccctcctgcgtgcgactgtacacgtgtcgcgcgcggggaggaggcggtgacagcgcgtgtaccgtccgttttctttgggcgtacgatttcttttttttttctatttttttctcttccgtaccttttccggtgttctttttttttcttctcgtatatttttctgtttttcctttttaatacgtatgtacgcaaactttgtatacatacaaatacaaacttgtatacacgtatataaatttagtatacacgtatacaaactttgtatacatacaaatacaaactttatatacacgtatgcaaacttttgcatacgtgtatacaaagtttgtatacgtgtattttttggtttttatacatatgtataccaactttgtatacacgtatacaaagtttgtatacacgtatacaaagtttgtatacacgtattttttaaattttttatatgtatacacacaaactttatatacatgtgtatcttttatacattaaaagtgtatacatataaaattatgtatatgtacacacatatgacacgtatgcatataccatatatatacatacgtataaacttcgtatatacgcatacaaagtttatacgtgtatatatatatatatatattgtatatacatacgtgtgtgtatatatagtacgtatagtatagtagtactctataggataagagatcagactagaggggagcagctgatcgcgcacgcgaacaagcccaagcggaaccccgcgagtccgcaacacaaaaattgggctgcaacctctcacaaccccaccgtactattggctattgcacagggccagaaaagcctcgaaaacggcgggagcgggcagcccatatgcccatgatcccatctcccctcgcatgagcgcgcgtgccacacacacatcgcgacttggcgaggcggtaacttcccctgctgctgcgcggtgcgcacacgctggagcaaccaaccaaccaaccaaaccgaccgcccactgatgactgaatagccgataggcaaaaccgtagtaggaggaccatgagacgacgccgtatgtactgcgggcatgtgcaccgtatgattacggaaagcaacccccacaggtggacagcctgacgacagggccggcagcccggcacagctagctcttgtcgcggcgacagcctcatatccaggcttccaaagctctccgcctctcgactcgtcatgccattcatacatgttgctccgtttgtgaatattattaccgtaggtgacaagttgcagacttgcagtgtagtactagtaatggagagagtggacctgatgatgaagatgcaatggatttttttcccctggcgtatgggattactggttcagtgaaaatgatggtttcagtgcatgcactgccaacagcatctctcctgtggataagttttggaaactttagggcaagtactgtaataacccatatgttgcctctaagaatgccacattggattgaatgatga

SEQ ID NO: 11159 - DNA, 1501 bp, Oryza sativa
atctcttatcctatagagtactactatactatacgtactatatatacacacacgtatgtatatacaatatatatatatatatatacacgtataaactttgtatgcgtatatacgaagtttatacgtatgtatatatatggtatatgcatacgtgtcatatgtgtgtacatatacataattttatatgtatacacttttaatgtataaaagatacacatgtatataaagtttgtgtgtatacatataaaaaatttaaaaaatacgtgtatacaaactttgtatacgtgtatacaaactttgtatacgtgtatacaaagttggtatacatatgtataaaaaccaaaaaatacacgtatacaaactttgtatacacgtatgcaaaagtttgcatacgtgtatataaagtttgtatttgtatgtatacaaagtttgtatacgtgtatactaaatttatatacgtgtatacaagtttgtatttgtatgtatacaaagtttgcgtacatacgtattaaaaaggaaaaacagaaaaatatacgagaagaaaaaaaaagaacaccggaaaaggtacggaagagaaaaaaatagaaaaaaaaaagaaatcgtacgcccaaagaaaacggacggtacacgcgctgtcaccgcctcctccccgcgcgcgacacgtgtacagtcgcacgcaggagggtgagcgcgactagtcgtgtattagccgtctcggggggttggtggctcttccgcacttgcaattgggagttgggacatttgcagtttggcactacgtcctatataaaattatttaccacttctgatgtgatgctttttaccgatttgctactactaaacccacgtgttataatcatatgaggaatttttgtatcattttcacgcgtagtaaacataggtccgacattactgatagtgcaatgttaccctgcagcgtgtagttagtactacatggtactatgtacatagtacacatgtactaatatgattttcgacggtccagaccttgaactggagctagtagagccaggaacctgccagcgtgtgcactccacgaacagggcccggaaaagagaaacggggagaggaaaacgcacgtcgacatgtggaccatctcgggccaatcaggatccctctggcaccaattgcgccttcaccttttcacaggcaaaggataaactcctccctgccaccatccattccgccggcgccttatcctaccctcatctcccgtacaaaacccactccctccctcccgctcccaacctgacccactccaaccccccctgcgccattgccggccacactcctcttcctcctccatcgccaagaaccaccacgaggtaggcaaaccaccctcatggagatggatttctgtcgttctgagctgcaacattgcttgatctcatcgttggttttcttgcagcaatggcgtcgctgtccatggccacaacgctgccgtcgctggccggcgccgcaccggcggcgaggaagagga

SEQ ID NO: 11160 - DNA, 1501 bp, Oryza sativa
ctctggccatgccacagcaccatcagacttgatcaattcagaccaaggaagtcattgcctgagagaactcctgacagagcaccaagaatcgtgcacgaggtagattggcatcatctttcccatctccagtgtccagacaccaaggggcaacccaggccgaattactgcaccatcaacttctcaaccccagctgcaaaatgactcgagaaaatccctgatccattggcaaagtgaagagatcgtgagcttccttcccacctctggttgaacgccgctgccgccattccatctagagtaaattccctgtatgcacctcaaaactgactcaatcctttccatatccttcaattttgatcaatcccctgcgtgccctcgagatttcgttgtgatccctcccatgtccctaccgttagttctcatagcattgagtggttaatttacctagaaatgtccattatgcccttaagagtgcaatttgagttctcagtgactgattgtatttgagaggttgagaaagattgaaatatccatgagtgcatcatattctatgagactgagtaataagtgcacagaaaatttatagaatggtcagcaatttatagaaattttgacaaggcacttcgtggaccatccatgcactcaccactatgtggatcataagcatcatggccataaaacgaatgcaagtgacaaactaaaagaacaaggcaagtactgtgtatgttatgagcatcgctggcatagtacatcaccattgcaagcaatcctgggcattacagtagcaaaatatggcagagtacctaactgcataacaattcatggccatagcaagcaatcttaggcatcatttcagcacttacaggacctcagaacaacaaaatatagcagtaatattattataccacttatctagtacatgagctaatttaatagtaccaaaaggaaactaaatcaactagctacatacatagttgctctatacatgcacatcttgcattcccttctcaatatcaacagtcaataagaagggaagaaatcatacacatctacatatgaaagaaatcaacctagtcggatgggagcagtaggggatggagctcgggaaccagcagcagccaccactgagacttctcaacaaggcggctgctgcctgggccactactgccgagattttgagcaaccaggatagcacctataacgtcaattcgctgccgtcgctagggccgaagccaccgtcgccagagccgaagggagccgaaaccgccactgacgagagctcgagggcgacaggaccaccgacgtcaaaacgacggcggggacgggagctcaaggccggtggccacgggaggaacgtgtcacgcccagaaattcacgaaccagaattactaagctgaatgtgtattaaacccctgtccaggaccagccagggtacataaacgacaattgttgacatacagatccacgtcttacaaaaatataaaagattacaaatgcagcggaa

SEQ ID NO: 11161 - DNA, 1501 bp, Oryza sativa
ggacagcatcaattggcgtgcatggttgctgtcgtgcaatgtatagcagcagcatgtgtcatagtccgggcctggtatagtaatgttgcatgtcggcagcgatgctcttgaaattgatgctcttgcagaactcttcgcatttcgaaagcgtgcatggtttcaacggatagcaatttgctgcacgcatgattccagaatgcagtgtaaggtcagatctagtctgtatttgtacgcatatccaaatgaaacaaaatgtttatatgcttgtataaatacgagagaaattaaatatgaaattgtgcgagtaatttgtataagaccagctgcatatatatactgccttcatattacttttcatttgcctctcaaatccgcctccatcaaactttgtgtaagattgaggttacgatcggttctgcctttagggagagcaacttcttcgtttacagtgggcacatttccttgaaactacatgctaaacggtgtgtctttttaccagcatttacagtattgaagtttctctaaaaaaaatcaaataaacccgttctccaagtttatagtagtatacttaattaccaatacactaatcactcatcttgttttgcatgcctatttgataagatcaggcaatccttctatttgaacagagccttaaacatcaatagagcctagctaataaacgaggttgttgcgagggaatagcataaccaaaatgtggttagcttttggccttttgccgccttagagctgcggtttgttatactatatatgtggcattttcttcgcgcaaaaacaaaacagtcttgaacaagtttaacacaataaaactgatatggtattttaaatttcgtaaaaagtaaatattgtaaaatagaaataaaggtgggcatacaatatcatactatcatatgcacgagaagatgacatgaccatcgctatgactacaacggctgcaaagaacacagaatcctatcagccttgtgaagtagcgccatgtgaggagatatatatgtgtggagattatggataccccatatctacacggcaggtataatctagctgggtacagggtaccaaatttagatagaatatctgtatgaggactcgggttggtttctaaacttgtatgtcgaggaaatacccaggatcctagtcggttacgattgtattttatctgtaatctcatattccgttagggatatggactgtattttgtaatacggaccccttcctttatataaggaggggtccgggtccctttgggacatgatttttctcccagatcatacgttcaataacagactcagcggatcaatccccggacaggagtagggtattacttcttgaataagaaggcctgaacctatataaaattccttgtctccaaactcatctactattccagcttgatagccacccccttttagtattgccgaaatcttgtttcgacagttggtgcaccaggtaggggtagcgtcaagttcttcgccgactagtacga

SEQ ID NO: 11162 - DNA, 1501 bp, Oryza sativa
ttctcattccccccctctctctctctctatctctctctgtctcatactttagcctcattcataaccgccgatgagctccccccttgtaacatacccgaaattttaggacttaaaaatttctagacaaaatagatataggcaaacttttacaattttgagagccaaaaatttccgttttaacttaggtgagaccaatctaaaccattgcataaataaaatttgacaacaaaataaaaccttttcattcctaacattagaccataaattccaccaagcaaatgagcatacatgtgcataatgcatgccttgactcgagtcccttgtgcatttggattttggtctcgcattttacaataggtcccatgagcataacttaaaagggttaaattactaaataaacttatagttaatcttgggtgataatatgtggacataatatttactcaaatatcatcttctcagttcgaaagaagtttaaagtaattcctataataatattagatgcaattatgaagagggaactcatatacaaagaaaaggtcatcctaattctctaaaatattttgtacaagataaaatcatgggaaaatttatgtagacaatgattagcacaaactattcactgtaattttggtcagatattaacactcaagttgatacctcaaataaattaatcaaaacagtcacatagtagactaattaaaatcctttattggctaaaaccatacttcacccaaaagtgaattaaaatgcataaaagtatatgaggtaaataatttatataaatactatattatttatcatatctcaatataatttttctagaattttattcctctgtttaagcctcctcaaaattcaatctagctcttagataaccgatctttgtttaatttctgtgatcaatctatccataatttttaagtgcaaccaaaaaaaatggcaactaagtataaacatctacttccagtaaaatcaacactacttaatctgatccacacattaagctatgaagctacaaagttagaggagaaaataattccgaaaattcatccaaaatcaagtttacccatgtatttacccacacctctcccttccacctactagtatacttcgtccttgccccacctgacagccactagagctagctctagctctgtcaaaccacttctccaccgctccagccgattgaacagacgagagagagagagagatcgttggcggagggagtgctcgacgcgtggagctgacgtgccgacgccgagtttcaccttcaactccgccaactcagtcgcccttcaccattcaacactctagagccgaagaagccgagggagaaaggccctctgcctctctgtcatcctcattctcgccggcggccgtggagacgacgaccgtcgccatcgccatcgtgccgcggtcgtctcgactcctttcccgatctgaaacctcctatcaatgccatatccattccacctaatctctcctcttgacatgcagt

SEQ ID NO: 11163 - DNA, 1501 bp, Oryza sativa
cctgtatgttggcaatttatttttagaggacaagtacaaagtcgcagttttcactggaacaagggttcctgaaggcatagtgcacttgacaggattgcactcacttcagtatgttgagtcaaatgaaacaattttgagtcacctcggtgttttcacagagataagaaaccttggtgttgccaacacaagaactgaacacttttctggattatgcaactctatcatgaagatgatccatcttgtccatttgaggatttcagcgttagatgacgaacaagtgttgaaagtggaagcacttcgtttgcctccaactctctcgattctcgaactgaaggggcagctggagaaggagtcaatccatcagagtctatcatccttatcacacctccacaacctatccaagttggtaatggcattctcaaagcttgaccaagactctctttacagccttcagatgttgcatggtctatgctttcttcaccttatgagagcttttgaaggggagaaactgcatttttgtgcagaatccttcccgaaactccggacattacgagtgtgggatgctccaaatctcagacaaattgaaatagaagaaagtgcaatgcaaagccttgcaaggctaacacttcgtgactgtccagaactgatgacaattcctgatggcattgagcacctagcagctctggaggaacttcatcttgaacaagtaagcgaggatctcatagagaagcttcggcgaaaaggtggggaaccaagtaaagatcttctgaagatcaattacataaggaaagtcactgttcgagtaatccacaaaaatatttgggagagaattcggtgaacaggtccaagttccttcttactaaggtaatccttgttttctctgtagtatatagctaggattggaccatcaattactattgtttaattggtcaatgtggatgcagctatcctttcagaaataggtgaaccggagtgatcttgtgattacagataatcaaggagagtgctcacggtggatatggcagatacagagagagcgtaagctattacagttgatgaggttgctctgctgcctgctttgcaaacgaggtacgaatacgatgagatttaaatcgtgacccaactcaattagcccctgtaaaaaaaaattttggcatcatttgttatttatttgaagtctctactctgacatcattatcgcacctctagtctagtctagactagagtgttcttaatttagggacgtccagtatcacatatatttgcaatttaaatgtatatttgaaagtgtactttaaatttagagatgtcccgtatcacgcaactttgaaatttaaatgcagttttttttttgtccgactgcagatgacgcatgggggactgttctccacctcgatcatggaccaccaaatgtcttaccactccagaagagcatgggcagggatctgggacaacatgctaattctagaccattgaatgttgtatgctgagcatatgttta

SEQ ID NO: 11164 - DNA, 1438 bp, Oryza sativa
cattatcgcaatgctcgttgagcgacattcctgtgttggaacaagcatcaattaaatatcgattgatgagggtataaaagtacatgcacctatgtttacacggagttttcctctctgcctacaaccagggactatgtaaatcttaaatttttgcaagtgcatcaagaacccatcgggaaaatatatttacataggcggatatctttgcatgggagaagatatattatatcatgcatgggagagccctgtgggtagaaacgacgatttaacaagtgttgaatacttaccatgggagaagaggagcgcgaatatgaacacgtagacaactattacaatcttgcaaaccattgtgaaaacttgagtgactaattgagggtaggaaggcagggtcaaaatatgtttatttatagtacttcggaagactaaaaatgacagaaattaaatgaatatgctcgagatgacagctattaattcatcattaatgtttactttatttgtaaccatgggtggataaggttcaagataatttcattggttgttatttaagttagaacttattagcttgcaactatattgtactctatgaacataaaagtgaactcattgaggatgacatggcgttgctagagaaatgattctagcttattttggatgatcattgatatttagataactgtatgaaaccctatgcgttactacggaagttttgtatgacaatagtataaataacatgtaaggtagctagacgacgtaactttatgtaatttttataattttcatagttgattgactactgagagaaatctataagcaattaagatgatgtggtttataaccacttaaatcatatatagattgatcattcaaaaataagcttgaggtgatatggctcaatgagagaaagaaaagaaggtagacaacatagattaatcatggaaagataaaactaaggtaaatatgactttgtaagagaagaaaactgtagaatcaaagtgtgtttgattattactttgtgatgaataattagcatgcgtgatgattggattttaatatttggagataattggcgaaatgggttgctgattgtgtaaccggttagatcggatggactaggccggtcagactagccggcgtgatggtctgaccggccggctctgtgtcagtttcagtttcgggttgtttatttggatactcatgattggttcatgtttatgacttctagatcgatactatgcgtatgtgatacaattgtgtgctaatgttgactcaagttggagagaacatgtgctcagatatggtttcttggttgattcatgtgtgggtaagtcttgatatacctccggagagtgtttgccggtgatggatcgggagtcattttgggagaagatgacgtctggatgattaggatatcatgcgagatgcttaggctaaatatcaa

SEQ ID NO: 11165 - DNA, 1501 bp, Oryza sativa
ttcaaaaggaccttgggggttttattataagactgcagcaggtacaagcagaaacgagacaaatgaaagtactccaaaagctaccatcagtaactgataattataggcgatctgaaagcaatacgtgtggtattaaagtttcaggattttattcaagaccaaatttcataaatcaggttttttgggcgggggtgcttcacaaaagcacagttatatatatatatatatatatatatatatatatatatatatatatatatgacactcatatggggcaccatggtgcccgggcaccatggtatcaaatgcacaaaatcactcaaatttttcaaaattttcaaattgtgagtatatacctagttataataatttgattcatacctatacttatcaacaaaacaactcaaatttaactttatttcataatccatgattacatacctaactaattatatgtatagatactatatacctagaatcaaaatctaacaaaaacaagttcaaattcagttcaaatttgttttgaactagttagtaaagtagttaatattaatacctaagtaattgaaaaagtttcatactcatttgaattgggtatatgctcaatttcaacaatggtgcccgggcaccttggagcaccaaacaaatttactatatatatatatatatatattctcacttaactacattaacaaagcctaaacaacaggtagcatataaatcaggtgcaacaatcaaaatttgttaggtcttataacacgaagcttcacagctttatataaggcccagtttgacactatacagttataactccgaactccaacttacctagagctgaagctgtgccaaacggtacagattcactatttttttggaacaaagttgggagagctgctccactaatttttactatgggggtggatctgggtttttactgctccacagcttcacttcaccccaaaagaccaactagccttttattttttagtctatttatacaaaaataccactcaactccccctttcacacccctgtactcttgttctctctcctcactgcaggcgcactggtagcggaggcgtggcgcgtgtgcaatggcggccgccgaggaggcaggcggcgcacgggaggggcgcgagcggctggacgagcatgcgtgcgggtagacctgcgcgagcaacggggtggtatgcgtgcggcggccgcggcagcccatgggctaaccgccggcggcgggggacgggggtgagcggcggcgtgcgggttgaatggtggcggcagcggcagggcgacgccaactaggtgttcgatgaaatgctaacaaggaacgtggtggcgtgaagctagccaatttatccaaacactttcacacccacttcagctcctataagagtgttctagctagaattgaagttaggagctaggaattggagtttggagccataccaaacggaccttaagaagcaatatatgtagtacacaaacaagaatcggtagtttg

SEQ ID NO: 11166 - DNA, 1501 bp, Oryza sativa
tatatatatatatatatatatatatatatatatataactgtgcttttgtgaagcacccccgcccaaaaaacctgatttatgaaatttggtcttgaataaaatcctgaaactttaataccacacgtattgctttcagatcgcctataattatcagttactgatggtagcttttggagtactttcatttgtctcgtttctgcttgtacctgctgcagtcttataataaaacccccaaggtccttttgaaacaaaggatttgcagataagttttgtaggatttaaatcctactgaaaattttccattttgactgctcgtggattttagaggaaagttagcaagtgctttaaccttgtatttccgcggcctgtttaaacatctcgtatttcttttttgtgttttgtaattctctattttgcatatgcatttcttttgaaagtctttccgtttctatattttctcaatacttcaatccgaaggagtcctaaaataaaattctgaaatttaaatgcaacttatcaatcctacatgagaaattctgttaccaaagtacttactccatataagcttcacataggacagaggaagtctgttatataacttatgcaagtttttcataggaacagcattattttgcattccaagattggtttccctagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgtggccgcacaggcacctggccgccgcaagcttgcggctagggttactgcaacagcgccagcacgcgacgcggcgcgccggcgccgcgaccagcgcctctccgtccgtgagtccacgagcaggtccggttccgatcctcactcggtcactcatctttcctttttcctctagatagatctacatttgctgattgccgaactgctactaaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaa

SEQ ID NO: 11167 - DNA, 1501 bp, Oryza sativa
gacatgttagattcagcagtaaccaccagctagtccccttcgacgcgcaggcaccgcgccgatgcctcgtcgtcggccgaccaacaaagaagggtcttgaactccggtgttctccagcttcgtccacgtggttgggttggaaagggagagggtgagagagaagaatggatcccctgtcttcccctctatcctacgttacccagatacggggatacggatacggatacgcgatacgtcgatacggggatacgtcattttctgaaaaacatggatacggggatacgttcacatatatgtatataaatatctatatataaagacaaatatcaactattcaaagaaattagctaattacaatgtagcaatttttctgattatctcttgtagttgattcaggtgggtgaaagtgaaacgatggcaggtgtagactagttgagaaatagcacaactaatatatctaaaaaaaactctttgatttttccgtatactctttgactattctatttcttctctaacaactcaacatatcaccgcatcccacagtggcttcttctcaccatcatttggaggaatgatgaatctgcagctagattagcaaccgcactagctctaggagtgctagatgcattgacacttccaatcccaaaaatcatcagatctaaaaaaaatactagctatctctgtatattgcacttctgccaagaaaacaggaaagaggaacaagatcgaacagataagatcacatgcactcaagcatcgaagaggcaagcaaaacaagtcaaatcgttcaatggaacttgcctcaccgggagcaggaagtcagtggctgctacggcggcattgtgcctgttggcgttgggtccggtggtggaggcggtgaatacatctagacgcagatctgcattcggcgtctgaaggtccggcatgtagcgacggtggcgctgcgttcggcgcttggcggcggcggctcagagttcggcctttggcgtctcgggcggcggcggcggcgggggaaagtgccgcgagggttgggcatcaggcgagaaaagtggagacagcatattgatcgttgccatgcggacgtatcgagaacgtatccagatttattttaattgttcgaaaattgcgaaaatcgctgatacgtacgcgatacgtatcggatcgtatccgatacgtatccgtatccctccacgtatctgatacggatacgttgcatttgtgacgtatccaggtaacatagcctctatcccgcactgacccatctagcatggccatcttgcggtggcaagccgctgccggaaaaggactgacgcccagaaagaagcttgccacagtctttcggcaagcttgccatcacgagaaattggcctagaggtctgcgtaaaagtggatctattttcgcaggtagtcggtgtcacgaaaatcggtttttatgatgtagtatgaaaaagaacgaggctttagtggatatatatccaatcttacggttcaaatcatggtg

SEQ ID NO: 11168 - DNA, 1501 bp, Oryza sativa
actacagggggttacgaaccgggactaaaaagcatttctccaccagttatggtattctccacgagtatgacatactttggacatgcaaggactcaaaggagaatgtgaagacgtaactgattacatattatatactgtacattacaattaagaaaaacatgcaagacaatacagcagttaactagtaagagaaacattaggtacccaccgtttctatcgataggccggaatacaatttcttacgtgaccaacgatcgaggcaacgaccccgtatatatatatatacagcatgaatgcacacagctggatctcaagaaggaaagaaaagctaatctattatattattaaagaaatagaaaaatgagcctctacgttcgctctcatggcctagaaattctcacattaattggagaaaaagaaaaagcagagtccatataaaaatacaatttagaaatagctgaaattcggaattaaaaaataaagaatattagaagaggagactagagttcatatagaaatataattagaaaatagctgaaattcggaattaaaaataaggaatattagaagatgagtatagagtccatataaaaatataattaggaaataataaaaattcgtaattaaaaataaggaatattagaagtagagtatagtgtccatatagaaatacaattaagaaaaaaaatagaaattcggaattaaaaaataaggaatattagaagtagagtataaagtccatatagaaatacaattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttataaataactaaaattcaaaattaagaaaaacatgggaagaagagtttaaagtcaatataggaatacaatttagaagtaactgaaatttgaaattaagtttagagtccacgtagaaatacaattagaaataatgaaaattcagaaattaaaacaataaatattaaaagacgagtctaaagtccatataagaagaatatatataatttacagataactaaaatttaatattaaaaataattaataactaacacgtatgtaaaatacaatatgaatattacacattagtggtttcgtaaagttattgcaaaatttaaaatgatgttgtcattttaatatatttgaataatataatgagaaaacatatgtgctattatatgagagaaaatataatgatactagccgcacaatctgtacgggccaccatgctagttaaggtgaagacaattgattaagaagcaaccttgatcgagctagcaacaacagcgtcgaccagagaggaggaagaagagatcgaagaagatatggcggtggcggcgc

SEQ ID NO: 11169 - DNA, 1501 bp, Oryza sativa
gggcaggcagtagctatgcatagtttagaaattgcacatcatattcatctgtaaaaaatcaggtatttattatctatattgatcagaaaatcaaatagattgtagagtatatagcctgtgaaaacagtaatgtctactccgaaattcaggccacaattttaaatggtcctacataaaaaggaaggacaaatctctcataaccactgaaatttcaccaattcagttatttggcatacgttgtcttaaatgcccgtctaggtccagggcctatgtgtcacagacattaaacgatcgtgcgaaatctacaattccagtagggaatcgccaccaaaaaagaaacaattacttctatgctagtccgcgtatcacctttgaattgatgttcctaactgacctgccaataaaaccagaaataataacaagaagatgaacataccgattccttcttgctgttctgcttttcctccaagtccttgagcgctcgatccatccgcttcctgccgccaaagaatcaaccccccagcatcagcacaactcgatacaccccaaaaacagatcaagttaatcagatcaccaaacaacatcatctcaatggctactcacagctcagcggagatgtactcgatgcgcttcttgacgttggccttcgcctccgcgagatcctgcttgaccagcaccggcccgatcagcttgtacacgttcgcctcgtcattcaccagctccagctcctgcgcgagaccagatcgaatcagaaacccacaccaaaaaaaaagaggaaaaatccacatagagcggaagcaagagagcgcggcgagcagggcatgccttgaggacgagctcgttctcgccgacctggatggtgtactgcttgcggacctggtggttcttggagatgtctgcgagggggaaggaacggacagagctagggttagggtttcgggattccgaggtgacgagaaggaaggggaggggaagggggggtttcgagcgtgcctttctggatcttgctgagggcgttggcctgggactcgaggtcgcgctgcatctcgcggacggccgccggggtggacgacgacgccgccgccgccgccattggtggtgctgcctctgctcccctccgccgccgccgccgccggattccggtgtggtgcggaatgctagagttggtgtggtttggccgtttgggctttcgctggctttcttttccctttgttctgagttctgacatcgggtactattttgggcctagatgggctcaatttggcctagctaatctaacccaaaaaatgcaaaatgggctgagaaaagcaaatgttattgtttgggggaaaaagtacaccgaaggtccctcaaaaacgccctcaaaccgcaaaaccagatatgcggtgtcccttaactatacaaaaccattcacccgaggtccttcggtggttatgaccccagttttggcctatgtgggacccacgtgggccccacatatcactgtgccacgtcatcacca

SEQ ID NO: 11170 - DNA, 1501 bp, Oryza sativa
atttgttttaaaaggatcattcactactacattagatctatatatagatctatatatagtgaaacattatgagtatactaggtgaaatatttttagtgaaacaaaaaatgaaacgaatttccttaatagagggttttcaaaaaatatgggttatttgttgcaatggagtatgtgatggagacacatggtaggtgggggcagagaacgtggtggggccaggcacctgcatcacgctcgtggtggccgggcgcgcggggggagggggttggtatttaatacggtcacaaataaaatccgcaagcgtacggatataccgatgtagcacttcccctacggagtatttcaagggtatcgaatccaagggaacgtgtgtgatcagatcttcctccgattcatccaaggacaccaagcaaaggatagaccaggatagagaggatttacaagtaagaaacagtgtctagggaaagcttaactttaatcctaacacaatacttcaggcactggcaacccgctgttctcagatgttgctctactacatatccggacagggaggacttaagtgatctcgagggctgtcaccacctctacacccacctcaaacgtactgtgggatacgtagcaattactggataataattacctaatcaccacgtttaagcaattaatatttaatttagtgtttataactcaccaaagcaatcactatattttagttgattatagcgaacaataattctgtatgctatttaggaactaaccaagagataattctcacaagataaatctaaattactcaagaagaatattatattgaattcagagtaataaacagaataaaagaaataggagaagattaccgacaactccggaattcttccgactccttctattctactctcttcctattctagtatacaatatagtacaataaagcctcttataattcagctcaagcttggaagtgtgtgtatgaaatgaggaagtgaagcctttatatagaggtaggtatgatggttggcgaaggggaaatgtccgaagtgccctccaaccgtcatcagggatgcatctgggacgtccacgccaaaccccacatccaacggtggaagtggtggttcggccgaaccaggcccatctggcctggccttcggtcggtagactccctagaccttcctccatccatttctcggagttttgggttgaattacggatgtttcgatgaagttcacaacccctccttgtatggatacataattttcctcactttagtccgatttgcctcccaacttcagggtttatcatctgcatacaactatacaccaacacttgtggaatatgtgagattaagcacctatcactatgttggatgttttattatctaaactttatgcatatgttggcagtatagaatcggtcatttaacatccgccaacagggggagcgcccgatctgcttcacccccgccaggcgcccggtaggcatcatttccgcaattataattagg

SEQ ID NO: 11171 - DNA, 1501 bp, Oryza sativa
  unsure (1)..(1501): unsure at all n locations
cagaggaagaggtctctaatgctgtcaaggcagaaattgagaagaaaaaggatgaacagccaaagcaggttatttgggatggccattctggtagcataggtcgtactgccacacaggctctgtctatgggcggcgaggaacaggttgatgcttcgaatgttcctggtccagctccacttccccgccctcccatgccattgcttagacctcctcagccacttccactggttaatgttccacgctttcaacctagtgcaatgccatatcccccacaccaacaacctcatctcatgcaaggagttccacatatgatgcctaccatgcatccgcctccaccaccgccaataccaggtcagccgcaggtgattaggatgccaggttcaatgggtcctatgccaaccaatatacctccgcctccaccaggccaaaatccctacatgcctggcccgccgcgtccatactccatgcctccaccgccacacatgccaaccatggcaaccatggtcaaccccattgggattcctcagcctccaccacctttgcctccacaaccacctgctgaggagcagccacctcaacctgatgaaccagaacctaaaaggctgagaacagatgacgcttctcttataccagcagaacagttccttgctcagcacccggtaatacttcttgatatatttcttctccactttcctgttttctactaaacattcttgttagtcttgttctttttgtatgcgtatattgaattttaagaatttccatgtgctaatttcttctcttccctgcagggccctgctcacatctcagtgtctgtacccaaccttgatgaaggaaacctgcgaggccaagtgttggagatcggtgtccaatcactctcagacacagttggcagtctaaaggagnnnnnnnnnnnnnnnnnnnnnnnnnctgctaataagcagaagttgagcgtgcggactagtttcctcaaagacaatctcactcttgcttactacaacattggccctggagtggtgatcaatttaacactgagggagcgtggtgggagaaagaaatgagctttcttgtatctcagtgcactggcaggttattgcttgcaactgaacttgcagctataaaggagaatatttttgttggttgctgcctattaatttctgtattctcatgttatgtttaaacgtggtgaaacactgttatttgcactatttgaatgtcagacatacatatctctttatggccatctgttacttaaaatatatgttttagcttctgctgtttcgctgttgtgaaatgtgcttgtcttgaaagttcactgcctacttgtcatcttacaagatgttcactatttgaatgcttgcatgttattgtagatttttctgtactgcatgggtgaaggtcttcaagagcttattataaaggtctggtcaagatgatgattgttttattgtatatatacctctgacattgttagttactcctccggtttcatgaagtgaga

SEQ ID NO: 11172 - DNA, 1501 bp, Oryza sativa
tatacagagttttaaatcatactgttaggaaaactatatgactttctatcagataactaattaagttttactctggcttatttttgatttatttcttttgatatcagaagatgccaacccaaccaggacactgcagcacattactagccacttacagatgccaactctattccatagtcgtttgactgctagctttgttgtttttatagtggggagtcctttttctctagaggtattttaccatccttgaggtgaggagcctccccgcccccttatcattaaaaataaataaattaaaaaaatcaattttattttgtagttactgttaatattttgatgtttcctctttatttttgttttcttgcatacataccagagagtatattgctagcaatcttggatgcttatctgttcctccgatgcaatgctatatttaggctatagcatgcagcgctacatctatcatcgattggattcgactttagccagcctgtatatactcctttaggctggtgctacataccgaaatgcatatactcccttcattttgaatagttgtgacttgtgagtgttagtgctattttaattttgatcataaatcacttttaaagtataatattttgatgagtaaaatttacatgtgacatatataatttgattacatggtataatcttttttttgagaaattacatggtataatcttatgtaacatcctcaaattttaaactaaaatttgactgcatcatgctggcttttaattaaatttgtttggttcaaaaatctatttcttgtttatttaacaaaattggttcaagtattattagaacccttccaatttattccctttattctaaaccctagtgaatttgagcaaattctctcaaattcaaaccatagattattttcttagttcaccctaatgttagtaaggatttgccatactttaaaccctagtgaaacccttccaaactcctagtttgaattcaaatcttttctagggaaatattcaaaattcctgaaatctactgttcattgcactcaaggtgctcgacagaatgcccagcccagctagagcagcccaactccaacccaatcttatgcaaagtttagaattggtcctaggggaccacatcccactcaaaaccgtggttctctttacctcttcctccctttcacgcgcgccgaccagcagccgactttgccgcgcgccgagccgccgcgcgtcggtctcgggatcgatcgcgcgtgcccaaccgccttggcgcgctgccgcccgtccaacgccttcaacccaccgttgccgcaccaatctcgacgacgacaaagccgggacgacgaccgccgcacgaaatcactgctcgacgccgtgcgctcccgtccaagccgccgccgagtgcgatttcgtttctacccgggatgaatcgcgccaattcttgccgcacggttagattgaagatagacggtggtatcccctccctcaattcaaaccattcaccccca

SEQ ID NO: 11173 - DNA, 444 bp, Oryza sativa
gtctctcagaggcaacacaagaaaagttcaagagatcgagggcaaacgtctctatggaagtatagtacaatgagtgtgcagtaccattttgttaaggtacagcgtagtacaatttaccattggcacagggaatgattttaaccttatattaacacttcagaaaaggagcaagcatgcataattaactataagtgcacgcagaactgatcagaaaggtttcttttttccaactttgagcaggaaattaagggctaaaatgcacagctctaatgacatattcccttactcacacaccgaaacaacaggttaatttcacccaacttttaatcgtcaaagggcaacgtcagtttcttccccaaaaataatgaaggaaaaaacaaatgatgacactacacgtcattccttgtgcctatctctccaacccgcccccccccccccccaagg

SEQ ID NO: 11174 - DNA, 1108 bp, Oryza sativa
gccaaccgcagccccgatgccgccacaccgccgttaacgaacgagaacgagaacgatcgaacgactgagagtgagaacgaacacgtcaacgtacgttgccgcgagaacgtgaacgagaacgagaacgatcgaacgaacgagaacgatcgaacgaagacaagcgagaacgagggaacgaacgtgaatgagaacaagcgaacgaacgtgaatgagaacgagcgaacgaacgtgaacgagcgaacgaacgaggacgaacgttaacgtgaaatgctatatatatatatatatatatatatatatatgttacttcgcatttatcctaatacattttttgtatcttgcagaaaagacgtgttgtcggagtcgtccgtcaagcctgagtggaagagctagccctagaaggaattggagcaggcaagtgacgtaataatataaatgatcgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcatatgtttcttgtatcaacaga

SEQ ID NO: 11175 - DNA, 444 bp, Oryza sativa
acttaaatcgactgaccacccgccaatcaatcattcattcaaatccgagcagctagaaggccgcactaaacttaagctgcaaagcacgaatcccgcgcaaaacacttcgatctttcgggcgatcaaaccgagcgaattcgcggcgggaggggagattttgcgcgtgtttcttgtgggttcgctcgcgtggggcgtaaggggcgttgtgaggtgtggatttcgggggcgagaggttggagaagaatctgggtgactcctcgctaacaataggccgcagctgggaaagaggaggtgaaatgtcggaactgccccgttccgggaaagaatcttcgcgggaatttagcgggtgtttttttttttagctcatatccgtttcaggcattgcgatagtgtctgcttcttattaccggcgggaataacctctcttgtttattcgtatccagc

SEQ ID NO: 11176 - DNA, 937 bp, Oryza sativa
atataaacttgttaggtgggtgcaatttagtacacaaacttgtaaaatactcattatggtgcatgaacttatctagagcgtgcgtgctagtccaaaacttgtgactattcatgttgagttcgtctgattatagaatgtcaggcgcacacgtgagggtatgagatatgtcgtatgtgtaaataatttaaccttgttcttcatttatttcgtatccattgcatactccctttatgtataattaacatgacttattgtatgtttgattgactatatgcatatttacgtaacatcatattgacatgtgagcctacataacatcctaatcagtgctcaacttagtgaaattagttacaacatattgttttggctctagtttgcacgtattagacaagtttatgcactgaaatgagcgatttacatatgcatgtactaaatcgcatccaccttgtaagttcatgtaccaactgtgcaatttactctaaatataactgtggtcatgcacacattgtgagggataatggttcctggactttatgccatgacatatatttacttaattgctatgcctgtgcttttcaggctgaatgctatcattacctttttgatgctgccatcaagctctatcaattgggtattgattggacaactcctgagcatggtccaataaacagtgccaaaagaccacgcagtgttctaagctctagtattccaaatggatgccctgattccaaatcatcaaaggtctgttctttgttctgagtatttgcaaaatctaccttctaaatgatttttttagatcttatagtgtaccgttttgcagcagtgagtactaggtgttattgtttgtgtactttcttaactttgtggttgctacatctggtcaactcatccatataatatgtttctggaatacaaatagctaacctttgtgttctct

SEQ ID NO: 11177 - DNA, 587 bp, Oryza sativa
aagctgcctcatagaaatttacacttttgatttcaaatataagtaattttaaacatacatacaagagtcttttacgaacacttacataaacaattcccaatgtggttttggtgtcttcgtttgtacgagtacttatataaaataaactatagcaagtatttatttgcgaacacgagcaataatttaataatttataaaaggatagtattttttacaacaagaacaacacatatagtagatctgagatgagaatgcaatgcctaatccaacaaaaactagaagagttagacaagtttttttttaatatttaggtaaaccgttctaaaaacggatactacttgtctaacccaaaaaagaataggatttggtaataaagcgaatcctcgaggaccccgtcgcaaaaacaccccctccccttaaaattcccacttcttctcaccttcttcttcttcttcttctacctttccctcccgcttccgattcctccacctccatgacctcctcgtcggcggcggcggcgttggagtagtaaccgtgcagtggcgggggcgaagtgtaggttgcggcggtggctgcggcagcgatgg

SEQ ID NO: 11178 - DNA, 1501 bp, Oryza sativa
cctctgagtgtatagccccctcccttttgttgattccagggaagggaatttttgatggcatgtagagcaatggcctcctattgtcatgctgaacttgtcccactgtaaacaactcatctgggcatcaccacaatgaattagaattgctagcatccaatgtcaaagctggtgttaatctgtcatattttaccccatggatgtaacaacagaatcaacgagtgggtaaaatcaacttgcaacctctggtgaatggtgttcaatgaatcctcatttccttacttaacttgtcaaacttttccgatatgatgtcagccttgtcaacaatcctctgttcatgaacagaaaatcagctactatgaaattgccaaatgctgatcagttctgacatgctatgaaattgtcgtttattcttccaatgccgacgtcagctgtcgtcgccggccaccgtgctggagccggggatcttggaaagccgcgcccgcttcatcaccttcctcagcctgtccacgtcctgccacctcccggcctcggcgtacatgttggagagcaccacgtagacgccatggttgccgggatccagcttgagcatctcctgcaccgccctctcggcgacgtcgatgtcgccgtggttcttgcaggcgttcagcagggctccccagatcaccgtgtcggcgtcgcaggtcgtcatgccacggatcatctcctcggcttccgtgaggaggccgctccggccgaggaggtcgaccatgcagccgtagtgctggatggtcggcgccaccgcgaagtccttctccatggacgcgaacacgcggcgggcctcgtcgagacgccccgtgcagccgtaggccgacaggacgccgacgagcgtggcaccgttcggcggcacgccgtcccgcctcatccggtggaacgtagcaagggcgacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgactccatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggaga

SEQ ID NO: 11179 - DNA, 1501 bp, Oryza sativa
tagtataaatagatatgaacccttttatcaaatgagatcaatggttcagatttctttctataccagtagagagcactgtagtggggctctagtaacaactaacctgtctgcccataacattagttctgtgcatacaccgtacatccatctttttggcatccaatggacaattcttaggagttgatcatatgccatttgattttaatgagacccttgaagatggaaatctagtaccaaatgcacgagcagactttgaagttgtatctccggtcgaatgcgtacttcagagaatgtggatatataaccactatgaaagtaaggtgaaagcagctcttgcattataaattctaaaggatgtttttgtttgctacttgtgtctattcaacatcagaaagaacattaaggagacgtacacatactatgccgttaattagccgttaatatatttctttgcctgaacttttgattgagttggagcaaaacattatccaaacaattaagcattgaggtatctccaaaacacatctgatgattggcccatatatacacaggtggaagtaggtgctacattcatctgcaacgacagttaattaatgaggaattttatagtacaatatactgatattaatactatcagtataaacaagcgtaccttagaaatttgctagaaaattagaaagggcaaatggcaacacagcgtgcgcaaggcggtggtgcacggacttgtgtggtgggtagtgacgacatgctatgatgaatgatgagtggacgatattgaggaaagatgaaagggatcgatggaggaaaagacctagcattgccgctctcaacagccatcagtgttgaaacagtcctacagtgaagcactcgtccttcatcatgattttccctggtgatggcgagtactccttccatccaaaaaagaaccaattcctggctatgaatatggatatgtgcatatgtccatattcatagccaggaattggttcttattgggacggagggagtacgctgcgctgagcatggcagcttgccgaggagacattcacacggtggggatgataagatgtcatgcacgcatattggctccatcacgagtagagcagttagatggacctcactgtctttcatgtccctctttgtgcaaaaacagcacaccggcaatgtgtggcagactaccgcgtcttcttgtggtgccgcctctgatggcaccatcctctgccatatcttcttactatcactgtcaagccggccatatgttcttcaacctcccgttgatggttcactatggtaggattagggctagtgttctgtcacaccctaaaaatcccaaatatataaattgttgtctaaattagaattattagaatttattttaaaagcctagaagagaagatctaattttaaataataaattacaatataaaatagggccagataaaatttcattaaatactttgcttaattctataattcctagatttttctgggatttatttga

SEQ ID NO: 11180 - DNA, 1501 bp, Oryza sativa
tatagttcatcctcatttaaattttagagcttaaaaaatccaagcattttaaatcatcattacacataattctcaaaatatttcaatatatctcaccatcattttatataatatctatatacctatacaatttattcccatttagttaattttatttctcttctctctcattaagccatatcacctcaattatttctaacccttaaatgattaatctatgggtggaattatctccctcattttcttctctcataaagccacatcatattacttttaaatttggctcatcattctatatactatttaaattatgataaatcacatgaacttatgtaagtttctatcatctagctatcttacacattatttatatttattattatcataccaaactcccgcagcaacgtgcggggtttcacctagttatatacaacagagatggctctttggagtttatcatctactatttgattttgaacatacactcaaagatggaaatttggcaccaaattaatttttcaaataactgttcagagtagctacctagtagtaatcaccaaaaatgcatggtaagaccttgaagttctctcattttcaaatgcagacttcagaaattaccgatgactagtaaggtgaaagcaactcttgcattataaattctgaattatgttttgcttcctacttattacgactaaaaattaagagatttgctccggtccagcaaaaagtatctcgagctaccggtatctcatggtaccaaatcatttccgatcgtcggatctatctgggcaggattggtattgttagatgcaacgatcgaaaacgatttggtaccgtaacgtaccggtaccttgagctactttttgttggaccggagcaaatcttaaaaattaatatcagaaagaacattaatgggtctttaacatactgtgcagacgatgatatatatagttaatgagccatcaacatatatatatatatatatatatatatatatatatatatatatatatctgggtgtacgtactcctgcttgtatcagccgtccatctgtgcacccccgatcgagttatcgaatccacctatgacctatcggacccgttttcatttttgtggagaaaagaataatcctagtaaatctgcaattatcccacagggatcggaactatctcttttaaaactctgttgtttaccaaactaaaccacaaatcgataaatcggatctgagggcgaggtcgcaatctacgggagattctggggcgacggcacaatcaatcggcgactcgacgtcctcggcggcgattcgctgccgtacgtccacaacgtggatccgtcgactaccatccacggtgcagtccatcagcaagccggagtcgacgatgagatcgacgacaactcggtgtcaacggaggcgaagagttcaacgtccacggcgaagctgcgatccgtcgcgacagcccatctgcaagccgaaggcgacggcgccatctccatccgcacg

SEQ ID NO: 11181 - DNA, 1501 bp, Oryza sativa
ggtttcctcagctgatggttgatttcctcttcaacctcctaaaaacgctccctgttcctcaatctttggacccttcttttctgattcttcgtgaaaataccagaaggacaccattgattcttcctgattatctcatcctcttggccataatcttgattcatcggacccaatctctgatgaacaggaagtcttgtctgccttagccgattacctctactatatgaccggctcgagctctcgacgatatcattgcacccagggcagttttcaatgaatggcaacctcatcccttcgttccagcagaatctaaagaactcacaaccccaatgaggatcaaaaccatcgtcgtattcttcataatgcttctcctgctacttgttatacttcctctgatacttgttgataatcctagccgaattcactcgaaaaccctttgcatggaccctatcggctgcttgaccggctatatgcaccatattaacaggaaaaggattacaatcgaccttcatcggttttttggaatcatcaaacctaatctttcccccttcaatggcaacttggatttgctgtctaaaaaccttgcaatcgttagtagaatgagacccagaattatgccatttgcaatatcgcttcttgcctaattcctcagccgatggtattgtatgaccaacaggaagctgaatttgcttttctcggagtagtaaatcaaagatcttgtcagccttggtgatatcaaaatcatacttttccacttttccagaactttttacccattggcatggtaagacctttttgcttctcacctattcggctgcagctatttcagaatcatcttccttgtcatccgatccatacatgtatggacaaacatgattaactttcttagagcttctcctcacttccgccgacctatgctcatgcaaggttaccttctgtatcagatgcaataagctatcaaagtcttcggacgagaatttctccctgattggaggaatcataccatggaatgccaaatcggctaactgagcatcagttaaactcaagctaaagcaattgtttctcatctccctaaacctctgaatatactcgtgcacgggttcatcatgccgctgcttgatcgctgtcaagtcggacaacttcatctcatgaaccccactgtagaaatagatgtgaaattgcttcaccaaatcggcccaactactgatcgacccacatggcaaagaggaaaaccaagtaaaagctgatccagacagagataaccggaataacctaactctcagagcgtctacagccgatgcttcaccacactgagcaaggaatcggctgatgtgctcataagttgacacgccctcttgtctcgaaaacttggagaaatctggaactttaaaccgattggggagagggactatttcaaaccactcaggataaggcttccagtctcttttggtttaagcccaaattgttctctcattacatcggcaatcacatcggcccacggtcg

SEQ ID NO: 11182 - DNA, 1501 bp, Oryza sativa
ttcgtgtatatattaatatatatatatatatatctcccattcaacatgatctactttccatggcagcatcaaattatcaaaccacttaatttgttgtcaattccaagcgctgcttactgtgttcataaccgggtgtaagccggagagatcgccgtgctgatttcgcgatacttaaaccatagccgtctttcctctccctgcttctcaccatcgccatccgcctggagctgccaccgctcactggcatgcacacgcgaacgatgcttaattactatttctttcgtcccaaaatataaatctaatattaaatagaatattaaatagagtagcattttaagatgctgagttcaaatctttataggaacgaatttcagtttgggttatttgatagctaagttccctagctatataataggctaagttcttgatttaaaaatactgcatatatacagttagatgtatatgccggataaaacatacccttctctaaaataaataataaataaaatatgacatcaccaatacaataaatttagacatgggtttatctagattcgtaatattatgtgatcagtacgttaacttacggggttgcagtagtagtctgcaccacagatttcacttgaacatgagaaatatataattcttctcgacataaaatgtttgaggaaataaaaaacaactattgactatagtactggtaatagagattgacaaccttcttttttcttttcctgtaattaaccatcgtcgtctctgggtttttactctactgatttaaatataattgacagagctcctgcttgtttagttcccaaaaaaaaaaaatggcagattactcacatggcaaaagctcgttgccggctgatgaagcgccggcggcgagagaaccgggcagaagcgacggcagcagccagagggacagcactaggattagcacgacgcgagccatgaaagaagcagccatggtgtgtttgcttagctagctcgatcgacggccatatatataatctgaaattaactggtgtctcacggccatgataggctatttatattatcggctcacttattatactatttgttactgttcaggaaaaaaaaaaggtcttcgatatgccgcttgtcagcttgtgaacaaattatgtactattccagtagtatgctggtctatatatacttcagtactatcatattaatgtgatgtaatcaactttgatcaactataagtctactcttttgcttttttggttgctagacacacccagaatttccgtgtcattcctgcagtcaaaggtcaaggggaagactatttcatccacgaaaacatattttgtctttgaccagtaattgagtcacacatctctcgctttttttcccttgctctagcatctaatttttatccattcctcgatctttagttagaaatgaacttgaaaataccactctaagtatgcatttttattgtctcatattccctctattttatgttcccatttcatta

SEQ ID NO: 11183 - DNA, 1501 bp, Oryza sativa
tgtcatgttatttataattaaatacataattcaagatccatttacccatatttactatataaaatttagataatgtagccattatgactacaaatatttgagcaaaatttgcactgtgaaaagacaaatgaattcaaatatgtgagtctaaagtctagattcaaccaccatcaaagagtttggaaccatggtggataccctgggcctgaactcaacggaggcggagctgcaatatattattaggttgtgttcattagataggttttggagctaatctctcccacgcacgtaaaataaagcgactcattacattagattattattaattaagtattagttaatttttttataaaatggattaatatgtttctaaagcaatttttctatagaaaacttttagaaaaaacaccgtttattagtttggaaagcatgtgcaccgaaaacgagagagttaagttgggaaaggaggggggaagaacacaaccttagcgaggtggacaccgacggaagcgccaatatagactttccatgacttcctaagcctaatagcatgctagatgattaggtgaaggacaaaggaccgagaggagggccagagagagacgtttctatcaccgaggtgttcagaattaaattcagaaaaaataagcaatttgattaaaatacacattcaatttttttaaaaaaaaccattaaaactattaaaaaatgtataacaagatcccatgtataatataaaacagtccatataaaagtataagttataaatatctaaaatttggaataataataaaataaatattaaaagatgagtccaaatacaacacgatacgagattaagtacaaattaaaatccttaaaatgaaaatttagaataacacaataatttgatttgaaaacaaattcgaaattataatcactcaatcactacattcaaaatataactaatagttttaaaagaacttatcattattgattcacatgcataacgaattacacatatatatgaatcaattaaaaagaggattgacaaggtggaaaaaaacatttattgccagcaaaagtttatcgagatttcttcaaaaagagatacaatgaacaccctgttaaaaatagaaaacaccttaccttaatttcactttattttgttagaactattttcagaacaaactaatacacatgcccgcgcgaatgcgtgggctatcatcctagttagactaatatatataggtgcgacacatcatattacaatgaatctggacatagagccaatctcatgctagaatgtgatacatcatttatattttatgaggatgtgttacattctaatatgaggttggtgcttattttgggacggatgtatattagaggtattattatcacgtgatgatccctttttttagaaaaaataagttatcacttctatctacctagcatgcctgagagtataagggagtactttggcatataggtgtacacttgatgagctaataattacttc

SEQ ID NO: 11184 - DNA, 1501 bp, Oryza sativa
ctatacccttcacccctatttttttttctgacgataacacccatccacgattttactaccataatataaatagatctctgaaccattcggtcaaataagattaacggtttagattgatttctactaccagtagagagcaccgtatgtagtgaggctcatgcaaattaaagtgcgcatatatatagcacctggaagctgccacgggtcgacgttgtaaacgtcgatatcggtgatgtcgggagtaacgcatggctgcgcagcggtacgcctctgcaagtagtcgacgacaagctgctcgtccgtcggctggaaccgaaaccctggaggcatgcgagaaaatgctagctgcggtgtcatcgccatgaatgaaaatataggatgtgtacagctatggaagatgatgatatagttttatgtgttttgtgatgggaaattgatggatcaattgggtgggtatttataggaggattcttgcagggatttggtgaaaaagctgtgtgcaaagcacagggataagatagcatgacatggcattgccctggaccctatcaccatagagaatcgacaaggtgacatgctctttacatttgtttttgcttaaaagtatatgctttatttctttctttctagctatctgtcctatgtgcgcttctgtctatatatacaggtggtgtacgatgtacaggttgatttgcaaaagttgcaatttgccaacggagtttggagggactcattggacatgtaatgtcctatttggcaatttcagcaatttggacgaaaaaaagttaaaaccaactcttacgcgtgtacgttgagttgagaaaagagatgcaaaaagagatagaaacggatgtcctggtggcaccacgcaatccttgctagggtgtgttgctcccacgcgagacgtaaatatcacatgggggctcctttcatgtttatgcctatccaaagttttttctataaacacagtacaaatgtagacgctcataacacacgcacactcatccgtttatgaatgcacaccctactcatatgaggacatccgaaagactgggtcagtatatcttgagattaacgaagtcaccacgggcgtatcgctgtcgacgggtacatcgcctaccattgaaagaataattagctataaatacgaacactcgtgtcaaatttatgatttgaaagcacatttcatgtacatgcctatccaatgttttggctctaccaagcacattgatacgataagagtaggagatgcatttgatagtgtagcggtaagtggtgtgtagtttcaactccgaggttctatgtttaatccccaacacgctcacaatttcttgaaaaaatatttagagggatgtccgcatctttaaaaaaaagtcagatttttctgattgtcacacaccgtacgtcacccacattctgcaaaaatgattgtgtacacgaccggttgtgatgcagcacggtcagttcgcctattcaacgatctcctccgattatccaaatc

SEQ ID NO: 11185 - DNA, 1501 bp, Oryza sativa
atacacatattattgtattataaacacctctcaaacaaagattgaaaaggagataaacacctctcaaaggtctaattggattcaattcgtcctccagtatatcccgggattggacactgtcatcgacgtcgtcctatttctctgaagctgaaagataaagaccacccagatgaatcacaaattcgtcgaaaccgatgaaccaaattaaatgggaaaattcttcatctaagttcatacagaaaaaggacctgggtcttttcatcacgagctttgaaaagattgtagacctccgagtgatcataacacttggccatcagctggtacagctagctttgggattctaggcgaaaacggaattaaatcacaaactgataaacaaaatgcaaaaatttgaatttcttttatgttgatttggataatcggaggagatcgttgaataggcgaactgaccgtgctgcatcacaaccggtcgtgtacacaatcatttttgcagaatgtgggtgacgtacggtgtgtgacaatcagaaaaatctgacttttttttaaagatgcggacatccctctaaatattttttcaagaaattgtgagcgtgttggggattaaacatagaacctcggagttgaaactacacaccacttaccgctacactatcaaatgcatctcctactcttatcgtatcaatgtgcttggtagagccaaaacattggataggcatgtacatgaaatgtgctttcaaatcataaatttgacacgagtgttcgtatttatagctaattattctttcaatggtaggcgatgtacccgtcgacagcgatacgcccgtggtgacttcgttaatctcaagatatactgacccagtctttcggatgtcctcatatgagtagggtgtgcattcataaacggatgagtgtgcgtgtgttatgagcgtctacatttgtactgtgtttatagaaaaaactttggataggcataaacatgaaaggagcccccatgtgatatttacgtctcgcgtgggagcaacacaccctagcaaggattgcgtggtgccaccaggacatccgtttctatctctttttgcatctcttttctcaactcaacgtacacgcgtaagagttggttttaactttttttcgtccaaattgctgaaattgccaaataggacattacatgtccaatgagtccctccaaactccgttggcaaattgcaacttttgcaaatcaacctgtacatcgtacaccacctgtatatatagacagaagcgcacataggacagatagctagaaagaaagaaataaagcatatacttttaagcaaaaacaaatgtaaagagcatgtcaccttgtcgattctctatggtgatagggtccagggcaatgccatgtcatgctatcttatccctgtgctttgcacacagctttttcaccaaatccctgcaagaatcctcctataaatacccacccaattgatccatcaatttcccatcacaaaacacataaaac

SEQ ID NO: 11186 - DNA, 1501 bp, Oryza sativa
agaaagaaagaaataaagcatatacttttaagcaaaaacaaatgtaaagagcatgtcaccttgtcgattctctatggtgatagggtccagggcaatgccatgtcatgctatcttatccctgtgctttgcacacagctttttcaccaaatccctgcaagaatcctcctataaatacccacccaattgatccatcaatttcccatcacaaaacacataaaactatatcatcatcttccatagctgtacacatcctatattttcattcatggcgatgacaccgcagctagcattttctcgcatgcctccagggtttcggttccagccgacggacgagcagcttgtcgtcgactacttgcagaggcgtaccgctgcgcagccatgcgttactcccgacatcaccgatatcgacgtttacaacgtcgacccgtggcagcttccaggtgctatatatatgcgcactttaatttgcatgagcctcactacatacggtgctctctactggtagtagaaatcaatctaaaccgttaatcttatttgaccgaatggttcagagatctatttatattatggtagtaaaatcgtggatgggtgttatcgtcagaaaaaaaaataggggtgaagggtatagtcgtcatttagcagtggctaaactcttttttctccttttttggctttttcgatgaaatatgagcgatgccagcgcaatagatgatcatagatcaatttagctgagaaaaaacataaatgacaaaataatttctaatcattgtattagtaaattactaatttaccttaataatactgatactagtagtataatactaccagtagagagcaccagagcgtcgatttgcatacgaggcagggcggaggcaggcctaggacaggtagggcttaagccctaggcttgttgcctccaaaatcatggttaaactctcttaaatcatcatttaaatttgggaaaagaaatgaataactaattaataacaccctacctttgtcctactcttagagtccgtcactgcatacgccgaagttctattgatagagcagaaaaaaattacaaaattataaccctgaaatgtcgaaaccaggaaaaaggaaaaaatatatattgattgtgaccctgatagatgcgatactaatgcaacatatattgactgtgtttgtagccatggcgatgtatggatcggatcatgaccggtacttcttcacgatggcggcccgagaggcgcaggccagacgaacgacaccgtcgggtttctggaagcccaccggcacaaagaagacgatcttcgtcgtcgccggtgggcatgaggtgcccaccgccgtcaagaggaggttcgtcttctacctcggccaccaccaaccatcgggcagcaacaacaacaacaaaacatcatggatcatgcatgagtaccgtctcatgaactctccaagagcggcagtgccgtcgtcttcttcggtgaatcgtcttcccactgatgatctcacgaaagag

SEQ ID NO: 11187 - DNA, 1501 bp, Oryza sativa
ctcttaacaattatgatgaaatcccttctttcaataaagttaaggccaaaagctcaaacctcgtgcttccacgtcatcatcaaattgtgaaccgttggatgaatgcattagatcgcttttcaaacgttggatagaatgcagcatagagcccaatccattagtcaccgggtgagtctcttcgcctccttagtgccaaatgtagcccatataaacacaatggcccatctccacacacatctatatgtatccagcccatcaatccgtataaaagagctttatggctgaacaccccttcagttgacatgtgctacctaaattatctacaaaattttggatagggctactaaaaagaatttctccaagaaagctatttgtttttctgtttctccttgagattatacctcctatctaataaattaatgttaaccaaatcccgcagcaacacgcggggcatcctctagtttggtaaggcttaaaaccaaacatatctaacactatcaaaatttaatactaacacaaaatatgtcaaaattttggtagtgttaaaagtggttatgaagtgaacgctctgtttctgttgatgtacatgatggttggaactatgacgaagattgagactatgcccattgaaaatgcaaagatagaagcttcaaactagaagataaaaacaggggctttccaatcttcaaatcattttgattggttgaatttgtgccaaggagtagaggaggagcgaagttatagtgaatgtagtaacaatttatgatttaagctctttgtcaacaataacgactctgccagagtttgttcagtcaattcaattgaatttacaccgaacaaatataactgtactagcatgactttcaaacaagaagacattattttaaaaaaacgaaccatcagaactaatttatttttaagataatggataaaaattcgccaacgaaaaaccaaattagctccaaaaattatctacaagagttacccacggtcgccggctcgccgccgagcagtgcagtccgcccgacgccatgatttccatcctgtccacgtcgagaagctccaccgtgtttgcgcgttgcctcgcctcgccggcggcagcggcggcggcggcggcggtgatggccgctggataaagcgggcccaaaaaggatcgcggtgtacggtgcggcttgggccggaacgggattgcagcctacgtgagtcctataagtgttgggccggaacggcgttgcgtttattaataagtctatttagcccctctcaactcttgccccgattcagtcagtgggtatgagttgagggacaaataatagacttatttcttatccatgcggcccatacatttgggccgggacgggattattgccgcctccgtgaggcccgtgggccctggtgatttgacaggtgggctgggctacaacgagcctgcgctgcaggccgcctcggcgtcttcttctccggctctctccgccgccgtctcgtctccggcgcgcatacg

SEQ ID NO: 11188 - DNA, 1501 bp, Oryza sativa
aggcacaaaggaaaaaaaaagcggggggaaagatatatatcagttttgtcttctgatcagattacatacctcgtaacaccagcagcgtgcaacatttcttatggtatatccaccaccaccaagaagaagcaacggaacattgaaagacctcatgaacttaacacattcagcatgacctttccctgagagattgaaacagcccaacctatcaccggacaacgaatcagcgccgcactgaagcacgactgcaccaggacgatacatctccatgactttgctgatgatcggcttgaagatggactggtagctgtcatcatcaattccatcatccagcgggacattcaggcagtaatacttcccttctgaatacccaatgtcgcggatatcccctgttcccgggaaataatccccaaacttgtgaaatgagactgtcataaccctgtttgttgtgtagaatgcctcctcaactccatctccatgatggatatcaatatcaatatacagaactcgctgtaaatatgaagacagcatattagtggtttagcacaagaagacaactagaccaaataggggaaaaaaacatctgatctgttttcaaactttcaactgttcatgataatctaggattgtctttacgcaacatccattcttcagatctgtgtaatcagtcacctcttgttctgaatacgtttcaatcaaatcaatctcttatcatgaatcgtccaatgaaaattctgtatgttgtactccctccgtcccataatgtaagcgattttgagatttttcttgcaacgtttgaccactcgccttattcaaaaatttttgaaattattatttattttatttgtgacttactttattatcttaagtacaacttttcgttttttatatttgcaaaaaaaaaaatttgaataagacgagtggtcaaacattgcaaacaaaaactcaaaattccttatatcggagggagtatatagctttaacagtatacatcatgggcaaatttaataacaaacacagcaagttcgtcgtcatatcattctctctctttggaacatcattatatcaactagaaatacatatacacattcagaatgattcatcaacgtacatgagcttttatccaggaaaacaaaaatctgaataaaattgttaatacataattctgcacgtgccaatatgccatactattcagacaatgtgtaatcgcgtaacgaatagtatagtatgagatttaagttgagcaaaaagttaatccaatttctgtctacagatagccatttcatttacatttacagatgattaatatttcctaccgatccaaaatttagcggaagatcgatcgaactgtacacaacaaaatcagagcaactggagagaaagaagtcaagatgatttttgcttccgtcttcattgacccacccaacttacacatcaagtaatctatctattcgaaaaattaaacaaaccacccatccaaatagtactactcctaatctat

SEQ ID NO: 11189 - DNA, 1501 bp, Oryza sativa
aacaacccaacctagctccggtggagaagtattataatctttgcattaaatgcatgtcttgtctcttgacttgggaagccaagcgcacgtcgtcttgatgatggggcctgtcaaatcttgccgcctgacacggggggtgcccctgtcagtcaccatttaatgggtgaagacttctgggctcctattacaccaggaaacgggagccttgctttgaccagagcaggaggaccgactccgactggaataagaggatgagaacctctcaccattattatttgatgggatatgtcgggctgcacgtcgcctgacacacgcgatggtgcgcctgacattctggatcccatcagtcattcgaccggtcacagacctgttgagtgcactgcacaccgcattaaatgcgtgcgtggcgcgaccgctcgggtcaccattaatgcgggtaggtgggcacctggaggcggacacctaacccaccgtacgtggtgacctaaagagggggtcgggggagcccgacccctagtcacgggagggggcggtcgccgcccgacctcgggcccgatcccccctcggggaaggatcacgtggtgcctggggcagccttctccctctagtctcggccaaggagtggccgccgccctacctcgggcccgatccccctcgggggagagccacatggcattggagggcagcctcctccgactagtctatgtaggagtggccaccaccccacctcgggcctgactccccttgggggagggccacgtggcattggggggcagcctcctccgactagtctatgtaggagtggccgccaccccacctcgggcctgactcccctcgggggagggccacgtggcattggggggcagcctcctccctctaaacatgatacccccgggcccatatcactgacaaagtctattttgcttctcttgagttgtgtcttatatagctgaaataagcctattttacctatctcatctctttggaccgtgtctaatggctggaataagcctattttcgctcccttcttctgattgttgggccgtgctgtaccgaggaagagactgataatctaattcacaagaccgtacaaccttcttcatttcacctactagcattccttttttcaaaagggatagtttcgtttctctgtatgaaccttattttttaaaagggatagtttctgttgagttgtgatccaaattcatttgcacttaataaaggccagcttctgccgtagcggaacgatatggatcgtcatcccttttagggttccaccatatatatacctcttgtaagccgccatgcggcgatgtaacctcacctcagatatagtgaagatattttgctggctggcgcccgtggtttttttctctcctgttttgggagggttttccacgttaaatctcgtgtcttctgtgattgatctattgttctttatcgtttgttcgcttatcgtttcctaacaagtggtattagagcttgttcccacattagggtt

SEQ ID NO: 11190 - DNA, 1501 bp, Oryza sativa
caacatctccattctgcacagacttgtaagaactaaaccaatctctgttaatgcagatatgaaacgaacatgcagtatcaagtatccattcatcatgactagcaacacaaccagcaaaaacaacaagacaatctcctgaatcagagttttcagcactagtaacaacagaggccttaccatcagatttccttttctccttattctgcagcttccaacattcttcaatgaagtgatttttctttttgcaatacttacagaactttttacctctggatttagaacggcctctactctgactcttgtcacgatcattgctgacgttgtaggttttctgctcagatctgcctctgacctgcaatgcttcgcccttagaggacgacgcatcagactaaaccatacctttcatcttctccctgttttggagcgcctcataaacttccgctagggttagttcatcacggcttaaaagtatggtgtcacgaaaatttgcatatgaactaggcagtgagcataacagtaaaagacctaaatcttcatcatcaaactgtacctccatcgacactaggtcggcaacgatctccttgaagaccacagaaccactctcctgcaacttgtgcgagaacaacttcatcttgatatgcatcttactggttagatctttagacatgtagatcgattccagtttgagccaaagttctgcaacagtcttttcctgcaacacttcttacaaaatatcattagatatatgaagttggatcagcgacagagccttacgatctttccgcttctcctcagcggtccattcagtcgatttcttcttcccgaagctttccagcgcctcatcaagatccgaagtttgcgccagaacagcctgcatcttgacttgccacagcgagaatctcgtcttgtagtctagcagcggtagatcatacttcatcgacgccatcgcgaaaccctaatgtgggaacaagctctaataccacttgttaggaaacgataagcgaacaaacgataaagaacaatagatcaatcacagaagacacgagatttaacgtggaaaaccctcccaaaacaggagagaaaaaaaccacgggcgccagccagcaaaatatcttcactatatctgaggtgaggttacatcgccgcatggcggcttacaagaggtatatatatggtggaaccctaaaagggatgacgatccatatcgttccgctacggcagaagctggcctttattaagtgcaaatgaatttggatcacaactcaacagaaactatcccttttaaaaaataaggttcatacagagaaacgaaactatcccttttgaaaaaaggaatgctagtaggtgaaatgaagaaggttgtacggtcttgtgaattagattatcagtctcttcctcggtacagcacggcccaacaatcagaagaagggagcgaaaataggcttattccagccattagacacggtccaaagagatgagataggtaaaataggcttatttc

SEQ ID NO: 11191 - DNA, 1501 bp, Oryza sativa
gaacacaatgatactaggtttcattccagcactcaacattctcctgaatgtggtaagcgcaaactcccatttcccttcttttgtacatgatgcaatgatggccttcagtatatcttcacttggatcaataccacttttgaacatttcctgataagcatcaactgctaactcagactgcccacactggacaaatgtgctaactaacaaatcataagtcatcaaggttccactcaaagaattctcccctagccttctccaaagtctctccacctgcctccagtcttttgctcttccgcacacagatatcaccgtgttgtaaacgatcacatcgacattcttcttatcgctctcttcaatttcatcaaacattttcagggctgcaaagtagccctcagtagtggcaacagccttgagtatcaaggtgtacgaatgcccggttgccattcctttccccttcatgaactcgaataccttcatcgcatcggcgaaagaaccccttcgcacaaaacaagccagaagggagttacaggcatgcgcgctcggctgcaagcctgaggcacgcattgaatcgaacagctcggtggcactcctgaccttgttggactggctgagcttgatcaacctcctggacagcatctcctcatccctctcctccaagaagtgcagcctcgatcccccgacctcagatttgctccccgcggctgacgccgacgccgacgccgcgcttcttgctgcggcgacggggccttcctccacagcagccggcctcaccgggcgccgccgcagcccgtgcctccggtgaccatcagcgaccggcggctcatcgtccatgccccaaaccgccacaccgacctcctccttgccggcgacgtcgggttcaagaacgcatggagccgccgccctgcacacgcgcacgcgccctctggcgaagacaaccacggtccttgcagcttccgcatggcgggtggtggcgtctctgcccgctcctccgctccatggatggattcttgccccatcaccgccccttcttccacgcgggtgtgggggaagttcttggctgaagctcgtgctgcagccgctccacactgcagccatatatgcccgccccgcaaatgcaaacgaaacctgcaaaaatctctcaacaagacaaagggattctggaaatcacgctggaagagggattcggctggctcatgaggggaaaatcggcaggaaatctggtgagaaatttggtccctcgctagaacggataggagggtggagaagaggaagagggagaagagaagaggagaagagagagcagcaatggtgggagcagagcagcggatgaggggattagaagatggagggctcgttaaatgggccgaagtttcctttcatttaagatgggcctaattcttcgtcctgacggcccgtgagatcaagctcttgattattttcttggcccactaatgctttcttatttattttagaaaaatgttctttttaactttttttagta

SEQ ID NO: 11192 - DNA, 1501 bp, Oryza sativa
ccgcacctccgcggcggcccaccgctcgccgtcgagccgcctcgtgaccccggccgacgcattgggcaggagcccgttgggcaccatccccatagcaaaaaaacaaaacaacccgccgcggccacgccaaccaatgcttcgctcgccgggccgggaacccaaaaaccctacaccccgggaacggcggcggcggcggacctcacggcacggcccccgcacccgccgtcggctccgcgcggatcgaacccccacccccggaaccggtggaaatcgcgtgggggggcaacctcccgccgatgagcttcggatcggccttgccctcccccgcgccacccgaagcgtcctgctctgcggcggcggcggcggcggcggcggtgaggggagagagatggggatggggagtggtcggcgtggaggagaggagaggagaggaggggaggggacgggagggttgaggtgtgcaaagcgaaatgggcggtgcggtgcggtgcgggtcggtgtttggttcggttttggtttgggttggtttggaccgggaccgcgaccgcgagagagagtgcagcgcagtgcgaagaggaggaggtcgatgcctcgatcccacggtggccgcggcgtctgaaacacttcagacgtggcgtgctggagcggccgcggtgtgggggaatggggatgcgatgcaggcgtgctcgaccagccaccgagatatgcggtcgcgggcttttgcagcgcgtgtgatttggagcatttggattttctcagaaattgcgatcgcatacaactcgaattggtcgtagcttggttagtttcggtatgctaacgcagtggtaaattctttgagaggggtgtgtagtttactaatactactactttagtgagaattttcttcctaccttggtttacggttgatgacactttgggatgtttctacggtcattctaagtggtttgatgcggattttcatttcatcttgcaaagactgggtgtgttcggcacccacttttttaaacctctctccctcgttttttatgtgcatgctttttaaactgttaaacggtgtgtttttttgcaaaaaaaaatctataagaaagttgcttaaaaaatcaaattaatctatttttttaaaaaaatagctaatacttaattaatcatgcactaatgaaccgctccgttttctgtgagtattgttccaagttaccaactaggaatagcgaacacaccctaaacctcggtttagctatgaggagctcacttttgaagttgattgcttttgatgtaagaggagaaaatgttaaagtgcacccttactaaaatttcttgttatcaacaatatttatgtgtttcccacaagtttatcgaatatggtttaaaagctgaaaaattgtgtgcctccttttaagccagtattacttttagaattgagaaagacgtaatagctcttgtaaattttatgtgggttctgctacccaaaatccgtgtacttagatctactactaactcatgc

SEQ ID NO: 11193 - DNA, 1501 bp, Oryza sativa
acagatttatagcaaaatcataatgctttgttttaagaaaaaaaacacacaccatttacaaggccaaatctataaggcttcgttggaatgcaagagttgaaaacttttcacccgtccacgtaaaacgaaatgattaattactacatcattaattaagtattaattaaaaatatttttaaaatatttaaaaatttaaaaccttgaacggactactatcacggattatctggtccacatctataaaatataaaatatagtactttctcaacaaactttcttccaccacattgattagactctattctaagctatttttattaattttgttttgtaaaatatttaatatatcattataatcaaatggataatatatgacaataacctatcaataatctgtttcaaaagagaaaagagtaaaaaaaatatcccaaaggcaaaatattttttttatttttaattttttaattttatgaatagacctttttccaaaagtattttaaaatctgaaccttctggtgtggcaagaggctgtcaccggcatgccagccacgtgtggtgtgacaaaattatttggctagccagacgggctggagtggccaaaaggggcatttttcggaaatactttttggaaagatctattaataaattaaaaactatttttttaaaaaaaaatcaaggcaaagccccagaggcaagacccagtcatctcgctgttagtggctcacaagagaacaagtcggcacccatccttcgatcttttcccatcagcagcctgactactcccagtctccaacccactaaccccatccttctctctacgctgggcgaggccaccactgagcggagcaggaggaaaaccagcaggcgagttagagttatcgccatgcttggcctccgcggcctcgtcgccgcgtcacctgtcaccgcgccgcggtgtagggggcggtgcagtgccgcgaccgcggcgacgtcggcgccggagaagacggctggccacgtcggccggcttccactggccatcgtcccagcggccgccgcctcgctctcacttgtcctctggtccagtccaggtacacaccggcacacaggcacagctgaagtgactagtaacagcttgcaagcaagcggtgatagtgttagtgtatacgctactccctccgtttcccatttcgtattgtcgctttgactaggcaaattattttaagtttgattaattttaataaaaaaaactaataacatttctaacacaaaataagtatattatcgtaatatattcaatgttacatttaatgaaactaatttggtgttatagatattgctatttttgtctaaaaatttagtcaaaacgacttataatatagaacatatagaacagagggagtggtagatagttggatcatgaactgaagatgcatggaacaatggatgaacacacaagacacaattggcaccgcacagccatgctgattgttctttctttctgcagtacatgctggcatca

SEQ ID NO: 11194 - DNA, 1501 bp, Oryza sativa
gttttttttggttgtttcgctgtttcagacgcaaattccaccaccttcatcatcagactttgttgacacatacccttgatgaagatcgaaacgggtataggtaaccctcagcgttctcgatgtaacgactgaagaatttctccttcatgcatctagccataagtcaatgggaagctgaggaggtcagctgtttaaccagcagggagcagcgcagcgcttgacaactttgctgaactcatggtggtaagccaacatacagctgctgccaccacctcagcgctagacagtacatctccagggaagatggcagaagcaccaactgtgattgctgatcctatcacacctctatttctcaaatcaattagattcaggttgtctgaaaagctttggaattagtaccaacagatcacacagcataaaagaggcacctgcagctgcaaataaggtaagatggacattgcagagatattcaaccatagtggaaggagatgacatttgtgcttgtaaaggtaacactagagttgaccatttattcatgttcttcttgagtggtgctttttctctttatcatggaattgggagaaggaagaaggcataataattagatcatggaagttcaagaacaaggcctgcagttgggaaccagctggtatccagtctgcattttcttttctgttttttgaatcttatcctttaaagctttgttgtattctaagaatagtaccaccgtttcattcaagtcactctaaaaccacctattttctgccctggactaacccaccagctgaggatgtgtttcaacaatcatcttcgaatttattttgttaacaatatgtgatttataaacagccgaaataacagagttcaaacagaatttataatgtttttgctaaataatccattgtctactttaaatagtttatcactagattcgagttaaagattaaatacttcttctagttagacaactatttatcactaagtatttgaacaatatactgaatcgtttaggcataaaaccatttagcattgagacatcaatattcagtgaccagcctaaaaacaaaggagtgaacaaaggagttgatgactgtctctagaagataagagcttataggtaggataggaatagtccatgaatcatatgaacataacttgcataacaacaataattcagcctatcgatcaaaaagggatttttgtaaagatgaaaccattgtcaatcaagtgaaaacacttctggaagagggaaaaaagagcattttcttctattgagcccagcaaaccttaatagcaacccaaatttagttaactgatagtccagtatggtaagatagattaccctcatactccacaacacggctaatttgttattccctgaaaacataacttagtaatatgtcaactatgaactatgaaccaataaggaaataactctgaaaaatgcatctgcatagcattataatacttaattatagtcaggaatggcacacacaacatg

SEQ ID NO: 11195 - DNA, 1501 bp, Oryza sativa
gaccttctcttcggatgtggatgttggttaggtccgtcgggctaccttcattgatgctagtaatagtaagaagtgtcacatcacttgccttgtcttctacaacttttgtggaaagctatcatgccgtatttcttgtatctaatgatcttttttgagatccacttcattcccttctcataactacagcttctatgcttctatattgcccgtcacatctgtctcctagatctatcggcaccaaaattgtatcattatttcgttattccaagatcaaagccccaatcaaagggttcattgggatttgccaatgatgctaagaaggatggggtatggtgaggatcttcaatcgaaagcaccggttagatatctgaattactattctccagaacaaaattataacaaatatgttgatcgtttagtatattcctgttgtattgtgtttacagatatgttctttgtttatatatttgcatgagttagtagtagatctaagtacacggattttgggtagcagaacccacataaaatttacaagagctattacgtctttctcaattctaaaagtaatactggcttaaaaggaggcacacaatttttcagcttttaaaccatattcgataaacttgtgggaaacacataaatattgttgataacaagaaattttagtaagggtgcactttaacattttctcctcttacatcaaaagcaatcaacttcaaaagtgagctcctcatagctaaaccgaggtttagggtgtgttcgctattcctagttggtaacttggaacaatactcacagaaaacggagcggttcattagtgcatgattaattaagtattagctatttttttaaaaaaatagattaatttgattttttaagcaactttcttatagatttttttttgcaaaaaaacacaccgtttaacagtttaaaaagcatgcacataaaaaacgagggagagaggtttaaaaaagtgggtgccgaacacacccagtctttgcaagatgaaatgaaaatccgcatcaaaccacttagaatgaccgtagaaacatcccaaagtgtcatcaaccgtaaaccaaggtaggaagaaaattctcactaaagtagtagtattagtaaactacacacccctctcaaagaatttaccactgcgttagcataccgaaactaaccaagctacgaccaattcgagttgtatgcgatcgcaatttctgagaaaatccaaatgctccaaatcacacgcgctgcaaaagcccgcgaccgcatatctcggtggctggtcgagcacgcctgcatcgcatccccattcccccacaccgcggccgctccagcacgccacgtctgaagtgtttcagacgccgcggccaccgtgggatcgaggcatcgacctcctcctcttcgcactgcgctgcactctctctcgcggtcgcggtcccggtccaaaccaacccaaaccaaaaccgaaccaaacaccgacccgcaccgcaccgcaccgcccatt

SEQ ID NO: 11196 - DNA, 1501 bp, Oryza sativa
acttgctttatgctaaaacgaaccatattatgccttccttgataatattccttacaagtagagtgttaggcttgtcttggtgcttgccagtatattatttcaaataatgtactgactcttgccgttgaattaaccttttgcttgcaggttttaaacttagtctttgagtgatgcaggttttgactgcttcttctaggatttgaacttaatggggtaaacccctagtcggtgtgcttgtggattgggtaaacaagcttccgctgttctattatttatttggccggtcagccagtgtaactaaagtagatgtagtctataatagctttcatcttatttgtgtttgctacgtataatcatgcttaagatgaatgtgtgactctagtgcacatccgcacatcctggaaactagcttcacatgagtatgagttaagaatatttgagatgttgtagatctttagccatttttgtcaagtctcctgaatgtgtaacacatctggtcgccgccttcgagtggtttgatgggcacatctcaggctgaagttgactggcaggctaaagtgtcacatcctgattttcgtttcaggatttataaattatttaataaattaataatagaatttatattaaatgttcattaatttacatgtgaagttaaatgtgggaaataaaatttcctaaatataaagcatggatggatttaattttttattaaattctccatgattaagtcaactctctggaattttctcagattttttcggagctcaattcctaatttttaatcatacaaagagcatttcagtaattaaccacatattaaattaatcattaaatggtctaattgtaattttgttaagtactttgagtgtccaagtattttcaggatttttcttgaaattatttgagcattagaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcgaactcgttttcgagtttatctccaaaaccgagtttttgattttcccggatcgatttcttgcgggaggagtccgatctcttcaaggctataaataggaccccctagtcctcctctttcgtttgccccctctcccgtggtctcccgtgcctcgtagcgccgccgccacgtgctccaccccgccgtcgtcgccggccgagctccatccg

SEQ ID NO: 11197 - DNA, 1501 bp, Oryza sativa
ttgtgttgcgccttagcgatcgatacacctctccgttggttgttgatcttgccggtgcagatcaaccctattcctgcaagcaaatcgaagaaacaagcaagaacaagataaaagcaatctgatattgcaaataggaatttaatacaaatgataaattggggttccgaagaacaagcagacggacggtctagccgacacgcgcgctgcaagcaagtagcaatggctaaactttaatctaacaaaacccgagaaaccttgaaggggtaactagctatatataggggtgggaggacgacctaggggtgcctagggtcgtgctccaccagcttggggcgcaccccacatgggccccacctgggccggggtcccaaatgaagttacaagcccataggcccattataggtgacgcaacacattgttcctgtgattctggccacacgagatggaatttagagaagaggctggatccgttagaaagagggctccgagagctttctatcaagtactcacaggccgaaaacggaggtcgtatgcagattcggtggccgtttgaagtcagcagtgtagtaggtggccgaatcggattccagcacttggagtacttgatctcgatatcttcttgttcatccatgatgtcagcaatgattgcatccgtggtagccatggtcacatcattattacccagggttgacaaaggacagatatcaagtaaacatggcacaagcgagcagataggtaatacccacatcccatgtaattagcaaaacatgcatatttatttgcaaacggtaaaacatttgtaaagtaggatcaaaacgctcaaggggaatgtgtgacttgcgttgcttcttcacttggatcttctgaacacttttcctcgcgaccgcgaacttccgaaacgacggaaactacatgttggcacgcaaaacgaggaaaaactctaataaacaccaaggaaacagtacataaaaagtaaacaaacatgtaaatctcaattttagatgaattttgcaagttgaatggtttgggcgattttatgtggtttgggcgcgagggcgcaggcgggagaggctggaatcgtgggcgacgtggggcggcatatgcgcggcatggcggcttcggctctggaggccgaaggtagaaggaagagctgacaagtggggtcttcgggcccacctgtcggcgaaagggggaggggagtcagggggttatttagactttacgcgaggggaaggtgaaatgggccgacggcttaagagaagagaggggaggccgactgaggaagggggaaggagaggggcgcggcccgcgggaggggaaggattcttgggccgaaaacggcccaaggaggaaggggattttttattttgttttctttttattttaattgataaaatgaactttgtgctattcaaattatttctcgagctccgaaaattcgcaggaaatttcagagagtttttttagggcacaaagaatattacagaatattcccggccaa

SEQ ID NO: 11198 - DNA, 1501 bp, Oryza sativa
aacaagagagaagaagagatactcttcgacattgttgacatcccatacaattataatgccatcttcggccgaggcactttgaccaagttcgaagcaatttatcatcataactacctcaagctcaagatgcttggcctagtcgatgtgatagttgtcaagggttcccagccttcggctaccacggtagcctccttcgacagggaagttcataccctagaagtcgaagggcaagaaagagccaggccaatgctgagacccgccccccacggcaggttgtccgtttgcagatagatgattctgaccccgccaaagtcatatcactcggcgaagaccttcatcacgcccttcggcaccttttgccatctcagaatgtctttcggcctaaggaatgcaggcgctacattcgctaggctggtgtacaaagtcttgggatcgcaattggggcgaaatgttgaagcctatgtcgatgacattgttgtgaaaagacgcaaggcattcgaccatgcgtcagatctgcaagagactttcgacaatcttcacgcagccggcatgaagttaaactggagaagtgtgtgttcggtgttcgcacgggtaagttattggggttccttgtgtctgaaaggggaattgaagctaaccctgaaaaaatcaatgccattcagcaaatgaagccaccatcgagcgtacgacaagtacaaaagctcacggggcgaattgcagcactcagctgattcctatcaaaggcagccgaaagaggattacctttcttcaagacccttcggggggcaaattcaaatggacgcctgagtgccaagcagccttcgaggagctaaagcagtatctgcaaagcccaccagctctggttagcccagcagcaagaagcgaactattgctctgtcacgccctgaaaattgcctaatttagtaattcattctttaatgcatttttagaaactattttaaaagcttacaagttaaactctaataatctaggaaaaatttcaacataaaattgagctagataaaatttcattaaatactttgcttatttatctattttctagatttttctgggaattatttgagcaaggaaagtatttttaataaatgaaacatcatttcacgaattattttaattgagaaagtaaaaaaaaaccctcttctaagccgttgggttgttcccagcccaacccttttccctccccttgcgcagccgtgcggcccaagccgagccgccgcccctccctcctctcagccgccgacatgtggggcccacatgtcgggcctttcttcaacctccggccggccacagccgagaccgagccgcagccgtcccccaccaaatgcgccccaaccggccatcctcgagtccgattggttgaggtgtttttatccctttattgtcctctatcttttcccccaagaatcagagctaatttctttgtattttatccgaatcaaactcgttttcgagtttatctctccaaactaacccttagaga

SEQ ID NO: 11199 - DNA, 1501 bp, Oryza sativa
ctgtgggtgcatggttttgatggtcgcacccatggcaattaaggaccggttcacgggaaaccctgggagacttaccgtgcttaccacaagcgagagtgggtaactgcttgatctgaggtatagctcgaccctttcctaggcaccggtggcgagggtgggcgtgatggagttgggtcggctgtggtgtccggttgtccagctgtcggattcaccgcggtgcaagaggggaccgcccactgccttttgaggggtaggggtgaaacccatggtgtggatggttaggggagggttatgcggagggtcttgtcacggtttccccctttgcagtatcatggtgatacttcggggcatggcgacatgtgtggaatcgtgtcttgggggtacagttgtacacctctggccagagtaaaactattcgaatagccgtgcccgcggttatgggcgatcaaccagattcaccgtgattagtctcacccctagtttaacttaatgaactggtgtagttcaggtggttggttgggcctgttgcaacgtggtgtagcgttggacagtgattggttaatattgcttaattactacaattgttttactgctttcaacttctgcttttaaatgcctgctttatgcaaaagaacatttagcctcctttggatatatcctgcatcatacctcctctttcggtatgacttgctgagtacagtgggtaatactcagtcttgctctcttttcccccaccccagagctgaagatcttcctagtgggagctattttgtcgatgttggtttcatcgctgccgtcaaggattgcctgtggagtggaatcgcccgctgcaggagtcaagcttccaagtctagctcgttttatcttttccgctgcatttgtaatcttttatattttcgtaagacgtggatctatatgtcaacaattgtcgtttgtgtaccctggctggtcctagacaggggtttaatgcacatccagcttagaaattctggttcgagaatttctgggcttgacatgcaatcggttatagggggttatgcgaagggtcctgtcacggcctttttccggtatgtcgtggtggcatgtcagcgcgcggaaacgtgtcgtggggctgtgtcttgtgggtacagttgtacacctctggccagagtaaaactattcgaatagtcgtgctcgcggttatgggcggtcgaccagattcatcgtgattagtcccaccttaataaatcaactcaatgcactgtagttcaggtgggttggttgggcctgttcaatgtggtgtagcgttgatcagtggagatttaatgttactttaattactcaactgttttactgttttgctcaataaaatgctttacaaccgcctttatataaatagccacaagccatccttgtatccccttgcacgtctgcatcattggtgtgttttgctgagtacggtggttgtactcacccttgctattattcccccttttcataagtgtagtgcttctgagctgaa

SEQ ID NO: 11200 - DNA, 1501 bp, Oryza sativa
cctgaacaaccatacccggctgcacagatttatctccaaaccaggaatgtaccattccaaaccaggagctaaattaattaccatcaattaccacattattattaatgagtagtgtgggactaatcacgaaagacattgttcgacccgcccataaccgcgggcacggctattcgaattgttttactctggccagaggtgtaccattgtacccacaagacacaacccaccagcatgttaccgtgcccggccagacacgtcaccatgttgagtgattgtgacaagacccctcgcataacacaacccaaagcagtgcaccgttcctggatcataatcaccctcttaaacaaggcatggactccccagcgacccccgtgggcttatctccgccacttctcagtctggtgctccgcagtgagccttgttatacaaagtgtccagccgttgcccattctggcttgtggttggcacggtaaatgattcacaaccgaaaatcatgaaccggtccttaattgtcatgagcactatcatcaaaaccatgtgctcacaacccaccattatcaagttttagttggcacattaattaatcaaccaatcacgattgaccattgtgagctatcattaagccatcattaaataatagtgaagcattagttatcccaattgtgtgctaatgtttctaagcatggctaagcaattatgtctaacatctagctgaaccaatatataaagctcaactagtcaaattataataacacaaggtatcaaggaatagagtaatcaatgcaaacaggccataacaaaggaataagttcacaccacccggtgacattaaaaaataaatgcacagttgaaacaaatagagaatttaaatataggatcaacatgctcaaaggaattgtgtttaggatctgtgtgacttgccttgtaataacgggtcttcaattaatcttcttgaacacttccggcgcactcgcgaaccttcgaaacgacggaaacgacaagctaacacgcaaaacgaggaaaaagactaataaaaactaaataaacaatacatataaagtaaacaaacatgagacttgaacagcctcattctgacttcatatgaatttattacgaattttacaagattaaatctaattacagcctatttaaaaaggattaaataaatttaattcaatttatggataattttaatatgtagatctttattttattcaacttttgcaactggaaccacattaaaccgagttacaatgaattagttatgaatttttaaatattaaaccggattaaagcatttatatggattttaattgaattatgacgcaataaagaattatttttgaaaaggaaaagaggattattgcgtcagcgggttcgggtgcacggtggaccgggcgcacggctgcggctcacggaacgaacggccgagatctatcctatccacaacggacggccaggatccatcggcccacgaccggtgcacgagacacggcgacga

SEQ ID NO: 11201 - DNA, 1501 bp, Oryza sativa
gctccatgcaattgtaagagaggcacagcgctgcggagtccggcagcggcagcggcggcaccgggaagcccgtcaggaagttgtgctgcgcgtagaaggtcgtcatgcggccggcgaacacgctacgggccaccgcctccggcacctcgccgtacatccggttgttgttcacgtacaggctctccacggccgctagctcctccgggacctcccccgtgatgccattgtggctgacgtccacaaccgaccacggcggcgttgcggcacgctccgatgcgaacgctggcacggcgagggacccggtgaagttattgcgggacagaagaagggacgacgcgctcgggagcgcgaacaactcccgcgggattgaacccgagaagttgttcatcgagaggtcgaggaaggccaagtcggtcggagccgaaccgttgccgaacgcgccgtcgaggctcccctgcattgagttcgccgcgacggagaagtagcggactgtctgcgccagcggtgggagcgagccagtgatggaattccggcttaggtcgacatggaaaagctgtgagctggaaaattggtctggaatctgcccggagaggccgccattgttcgctaggatgagcaccttgaggctctgcgaagacggcagcagcaagccgctgggaatggagccgtcgaggtggttattgccgaggtcgagcgtgtgcagatctggcagcccggcgagggactcgggtatctgcccggtcagctggttgccggacatggacagcagcctgaggcgccggagacccgacccaatgtccgtcggaatagctcccgcgacgcgtcctggataaaggacgaagtccgtgagcgcagtgaggctggcaagcgaggccgggagcgtgccagccaggccgggagagtcggtgaggccggtgccgagcgtcagcacggacacgcggagcgcggccgggtcgtcctcgtcgggctcgcacacgacgccggcatagtcgcacgggtcggtggcgtcatcccaggattcgaagaaccgggaccccggcaggtcccgcagccccgcccggacgtccctgagcgccgccgcgtcgcgctcgtgcagcgtcgtcgccgccgccacccatgcggcgaccgagctgagcagcacggcgacgatgaagaagcggagcagaggaggaggcagcgccatgtgcgtcacctcggcctcggcgaagaggacaagctacttcacagagggtggtgttggggggtgggctttaggctacagaggtggagctactagtcgtagcgactggcgagtggcgagtgctagtgtgcgactagtggaagtccggaagagagcggagagacgagacgagcgagtggatctggggcgcctggcggcagcagcagagagttcgagatttaagaatgaatagatggtgggaacgtggggttgggttttttgacagcactgtggatctctgctgtttctttacaacgtcggtcggtaggtgcaccatggact

SEQ ID NO: 11202 - DNA, 1060 bp, Oryza sativa
tgggggggggggggggttgagaatggtgaagagatagaggagagagagaggttgaggggatatagaaatatggtttggggttttggatggggtcccttgagttttaggtaattttgaaaatggacctttgtgcaaaattatttttgaagaaaacctttgtgcaaactttatggttccatcggttggcgtaataatctaaagcaaaagctaaaatttaaattttgaaacttaattttaatgttgattttaagatattttaatgtggtttctttttcaatattaacttttaaatccctaaaaataaatatataaaagtcttatctaattattagggtatatgagcaaccgatgaagacattaatcgggaggagcgattcgtggtattcatcgaaacaattatgtttggatttaaactagagatttagctatgacgatagtggtaaaatgagtaaaatgtgcggttgtttttttacgaagacgaggacttgatactcgagccatttggttgggaaatagaatgataaaggcgtgcattccgttgtgaaacatatggtgctgagtgctcatcttgaatccaacaactaacaaccatcctctaacatatactaatagcgacgaagaaatatcccgttgaaattccgatgaatcaaatgagactaaagtatcccaggtgaagttcctcgtgcattttcaaaacaagttcttacacactgcaataaaaaggtctcgcaaacaataataacacaaagttgctcttgggacttttagagctacggttacattgatttttcagagagagaacctaggtcgagaggctaagagtgtgttagagaaggaggggattgaggatattgataagatacgtaaaacgaagtgagctattagcacatgattaattgagtattaattattttaaactttaaaaatggattaatatgattttttaaagcaattttcctataaaatttttttgcaaaaagaacatagtttaatacttcgggaagcgtgcgcgtggaaaacgaaacaatctttctctctttctcctgcgctcgaacgcagc

SEQ ID NO: 11203 - DNA, 1501 bp, Oryza sativa
gtattaaaattagttattaagctcctaaaattgatggaaaatttcagagaataatttagaccacgtagaatattacaaaaatatttctagccatcatttttataggaaaattttagtttcttcatttaattcacttgactaaattgctttaacttttaatatatttttctataaatgcattatataaatctatgacatttgctttgtgccccttatgacaaattaatattcgtcacgatctcccatcgaaatactttatgacgatttctagttggtattaacgacgaacacctttttttcgtcactaagccaccccatctcatactaatcgtcataaaatggattgtgctaatgacgaatagctctgacgtcatgaggaattcgtcacagaaggtcatatttcttgtagtgtaccatagataagatcattgctaaaatatccctgatgacccaatggttcaatctgtctatcaagtgtggcgactctagtttgaaccctgtcaagctcattcaatgctaaggtgaggtacctatccaatgactggactaagcctgcaagatgaagtggtgtgttaaggttccctgaccgcccttctaaacctggatagtgactggtggttatccccggcatatggtgctgaaaatacacgatagcttggtaagcaacttcaagcatagctgagggtgcatcccagacgtaaccacggaaatgagggctgtttcatttgcccatctcccttggatatacaactctgatctgaaaattctaagtgaagagcttcgctcggcagaaaagcagtggtactccggttgatggttatagccgaggatttgtaacatgagccatagtgtatggggcaaggttccttcttcgaaccccccggagtagcccaatggctgccaaatgaacgacatctacaagattatcaagattatcaacaataagaattaattagcaaccttaagtgaggccccaaagaacaaaatgccgactttgtggaaggtataattttttgtccagcacattgcctaatgttaaggtgtttataatttaacttgtggatataataaaatgtaggaaaagtctactttcagttccccatgaagttttctaagtttggaaatggaattcacaatttttatcagtggagaaccctgggctatacattatatttgctaattgaaatgaacacatcaaatcaagtagcaatcataaataaagccgcacagtaggagcctctcctgctgttttaaccgtaaaaaaatcatatataaagcccgaagccttgagtagataacataggagatattgtgtcatgcccagaaattcccgaatagaagtccaagcagaatgtgcattaaaaccccagtccaggactggccagggtacataaacgacaatgttgacatacatatccacgtcttacaaacatattaaagtcttacataaatacaacggaaattaaaggataaacctaaactaggtcttgacttggatagc

SEQ ID NO: 11204 - DNA, 1501 bp, Oryza sativa
atgttccatccagtctgagaaatcttatcttttttgggatgacttgtggaataaggaactgcatagctccaaatttcctgctctgcatgctctagctttatataaggaggaatcaattagctgaatgtgatctaggactttggaggattgtttcatgatgcctctttctacccaggtttatggggattttttgcaactttaggacttcttgaatcctctgaatttgaatgatgcacagggtgacaattggtgttttatttggaattcagagatatatacctccaagcggttctataagcttaacttcatgtctttgagcccttctaggccttttgtttggttatggaagaccaagtgtgttatgaaagtcaatgattttgcatggcttttattttgtgacaggctgaacatacgagatatgcttgatagaaggcattctgcaaaggaggatgatgatctcacctgccccttatgtcctgaaggacggagggaaactcggctacatctcatttttacattccctttcagtatgtgatgttggcaatctttgggaattgtttggaatcataatttggagttctttcacctcgtaattcttgcaaaatggaggttcagtagaaatgacagaaagagcttcttggaaattttctttttagcatcatggcacatatggaagcagaaaaatgggctcattttttataatattattccatcatttcaatcttggaaggccttgttcgccaaagaaattcttctacatctatgtagaatgaaggatcctttaaagcaattaatctgttttttattggttacaaactttgtagcttggcaaaatttgctgcagcacacgcaaaaatcatgtaattggctaagagacaccgtaaaaacatgacactgccaatgaacactacaaaagttatgtagttagctataggacaccggaggcattattttataatttccgggctaaaaaaagggagagaaatttcgaaatgacgggaatgcccccctctactccttcttcctttcttctcactgcagccaacatgtgggcttgcagagagtgttgtcgtcctcctgtcgccaacgctcaacgccagctgccgtccccgacctcgacgccaccgttgcctccacttgctgccacacccacgctcagaccacctccctccacctcatctcctccctcctcgccccgcccacagctcccctcctccgcgagctgccatcgcctccacttgctgccgcgcccacgcccagaccacctccctccacctcatctcctccctcctcgccccgcccacatctcccctcctccgtgacgccctcgctcgcgcccgcacttaccccgccgaattccgcaacggggacatcaatctcaccatcctccgcccatgccgctcctcggccgcctccccacgcgcacccgcccaccgcctctcttcctctggtgcttgctcgtcatccagaacatgagccgctacatgcgcggtgtgtccac

SEQ ID NO: 11205 - DNA, 1501 bp, Oryza sativa
gaaaaacttccaagacaaccaataagttttttttaggtgtcaattcgcaagttgtccctccacagaaaactttgtcgacaaacaaaccagtcatcccagcgtccccgagctttaagaatatggctgagaagacctcccgtgagttcgccgctccctctgctaacaatgtgcccattgggccacacatcgacttgggagacggttacttcgacttgaagaccagcctcattagaatggcgcaggctagccccttctgtggcaagccaaatgaggatgctagtgctcatctgcaatagttccttgagatttgtagcacatacacgatgaaaggcatcagcccaaatgccatcaggctctgactgtttccgttttccctccttgggaaggcgaaacaatggttttacgctaaccatgcaatggtggacacatggaacaaatgctctatggcgttcctctcgaagttcttcctgatgggcaagaccaatgcctttcgcggaagaatctcaagcttccagtagacaagggatgagtccattcttgaagcatgggaaaggctgcaggattacgtcgccacctgtcgtcatcacgggaaggacgactggctgatcctacaaagcttttacaacgggttaacatcttcgtactgggaccacctagcggttgctactggaggagctttcttctctaagacggttagatgtgccgtcgatttaatagagaaaatggtctcaaacataggctggagcgagaacgactctagactcgttaatgtggcatgcataccaacaaggagacggaaatactggccgcaaaactggacctcctaatgaagcgcttggacgaccaggaaaagaacaagccccaaggcaccatcaagaccttagactcacacatcatgtgtgaggtctacgggaacacgggtcattccgggacagactgtccagagactcatgaggaggcaatgttcatgaacaacggatatcgtccacaaggaggtcatgggtgaaaccagccctgcccattctaccaaggaggcagcaacaacaacaataacggtaattttaataattagccttccttgaaggatcttgtctttgctcaagctaaaaccactgatgctttaaacaagaagttagctaccaatgataacatcttggaaaatataaatgtcaagctagatggctttgcttctactttccaaaaccaaccgagttttaataagatgctacaaactcagctggtgcaactagctgctctagttcctacaaatgaatatgggaggattccggggcaacctgaaccctccatagaaaatgctaaagcaatcaccacgaggggaggaaaatccactcgggattcgccatatcctaacactgcatgaactaggaggaatagcgaggaagctgttccaactaacaccgctgggaccgaggaggcaacctagaaggagaaggtagtgccgcaggaataatacgacacaaatctgctgccatttccttag

SEQ ID NO: 11206 - DNA, 1501 bp, Oryza sativa
ccaaacagttccttaacataatatgcatatttctcttggagcattgtagatcttctgtaaatatcttattcatgtcaattatatttagagactccaatagaccatagaagcttatatgtcttctgaaatacaatttttttgtggaatggtagaattgtttttaaaaaataaatatagtaagaaagtttagtgttattatctgctaggttaatctgaaaacttccaactgtcaagaaagatttttgaaaaacaaatcagcattcagaccaattaatcaactttcacctatagttggatctgatgttgaaatcagaatcactcttcaatttgcaccgatctcctgtgttattaatagtctttagtctaagatttgaccctgctgtacatgttcggcttagaatttgagtacatcaccttgaactgcattggacaatgtgtgttggacctagatagtcaccaccaggagtacgtatgataaactgtactacttcaaatatcaatttggtttttttcttcctgctgtactaacataaaaaaaatcctaattgcaaataaaaagacgaaaaagctgagcacttgcttttttttatttgcatgactcacgtacaaatacaaaaaggatatctacaataagttaagaaaagttcagataaagttcaactgactgcttagcttgatgtggcgtaacctttctgcctgttttgacaatgttcctttatttgcatcttgctttaatatgatcctatagcacaagcccccaaggttctcgattgccatacaattgatagtattttgtagctatgatcattttggtattttctgctgatattgttatactgtatgttgactcttattgggcagtttgatacttttatcacggattactgttagtcgatggagaataataatgatggagtgattggaatatcctggcgtaattctaatccaaaggtatggatattggaccgctgaaactttcatcttttagtaatgtttcttgttacctgttgccgtccatgttttgtttggaatataggttcttatgatattgctttatcatttgcattatttgattggttggaaatagttttacgttgctttcttagtaccagaaagatctatgggtatgaaatttgagttctttaaggttttatccctgagtaaatatcattaattgtgtaacatgcacacaaatcttagactacacatcactatagatggtaaatgctgtgtaaaattgtgactccatggcaaagaatttgagactacctcaattggtcacatatccagttcaaatttgggagtgttttctttgtctgattcaagatagatgcacaataatttcctcataaagatcatatctttgtatggcataaagaacatatctttgatacaaacattttttcttgcatgcttatctatgatatgatgtgattcctttgtacctgttgagaggcagagttaaaactgcagtatttcaataagatcattatttgatgtt

SEQ ID NO: 11207 - DNA, 1501 bp, Oryza sativa
tttttaaaaaattaactagtaattaattaatcacgtgccaatgtactgctctgttttttggacgggacatgtattcccaatttgggaaaagacatgtgtgggagcggcggtcccttatatccaatatgcggcagagctccgcatgcaaatcaccgtgttgtcgctcgcctgtcctgcgggaccggcgctcctgtgcaactaatatgcggattgggtatatttttgtaagttaatcttggacatgtatataaatacaaaatatgaaaaataaaagtatgtttccaaaaaaattaacggtttacactcacttacttgatcggttacttctccaatgtaattaactgacaacactgacagctccacttccaaaatctgcgcacaaaagaaacaaacaagtcgcgtagcgattgtcgccttaacccttttttttgtcagggttaacattgtgtttacttaagctgtttcattgttcaattcactcaccctgcaagtcggcaacctcctgtcatccctgtgaatatctccacataaaagcccttttcaccttgccggctacgaacgcttgcccggtcggtctccagctcacccgcctgatcgaacggccgacggagctctcccggcgcagcacggcgccatctcggccgtccgtctcactcactcgtcactgatagatcagccggtttacttcccattacccagtattgtaattaattaagtactgacagtactgagcactgacagctccgtggcactattttttttttaccgcgaatcctccaaattccgggcgagaaaaacaaccacgagaaggattattagtcgcccactgtacgtaccggcattacagcttagacaacgttttccttgtctcctactgcttactccctccgtctcaaaatataaatatttttaacatagtgccaaatcaatcatttttaactttaactattaatagcaaaagaaataaaaaaattaatcatgtaaaattgatgttactagatttatcattaatcaaactatcataatatgcaattctttttatttaaaatatctttttttaataaatattgttggtcaaagtatcatctcgaagactgtgtcagagtctaaaaatacttatattttgggactgatggagtaattttttcagtggaaaactgaggcaaatcacgcgttgctacgggagcaatgcaagtgggcgtttggtttttgtggaattagggtggccgagtcagtaagtcaccacctgctccaagcaaactaattaagctgattttagctaaactactaggaggccatccaggtcttcctagtctacaattcatgtcgctctctcaaaggccgtagagatatacatcgatacattatacatgcgtgttttcagtagtgaagcagtgctgtgcatgcatgactccgccgctaaagtcaatgggggcgattaaggtaattaactaaccgggttaattttattcgttagattattggatagtttactagtaat

SEQ ID NO: 11208 - DNA, 288 bp, Oryza sativa
ggatacgatcgaccgagctacgcacaaacggctctatatatactacacacagctgcaggtattagctaggggccgggccggggcgtatatatgtacagtacgtgtgcgcaggtgagagagaaggaagcaacacgagcctattcgatcggaaccacacatcgcactccatcgtacagtagcagctaagctccgatcgagctagtaataattagtactcggacaactacgtacgttcctaacacacactgatgactgaccaattaaacgcccgggttctcgggatcgaga

SEQ ID NO: 11209 - DNA, 1039 bp, Oryza sativa
tataaataagttttggatatatttatctttaaaactaaagattagaaaaaaaaaatccagcgtactgtggacaaactatagtacggctgtcgttgcgctgtatatattcatgggtaaactgatctgcaggctgcagcaacactgcttgactggttcaggcgatgacccgtggcgtttactttccaatttcagaagtacaggcttgcttgaatattcttccgttgcaaccataaattaacccacttgatcattcatggtcgtggaatccggccgttgacctcttctgctaccttcaattcgtttggtacacagttgcgcgtagtagtactgtatcttttgaggcgcatgcaaattgatatgtgaacggctattctaaaatcgatcgagaagcttttcgagagctcaatctaaaagatgcaaattcttcgtgtggttggttacccaacaccgcagttcgactagcttaaaattgcccaatgatgctaatagtgtggatcagctagctatagctagcagaatgtcctagcagttgggtaggcaggcagcatgcatgcataggagcaggtacaatagcaaactattagccgactataaatatatttttaatgagataaaagataagagagaagagtagcgggctacagatctgtaactagcggactccaagacacagtgtgtatatatgacaggtgggactatatattgatagtatagtaagcaattattatatgaattggctactagattggttataggtgaattgcagttagtagtgggctatactattaaacttgctctaagaggctgcaaataattatccctcgtactgtactactatttgatagcaaccagcaatctactactaataagtgctaataaccattgatgggaagtgaaaaaacaaggggctggaacggctcatttttcagggtcatatgattgaattggtactcgatcgtaatgttgacactctagcaatctggcaaaggaagaaaacttccactcttgtagcattaataatcgtcaatcttcccctagc

SEQ ID NO: 11210 - DNA, 158 bp, Oryza sativa
tttctcgtgatgcgctcaatttctcgttatcgtgggccttcagcgccgcccacgggtagagttgctttgtgccaccttggcagcaaaagcgcgcgcacctccttccactttccatctttccctgctttaatttcgcgatctctactgcaacactaagg

SEQ ID NO: 11211 - DNA, 1501 bp, Oryza sativa
gtcaacagagtccacaagcgtgccgagaagatctacatggacgcccgcatcgacccgtcgccggagatcactagggaacctggtaccgcaacggccagctcgactccgacgccgtcacctccgcacagcgtaggtgcctcgagcagatcgacaggcttggcgtcgccacgacagagtccatcttcgacggcatcagcagggattaccctagcctagcctactcaaccgagcaggtcagggacatcccacctcgtcgttgcctcctcgccggtgaagagtcgaaggaaatagaagtagagaggggagaggtggacgccgccctgctgcacgccgctgccctgccgctcctgctcgcccgtcgtcgtcctcgccgcgtcgtttccccatccgccacaccgcgccgcttccccgctgcgcagctccacccctcaagcccatctcctcaaccgctggccactgcccatctcctccccgtgcctctgccgccacccaactccaaggcttcccccaccggcgtcgcggccctcgcacggccgccgcggagctttgccaagctaccactgttgccagccgccatcgtggcgccaccctcctcctctcccgcctcgccccaccaaccggcctacaggcaaagagagagagaaagagagaggaggaaccgagggagagaaggagggagagatgattcagcctgacatgtgggtcccacgctgactcagttgccacgttggacaaaaccagggtcaaaaccaccaaagaaccaatgtgaccgattttgattagttaagagacatcagatatctggttttgcgattttgtggatgattttgtaactcgttaacaagttgagggacctttggtgtactttttccttttactaaatcccggcctatcgacgtctattggccgggaatgaggcccatcaaacaatgacaaacactctactactcccttcattccaaattatacagctaaatttcttatattttagttggatataacacatcttactactacgaatatttacaccagactaaaatttttatattttgggataagaggaatacgtaatattttgttcgtttcataaaatatgaaaatagtacgaaacgggacatcttccagtactataaatctgaattggtttgttttcatgaacggagggagtagatgattactatttgatcatgtagttttgagtggtttgctcacgtcgcgtggcgatttgccattgttgttatcgaactaatccattagttttctccttaatactgtttacgtggccatctttttggtcgcaacagatgacgccgacgagtatatgacttgccctttgacacgccgcctcctcccccttcattttctcgaagcgcttcccttcccttcgcttccccgcacaatctacaaacgcgccacccgtcgctcataaacccctctccctctctctctggccgacacatggaccccaccgtttccaactccggcgacgccaacggcggcg

SEQ ID NO: 11212 - DNA, 687 bp, Oryza sativa
tatactatatttttttaaaaaaaaatcatacaatacaaacgtatctcggcaaaagtcgagtcactctctaatattctccacgggtaaatcctcttgcgtgtggcgtccggactttccgatcatgcgtgcatcgatcgatcggttgcatggtcactagctctcgatcccgagaacccgggcgtttaattggtcagtcatcagtgtgtgttaggaacgtacgtagttgtccgagtactaattattactagctcgatcggagcttagctgctactgtacgatggagtgcgatgtgtggttccgatcgaataggctcgtgttgcttccttctctctcacctgcgcacacgtactgtacatatatacgccccggcccggcccctagctaatacctgcagctgtgtgtagtatatatagagccgtttgtgcgtagctcggtcgatcgtatccatcacgattcacaaggcagttaatttgatcttggtttttcgagctctaaaactgctgatcgattcaatactcagtagctagctagctatagccacctaattcatcgccacgtacaaacggacatctgctttctgaaactgtttctgttgatagccggtgatcataacagcgcagataaacgtacggcttccaaatgaaggtaagaaaaatcggtctccgatgaactccatctcctctgaac

SEQ ID NO: 11213 - DNA, 350 bp, Oryza sativa
gattattatggatgggattatgttagatggtggtgttggcatgttgtgccatgttggcatggactttggtagtccatggctgatgatgagagcgccgtttgggctcatttgcttatacatttcagaattatatacttgctgtccataaattaaaatgatgctagatttacttgtccttgcttattttactcattaattgctcaataaaattagctttatgcaaatgttgaacctagagacccactataggctagaaagcttgcatacttctctctcccttatgtatttataattttgggtaagacttgcgagtacaatcttgtacttaacccggtgtctgcaatttcagg

SEQ ID NO: 11214 - DNA, 1501 bp, Oryza sativa
tttggtccctaatgaacttctttgatcatccatgcattcgttatgctcggtatcttttctttcgcccaagcaagtatctctacaaacgaaaacatacaaaacttattgtgtagcaacgtttgttcaaatatataataagtaaatctaatgtagaacacatgtacctttggttgattaatacataagatagtcatggttatatccgagctagttgtgtcctcatcatcttgcatgagatttaaaatactctagagtatgatgatgatatgccatagtggatgatgatgtgacacagttacatgttgagctttaggagttagtgtgtaccaactatataaaaagtatagatgtgtgaacaaagagagtatatgtgtatttatagagatacgtgtatgtacgggtacttaagtcttgttaactaaaaaaaagtccaaacaccccctatactttagatgaaagtctatctagcaccccgaactttaaaactggacatctaatcccttggtctttgtaaaaccgttcatattaccccctaaggtggttttgcatattttggaagcttaaacaaacaattttgaataactaatataacatatttgcatatcatcaatttgtacttatatagttatactatactattattatgttggtacttgtttgcaaacaagtgagagctaacaagtgattaaaaagaaagatttaaatggagattttaatatatatgtccaatgtatatgtcacgtgatcaaactcatccaagttatatactctctccgtttcaagttataagacgttttgacttcggtcaaagtcaaactgtttcaagtttgactaagatcatagacaaatatagtaatatttataatactaaattagtttcattaaatcaataattgaatatattttcataataaatttatcttgggttgaaaatgttactacttttttctacaaacttggtcaaacttaaaacaattagactttgacaaaaatcaaaacgtcttataacctgaaacggagagagtacaaattagataaaaaccattatacaaaatccccttaagagataatatgaactgttttgtaaagtttagggagttagatatctagttttaaagtttaagatgccttacaaacttctatatgtagtttagagggtatttggacttttttttaagagaataatatattttttaatttgagcttaaattggacgagctcaacgacttctgagttctactacttctgaccaataggcgcatcgaatcgagaccatccgatccaatctcatccacgcacacaactcaagtaaacgagaaaccaaagatcaaaataaaaaaaaaatccccacgggctcttgtgttgtgttgtgtctcgagtcgaggtctcgcctgagtcgcctctccctcccgagtctcctctcctctccttctcctctcctctctcgtgctctcgcaaaaccctagcccacctccccctccacccacatgcaccgcggcgg

SEQ ID NO: 11215 - DNA, 963 bp, Oryza sativa
tgcgccgaaagtgttattgaacatgtgttaattgattacatgggttcaggtcatatttatacccgagatacaaaatatgtccttgccggacacgactcttatctctaacaaactctaagataccataagtctttgcggcagacttttacccaaacatatctctaaggaaattaaataagatatcctaattaatagatacaattacctatctgagagctttatctccatcgtggcaatcctcatgaagcacgtccatcgattctagaagcagcctcgaagccatctcagccgattcagaatccagccgatgccttcgcagccgatgcatactctattcttcaaatctatgtctttgccgaatccacttcgattccaatgccgaacctggttcatatcttaccaaatttggtcgttaacagatgcctaacgggctaacattggcttgtttgcttgatgggctgacttgtgggctattccttgatggactgatggatatggcatccaggggagtggggcaacgtgggccgtagctgggccggtcgcccaaccctgcccaatgggtaggtccgcccctgtaagaaatatcaacgctaggccttttaagggggaataaaaccggactttatctgtgaaagtcatttcttttaaaatagccttttaggaattatttttcactttgcaagtaagattttgataaatactttactacttagatatcatttgcaagttattttccgaaggacttattcctttttaaggattcttagaaaataatcaaaattatatttcctttgcaaaatagtattcgttttaacaaactatcccatagagggtttctattcaaaactgtaatatatatctttatttatagaacaaatatgtcagaggggttctaatatatagagaagggtttttaggaaaataattggtatttgcaaatattaacatatttcataatcatgg

SEQ ID NO: 11216 - DNA, 1501 bp, Oryza sativa
gctactaataaagtatttactgaaagccctatttgtgaaatataattcttaaaatggcaattttaaaagaaaaggctttcttagataaagtctggtttatctctttgagaagcctagcctagcccgcataatggattttgtaattaattgtgtgtttagtttttgtgccaaaaatctcgattaaatcttatctcctaaaagtatgccccctgttcgacatcctcccctgtcccctctctgccccgtctgtttggtcaagcgctttggtgctaaacaaatcacagtcccgaagctctctgctcctatcgcaattttatcgctctctcaaaactcttatcctacggttaaattgaaatcgctctattgtttcgaactcgataattccctcgaaaaatctacgatcgttcgacggatttatttatcgtgcatcgattcaaatatcttcaattttatccctaccattgaaccctaccatgttgattggaattatatgccatgagtcacccctattacccctatttgatatcgagattcattcattcgagcgatcgcaaagaaatcctaattctaatccccgcacgacctttttgccaaatcaaactccaatgtctcatttagcggcctaattaccattatacagtcctatgtacagtcttggtgcatgttcgagttcaagtgccaattccaatttccaaattcgagactcccttgtaatttacaaaatccccgaggagatacaaaacaagtccagcagtactagttcaaataaatcaatgtccaaattatacagtaccttgcacagtccaaattataaatacagtccaatttacaagtttcacatacacatcccaagttcctattacaatcgggccatctcttttccctgccaggccaacccatccctcacagcaagtccattgttaccccctcggcatagcagtagcagcccactccctctctccttctcagcctaaagtctactttgctttcctcagccaacacagcatgcatgcacagaagatgtttgatgaaatgcctgcaagccatcacacacatttgactaccatcaaatagctgggaaccctccccaacaacaccccatgcaccatgcaccatgcacccaattcacagaactctccaccaaaaaccaacaaacacagtaaagagagttcacaccgaaaagaactgagctcaccaaaaggaattgcataccctgcctcctgcattccaacagccacaaacatatataaaagccgctgccaaaaaccatcacctctgctttgccactgccactgccactgcctctgcctgctcctccctgcgcacatgccgccgcttgctccgccgcgtctggccacgagtcgagcctcggttgggcaaggggttgaggttggccgccgcgccgtcccgtgagcttcctttcgcacgcaagtgcacgaactatgagaacaatcgaacctttgaacgcttgaactcttgaacgtatccaaaacttgcaaac

SEQ ID NO: 11217 - DNA, 499 bp, Oryza sativa
aacattacccttttttttcttatatgaaatcaaacaagatatctactgaaacaactggtgtttaagataatattaagttataaaatttcaaaattgaaataataactaaccaagtgacagaaatattctggtatatgatgggatgaaaacgggaacgggaaaaggaaagggaacagacccaccaaccaaccaaccaaacaaaccggtttagcttgctgcttgccggcagcagtaaccacgaaagcgctcggtttcacacgccacgcacaccccacaccccaacccaaagcggcatcagcgcacgcgtcagtcgtagcctcactgcgaccgggacccacccaccccctggccccacctgtcagccccccgttggtgtcaactcccggtggcctcctgcttcgccgataaataaccgaatcggggggaggaggtggaggtggtgctcctcctcctcaacagcgtcgcctcgcgtcggcgtcgcctctcaccacccaaccac

SEQ ID NO: 11218 - DNA, 363 bp, Oryza sativa
ctgtcttcatcaccagagaaatggaggggcggattggtcaactgccttgtccatgctggccatcctaggtggcactccacagtggcaaaatattagtgcataatatctcaccagtggcaaaaattacaaggacaaacctaaaagtggcatttagagagttgccacttctaatagtgacaaatattcaacccccccccccccccggccccacgcgttcttcatctgttatgaagtggtattaattgattagtttgtactactagtaagatatttagaggtgtatattacatgctggtaatctcacagaatgtgtgttggcttctgctcaaagtttcactttgcattgtcgtcttcttctcaagc

SEQ ID NO: 11219 - DNA, 537 bp, Oryza sativa
tgcatcagttgtgatttgtggaaactggagtgaagcttccactgctccacaccctcaattggcggattgcatgaacaccaaactgtaacagcagagtacgcagggtttcctttccatggtcaaattatttcattcagatcatgggggtacatatatataccagtatacatgttgtgtttttacacttcgatgacttgtcaccggtatctactctcccatgctacttcagatgctagtgcacatcagtatatgttgcctgccacatctactgttatacattcatcatggcacagtgtattctcgatactttctatttcgattcattcttcagtccccagtacttaccccaaatctacacgcagcagccttctagtatatgtatatgtatatgtatatgtatatggaatggtaacaagcaacaaactctgctaggtacatttatccgctcggtgttagctggactcgtgggaaactcttctgatggccagctgaaactctcaactctgacactggactgtatccaggagctgggatcaa

SEQ ID NO: 11220 - DNA, 716 bp, Oryza sativa
aatagaaagtatcgagaatacactgtgccatgatgaatgtataacagtagatgtggcaggcaacatatactgatgtgcactagcatctgaagtagcatgggagagtagataccggtgacaagtcatcgaagtgtaaaaacacaacatgtatactggtatatatatgtacccccatgatctgaatgaaataatttgaccatggaaaggaaaccctgcgtactctgctgttacagtttggtgttcatgcaatccgccaattgagggtgtggagcagtggaagcttcactccagtttccacaaatcacaactgatgcatggatggtgagagcaacaacgcatccctgatttgaacccgtgcgtgcacggtcggtctcggtcagtgatacagtgatacagcctcagttcccgtgcagtgtcgcgttccggcgagagttggattccgagtggccggcgaccccatccggcagccaccccagcggcggaggaacgtgagctcttttgttgctttctatctgtccaacctaccccccctcacgggccttgcccacgccacgcacgccaatccaaccagcgtcccatttccctcctcgtctccccccgcgtccacttctccactcccaccaccaccatgcaacgcagccgctggcactagatctcccacgaccacctcgcctcgccaccatatctgcagctccactcccctcctcctcgttact

SEQ ID NO: 11221 - DNA, 1501 bp, Oryza sativa
gttgtaatttctcctagatgccaagtgatctccagacttctcttgcacggtgacacgtggaaaatatatgtttgatatatatcctctcctccattcagacaaaagggggccgtgtttagtttccccaaaattctcaactttccatcacatcacatcacatcaaaaactttcctacacacataaactatcaacattttctccaaactactaattttctcctaacttcctaacttttccaccatgcatcctcccgattctccgatatatctattctctagggtagctcggcaaggtataaaccccttcaacgctggcgcgccatccaaaaattttaattttccccagcaacacttcaatctccacaaattcttccacagctaattccgtgaagcagtactagcttgcacttgggccctatttagatcccacataaaaattttacgccctatcacatcgaacgtttgaacacctacataaaatattaaatataggctaaaaaaataactaattgcacatgttgcgactaatttgcgagacgaatcttttgagcctaattacgccatgatttgacaatgtggtgctacaataaatatttgctaatgacggattaattaggcctaatagattcgtctcgcggtttattgacggattctgtaattagtttttttattagtgtccgaacaccccatgcgacaccctatataataaccgatgtgacacgctaaattttacacccctgaatctaaacagcccatcttgctgttctactgacaatgataggcagaccgcagaccgaacgtcctttgatcgatacagtgaaactagtaacgcatgcactgttgtttgttgagacggacacgccatctgaattaaagtactatagctacgccaggagcaaattaacaaagtatcatcatgactatataaaattatagacccttaattatgtttttaaggtaagacgtcaccactactaatactctctctacccctaaatatttgacgctgttgaagtatatttaacaataaatcaaatgataagaaaaaaattaataattacttaaattttttaataagataaacggtcaaacatgtttaaaaaagtcaacggcgtcaaatattcaaagacgcggggactattagtagtggtgatgtgcattatcacatcacctctacaactaacatcgggtctcgcaatttataatatcacactatatttcaataagtcctcaataaatattggcttctccaaattttaaaatcatctatttgttcaataagaaaaatcatagtattatttacgttaaacaaatacttattaattgattttataaactagaaactcaacttgtttgccgttggaatgcgcgggtttaggctatatataggcatatggtgctgcaactgcaacttctaaacggtgcagcaagcaatagattgagctctcgatcgaaccagcaaataatggccggcatcatggacagtactactgcatcctact

SEQ ID NO: 11222 - DNA, 1501 bp, Oryza sativa
acaaaactcgcatggcctggagatcactgatgacagaaccatggcttccctagcatgaatttccatgtaacttgggacaggatgattgttgttagcttgcttgtcatcggagttggctgatggatgcccggtttcggtctggccatagctgttgcgctatcgaaatctcctactccatgcagtggctggtgtggcacatgtgagtgacttcaggagaggaggacatggacggaggcgatcttggtggcggcgcagacggggcaagcgtcaacggcggcctcgtaggcgccgcacaggcacaggcggcggaacgagagcagcggcacagacgcctccgtgacacggtaggccttgcacgacgtcgccctggacaccgcgtcggcggcagtggcggcggcggcgccgcctggggtctcgaagcagcacgactgcgcgtcctcggcgtcgccttcccccgctgcggtggcgacggcacagggggactagaggagctagtcgagcgtggcgcggaggccggcggcgacggcctcgtggctcttagcaacgcctatccaagcctgcccctctgcgctcatctggcggagcttctcctctagctccgcgttgcggcagcgtgcgcgatccagcttggcctccgccgcacgcaccctccccgtcgtggcgcgcgccacggccgccaccaacgcccggacgtgctgtcgctgcgcttcctccagccccacgcgcatccgctcggcttgcacggcatccaccaaacaccgacgccgatcaaacaccactcaccaaacacaaacagaggaggccggcggcgtgagccggtgcgtggcctcgtcgtaggtgaagaagagcgaggcgttggctgtcgggatgggaggcctgttcccgcgtcgccgccaccaccacgtcgcctgtcgccagcctagagagaggaaaagtgagagagagaggacgaagggaaagagagagatggtgatgacgtggcacgctgacatgtggggaccacgtgggtcccacgtgccacgtaggccaaaaccggggtcaaaaccatcgaaggacctcgggtgaacggttttgtatagttaagggaccccgcatatctggttttgcggttcgaggacgttttttatcccgatgacaagttgagggactttcggtgtactttttcctaaaatcttaagcaaacacatagacgggcctcaattccaaagaaatctagatgggctgcggaagctcgaactaaaacctggacctatcaaaccaggcctaaatcactacaaattcgacccggcccacgtttaacctaaacaaggacagcccatcaacctggcccatggagcccatcaagagcccaaacaaagcggaccgggtcgctacccgttaacccgcctctgccattgccaaaaatcccaaaaccctacgctgcctctgccgccgcctcgccgccaccattctcccctccgccgcaaaaccctagctcccaaacccctcgccgccgccgcca

SEQ ID NO: 11223 - DNA, 1501 bp, Oryza sativa
tgtcctcatgtgcagttgtcggcctatacataactactccctccgtttcaaaaagaatctaacatattctaggacaacaaatttggacaaaaacttattcagatttgttgtcttggatgctgactccaaccaatcaaccaccgccacttgtggcactgacaagcaggcctgcctgttggctagataagacaaactttgtgtctctgtttggtacagctttagatcacaaatccatggtagatttgtattttgtatgttaaataataatggtttaaaattttaaattatatataaaatatgaaaaaaatgattaatcaaaatgttatcaatgtaatctagatccgctgattttgtacccagcttcaaaaaatttttgatccagagttgtgccaaaaaggatttgtatatatatgtttatgatctttttttttgttctgattaattcctcctcctttttcatacatggtccatagcttgcatcctgtactaattaagtactaacagcctaacaggtaggcacaggcaggtccgaatataatgctgaagtgagaccctgaaaaccatgaaagctctccttgctaatcttgtccctgttgtttgttaatttagttgaaagtctatgatggttgcattagaggagattaattagttggaacttggaacagctctttcaagaaaattctttgccctcaattaatccacttgctatcatgagccaatgctctttgcatacaattgatcgagattggttcgagtttgcaatatcacgctgttacctcacagttatcatagttaccccctcagtaactaccttagtttttaaccttatagcttttatggtaaccacatggatactagggtaaccacgataccgtcaggtagaggtaaccatcactaaaatggtaagggaaaccatggggtgggctacgcttgcaatgctcaatttctgacgaaagactttttttttctctacgaaacacagtacaagaaattcacgtatatatacgctacacactcacacctatgaatacgtataggtacgcaacaaaccacatttataaaagccaaacttttgctatgtgtatctctattgtaggtgaagatcattagatcaagaccagagttatatatgttccatcatcctaaaacgtacttccaaaagctctaatcatgagcactactcaagaccaaagtggatcatgcatgtaacaaatgaaataagataagagtcactggcaaacaaaaatgtggcatatatgcctctgggccccaatcaagcaaataggccaacctggtgccctaattaagctagcttgcaaaaattcaatggacaggtagatcgatcagtgtgtgactacctatagctatatagctttagctagctagcgtcctcacttgtctacaacgacgtgccacccacttctcctcctcactaacacacatccacttatatatacacacatttgtaatttgtatctatatatatttgcaatgcttaagc

SEQ ID NO: 11224 - DNA, 559 bp, Oryza sativa
gccctccgtcgccgtcgccagccaacgccgccaccgcgacagcctcgtcgccgtcaccagccgccgtgaccgccagcagccaccggacgccaagcactaggagctcccgctccagatccgcccacgggggggctggatccgcctccggcgtgcctggatccgcccacgagggggcccgacctacctccggcgcgcctggatccagtccgccgtcgccagcctcgccgccatctccatccccgccgccatcttcatccccgtcgccgacggcccatctccgacgccgtcgtcacccccgccgccgtcaccttccccgccgccagccgccaccccgccagatccggccggagcggcgtggatctggcgggctccaccgccgccgccttcagtcgctcgagaaccgccggtgccccagcgtgctccttgagagaggaaaaggaggccccgccgccaccgtccttgccgccgcgcggctttgccggcggctgctctggcggcggcgaggcgggagggaggaggaggaagctggctcgcggcacgtggtgtcgccgcccgtgtc

SEQ ID NO: 11225 - DNA, 1299 bp, Oryza sativa
tttcagtactctcagagcccctcccctgtttcatatatatatgaagttcaaaattcacagcctagggtcctcaaccaaaaatgttctagctttaaaatatgtcgttaaattggtcaatccatataagttaaaaaaaatccaatcttatcgtcataaaaaaaatttagaagaaaaaaactctattttaatctatgcggtcagccttgcatttggattgaacgatgattagaaaaattcaaaaataagagataacatttggattgaacgatgattagaacaataaaaaataagagaaaacaaaagatatagttttaaataatgaaagcagcaacaactaatcaatggatcaaacaagaaaatacggtacctactcaactactgtaaaattactcatttcgtttcatactataagtcgttcgtctttttatagaaaagtttagcaacatatataatatcaaattagttttattaaatctaatattgaatatattctaataaaatatttgttttgtgttgaaaattttactatatcattttataaatttggtcaaacttaaacaattttgagtgaaagagaaatcaatcgacttataatatgaaacagagagtaatcaccaaacaaacttagctgccccgtgtcgatttagttcttcctagcttagtcttgacgatagtaactgaaattgggagcaagccaagtcggcaatggccatgtcagccatggttgagttgcctgaaacggcgagaagctgccatctgcgatgctgtagacgccaatgtttctcggcgcctccgtgttgccatcctccttatccgtgtagtagatgtggttgggcagaatgccgctggagcactcgccgtcgccgccggccggcacccagaacggctggttgcacccgatgaacagcgcgtggctgtcgccgccgtcgcccagtgtcgccatctcctctagcctctgcgcggaaagatccacgcggaacaccttgatccagagagccgcggcaccgagagacattggcgtctacagcgtcgcagactgcagcttctcgtcattccggccaatgcaaccatggttgacaaggccagtaccaacttggcttgttcctagctttggttactaccgccaagttaactctggctaatctggtttatcgagcagcaaattttgattaagtaaattattacactcttactgactatctgttgaacaaaagacagggcttgatcatgtcaaaccatgcaatgagttatccgtttagcaaacctctgggtactaggtactcctccagttattttttc

SEQ ID NO: 11226 - DNA, 1501 bp, Oryza sativa
caccggccagcagatcgactcgctcccgccggtcgacaccatcgagcacgtcaggcaccgcagccagagcgccgccgccgccgacgacgacgacgaagatgactacgactacgagatcgtccagtacgactggaccatggagcagcgcgacgaccggccaccgacccaggcgaaggccggtgagctcgccgagtacctcctcatgcgcgcgttcctgtcgtctgatccatcgtcggacagcggcggcggcggctgcatcgttgtcctgctccaccggccaaagtaccagctctcgttcgcgcgggtgggcgtcgacgagcgctgggcttgggtcaacctgcccgactcggacttctacaccgacgtcgtctacaacgacggcgacggcatgttctacgctgtcaggcaccaggccgccatccacgcctacgacttgtccggcgggccaacacgccgtgcgccggacgatcgtcctagccgaccagttgcacggcgtcatcgacctcgagaccaagtaccttgtccgcgcccccgacggcggcgagtggctgcaggtgtggaggatgctgaagcccgtgcgccgcgctgccgacacccacggggacacgacgccgacgacggcggtgtataggaagacgacgatctggatcaaggtgtcccgcgtggacctcgccgcgcagaggctgcaggagacggcgacgctgggcgacggcggcgacagccacgcgctgttcatcgggtgcaaccagccgttctgggtgccggccggcggcggcgacggcgagtgcccggcgggcggcgtgctgcccaaccacatctactacacggacaacgatgaggactacgcgctgctctacccggaggcgcccagggacatcggcgtctacagcgtcgccgacggcagcttctcgccgttccggccatctctaccatggctgacttggccattgccgatctggcttgttcccaatttcggttactactgtcaaggttaagttaggaagaactaaattaacacagagcagctaagtttgattcattgattggttgttttttgttgctttcattatttaaatctacgttttattgtctctgatttttttttaatcatcgttcaatccaaatgtcgggctgtgcatagagtgtgacttttcttttttccttctaaattaaattttgtgctgataagactagacttctttttttctctacctgtatggatttgaccaatttaactatattttttttaaagctagaatattttgtaaatgctccgaacttctctagtcatcactagttcaccacctcttcaagcgaaaaaaaaaatggaactcgtttcttcagttaacttcatctgatcgtatagtaatacatacacagggaggggctttgttttgtgcttttgtaatatgtctcattagttctgattatcctcatttgaggaacatttgttgttaacctttttaaatttctctttccactctcaatataatctcaagcg

SEQ ID NO: 11227 - DNA, 1501 bp, Oryza sativa
ctcgcgttcaaacgggcggatttgcccccgcaaatctcgccggcgccattgatggcggccggacctcccgcgccggtttccttcctccccggccgctctctcccccttccaaccctatttaaaccctccccgcacctcctctgtccgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcgggttcgccgcatcctcgccgacctcgtccacctctccgtttcggtcgccgaccgccggagcgccgccgaccccgtcgacccgagccgcgacaccgcctccctccgcttcggccgcctccctcatcgccgccgtcgccccgaggtgagccgtggaccgtcgcctcctttcccccttccctcccctctctcggccgccgctccgccgcgccggtggtcgccggcggcgaccatcggggcgcggggcgccgcctcccgccgtccgcgccggcttggccgcccttgggtgcgccgagtggctgccgcgtggggcccggccgtcagccgcccgcgccctcgggtgcggctgacgtgtggggcccacggcgccgatcggtgtgagcccgggtgcacccggtccaccgtggaccgtgaggctgccgcgtgggccccactcccgtggacccggtccgcatgcccctccccctcggctgacgcaataaaccatttttaaattaaaatttaaatgaagaaattcgtaaatattcatttaaagagcatataaacttcaaatggccataacttggccatttgaactcggaattggaccgttcaagtctttaatttttccttaagaagtcaagaacccatttttgtgctttgttcttgtgggttatatggagtttattagagtaaaagccttttcttttccgttggtcgtgtagacgctgcagcttcggaagatccgctcttcgtggaggttgaagccgacgtttgggaaagcgagcaaggcaagtcacatcatcctcgaacacattgaatcccagtttataaaattattttgatttaaattattgcattatcgctttatttaaattctcacgttatcactgttttgtctagccatgcctatttacttttgttatgaccttattattgttattgttattattcccctgttcaccctagaataaataaaaccccaactagtggacactctactcatggtaccactagtatgattttaggtagatgcttcgctggttaattaggcaacattatgtggttttacaactctagactttgggaatattctcatcacctggacactatggaatggatggattattgtggaattggattcacacctcaccctctattcaaaactctcaaaatggttttaggctgggctcggggtgcatggttttgatagtagcacctcagccatataaggaccggt

SEQ ID NO: 11228 - DNA, 1501 bp, Oryza sativa
ggcatggcaaacaaagtgtggccaacaatttgttggccacaagtgtggcaatgtttagctagaaaatgagtatatgacatgtaggcccatgaaacaagaaagtgtggcttgccacaactgaaacaagcaaccaaacgctaagctaacaatctgtggcatgcctaacatgtggtgtggcaatgtgtggcaccaaaacaaacagccccgtagtataattcatggaggggtaatgttggaaatgtaatagatggcattgtgatgaatttgcaattggcataggggtaagttcgtaatctagtccacgggtcaatatgctcaatcggttcacaactgcagcacgcggggatggcgacgagagtcgttttgtcgagaaatgagatgcgagagggagaacggaggcgaggcgagatgctgcagacctgcagtgctgctgtgcgcgacggaggccgccgcactttacgcgtttggcagtgccgtcaatttgatactgatgatgagatcctgtcaaaggactctgctagtactctcgcaaaaaaaaaaagggactctgctagtacacctgtttcaaccgtagcgtcaaggtttagcaacacctaattgaagtgggatgatccatatcagaatctaaggcaaggccggaaggtaatcaaaccgatgaagggttcaagatcgtcgtagccatgctgatgttgatcaatttcttgtcaattgttgtttttgtcggtcaaattgcagattgaaatagctgattaagaagacactaacacagttttagctcatatctgattgtagttatttttgtcagtcaaattgtagattcggataactgattagaatgacgctaatagagtgagagtgtgcttgcaaccgcgagtcgttgagctttcttttttaaccttatttcagttcagtctagaactcagtacttggtccgtctcagttctgctgcagataaacgagcttcggcattagctcatttgcctgatgctaatgcgaaaatgattaaattatacatcatcagctaaacatcagtgattcagtaattagttttgcagtatagcaattgagcgattcaagaacacatttcaacaaagcgaccttccctagagcaggtacaccatcatatcccaagaatgaagcggtgctgcggtgcacagggccacagggggtggagggatggcgccgtcgtacgtggccgtgggttcacgcgactacgcaaggaggggcggcgggcggcggccgcgcattaaggtgaggggcggtgccgccgtggccgtgggttcgcgcgaaaagaacgggaggcctcgcgaaaggcgaaggtagacgtcgggcgcacgaggacgggcgaaggccgtcgtgcgcaacgaacgggaacgagcgaatcactagccttcgtgggagcacctgaaataacgaaaatacccttccacggtgtaaaagtaaaattctaaagtatccatcaggatcaatggttagatttggttcctactacactactact

SEQ ID NO: 11229 - DNA, 1501 bp, Oryza sativa
aaccaaatgtaaagaaagtgaatccgagttgcttgttcgtgagagctattcccagttatgaaccaagtgatatgttcaaagataatctacagatgttagattaaaagcacatctaacaacgaagcttcagatttggcaggatcacgatcagacaataagaagtccagcagtaaagccatttgggaagacgtcaaagcatgtcaagggggataagttggttctgttaagaaacataattcaaaggcaaagttatcgacccttgcatcgaatagcagaagtagctagcacccggagagcaggaaagctcatatgaggcagttggtggcaagttagaagtaaatgacaagcatggtaatctcatgatgacaagcatggtatcctagtaatgacaagctggtgtcgacgcatgacgtgaagtgggtaacttgtatgaggattgacaccaaggataagaagttctggaactgaaaccccatcctcaactaccgcagcctagtctgagtcagttaaaggtgcaaccagggacaagtcgggtgaagagaagattccatctgcaacaggagatcgagacaagcagtccagagtggagaagttttgctaggcaagttcgttatagaagaagcgacggaagaagtcagacaagaagagaagaccgcccaacctatcttcatgctagcctcctcgaatctcggggacgagattcttgtaaaggggggtggatttgtcacgtcctgataaattcatcccgaaattaaaaatcattcgctaaaaggaataatagaattaattaaaattcgaaaagaaattggcaaacactaaaatacgtagaagaaaaatttgaatatggcccggagaatttttgttaaattctccttggtctaaaaggagccctcaaattttacttgaattttcagagcaccggaaacaattattaagcaacaaaaacaattatcaaagtttattaaaaagaaaaacctaaaaataatcctccttttcttttgggccaaatttggcccaaagtcctccctctctctctcccggcccgcggccaaagtcctctcttcctccctctctttctctccctctccttctctccctccttctcttgggccttccctccccctcccggcccagctccctcccctcccctctctctcccgggcctcctcgccctcctctcctcctgggccgcctctcggcccaagcctccccgccccctcccacctgggccgcctccgggcccaacccgagcggcgccctcccgcccgtgccgcgcaagtgcgcgcgcgtgcgcgccgttgccgcgcgctgaccgcgcgccgcgcgtgggtcccaccgcccggtcgtcgtcctcctcccgcccagcttctctctctctcccgtgaaccctagtttcttcctccctcaaatccgcgcaaatcaattcccttatttccaaattaagtgggggcttttaatcccctttccatcctctttgatttcccccattttcccccttgat

SEQ ID NO: 11230 - DNA, 1501 bp, Oryza sativa
attctggtaacgattcccacaccacaacaacttttcacaaagcacaagcaaacaaatctacgctacaggaaacacctcacatccgcccatgaccatgggcacagctgttcgaacagttagttaacctctgcagagggggtacactttacccacacaacattactaacccggatcacccagcccgtgagatcagccacgtcgggagaccctaaggctttcatgacaaggcatttcgaaagccgacacaagtttaccatatgccaacaagaggggtcccagaccaacaccaggttaggtcccagaccatactgtgccaagaagcccgagggttctccccgacaccaccccgttgaatcaacatgtctcttggcatcatggctcccccgattagctaattactcagccaggggcgtcccattgcacccatgtggtcgcacttgttatatgctcggatgaatttcccacaggaatcggtccttatatgcgaatacgggacagtgccacataggcacaacccccacatcgtgagttttcacaatttattttattttcaaacacaccgacaccacatgttgggttttcaaggcttctcaaacccatttcccaagttttcgacaaacaacggtgtatgtaggatatttggtatacgcgctcaaagaacatggataccgaggtaccacaaaggtggagctacaaggagtcagggtagtatagcctacaggaattagtgcgactactaggtaggtctgtcggtttggcatgcaaaccgaggccaagcaagttaaacgggtgattctaataatgcaagttgcaaacaaaataataatgattttttcgattataggagcaattggtcaaagggtgacttgccttgctcaaggtcttcacgaagcttcacgaatcttcgagaaatccttgattgatgaaaatccgcaaccgcaactatacgcaaacaatcaaaaacctaaacaaaagatcaaaagaaagaccctatttagactaattaatagtgccattagatagttcttaattttacggaattactggaagttgaacggagtcaatcggatgagcggttgagaagatatggatttcggaagtttatttggaatttctagaatgagaggaatggtttatggaatttatagaaataatattctcaagaatattattgacagtcactgacgtgcggaaccaaggaaaatgattcatggaatttttggaataaagaattgatttacggaatagggggaaaaggatttatttaaaccctttttaaaaaggaaaagaaatggggaggagatttagacttccctcgggcggctagggcgcggcccgagagaagaggcgcggctcggccgagctaacgggccggccggcctaaggagacacggcccattagggcgcgcgggaggggaggagagagggagccggtggaccgggctcatatcgcgttgtcccgagtgggacccgcttgtcggtgacgcgactcatggaggga

SEQ ID NO: 11231 - DNA, 1501 bp, Oryza sativa
atagattggatctaaacttcagagctcttataccatgaaggaaatcacgagaactggagtaacgtcgcccttcacgctagggtcaacggtgcgtgtttcacttagtgcacaaatcggcacaggtaagtacatatatatgcatagacttgtgaggctcggctggggttgtttacataacaaacttgatcttgtctaactatctaaaccaccggccaagcctcatcttgtctatgtttgttacatgggatagtatctctaacactcagtgcctctcctccccatccggcgccggaaacggattccccgagccccggagatgcttccgccgccctcaatcgatccctcgttaaccgccgccgtttcccctctttgctcgccgccggtatgcgccgccgcgattcgtcgccgccggcctccctccggtgaatccgggccggtggttcgctccttattgtccctcccgtcgctccggtgacctccctctcccttgaatccccgtgtgctgccccggcgaatgtcgccgccgtccgccgtccatccggccacggcctttctccctcctcccgctcgccagcgtggccgccacctcggctttgaccgagccaagtcggtcagccgcctcctccctcccccaccctcacgcgcgcggtccacggtgcgccaaccggctgcgcgtgggcccgccgcatccctagtccatccggtgcacgcgcgtgaaccgcgctcacccgaatcctagcgccacccttacgtgcgcccatccctccatgagtcgcgtcaccgacaagcgggtcccactcgggacaacgcgatatgagcccggtccaccggctccctctctcctcccctcccgcgcgccctaatgggccgtgtctccttaggccggccggcccgttagctcggccgagccgcgcctcttctctcgggccgcgccctagccgcccgagggaagtctaaatctcctccccatttcttttcctttttaaaaagggtttaaataaatccttttccccctattccgtaaatcaattctttattccaaaaattccatgaatcattttccttggttccgcacgtcagtgactgtcaataatattcttgagaatattatttctataaattccataaaccattcctctcattctagaaattccaaataaacttccgaaatccatatcttctcaaccgctcatccgattgactccgttcaacttccagtaattccgtaaaattaagaactatctaatggcactattaattagtctaaatagggtctttcttttgatcttttgtttaggtttttgattgtttgcgtatagttgcggttgcggattttcatcaatcaaggatttctcgaagattcgtgaagcttcgtgaagaccttgagcaaggcaagtcaccctttgaccaattgctcctataatcgaaaaaatcattattattttgtttgcaacttgcattattagaatcacccgtttaacttgcttggcctcggtttgca

SEQ ID NO: 11232 - DNA, 1501 bp, Oryza sativa
actcgccaggtgagcggggagccggggacccacagcatcaggctagggacaggtgtggacggtgagtcggtgacgatggagttgggactggccaccgacgccagctaggtgccggctaggggagacgatggcgggctggccaccggcgctagcgatggacgacgacaatgcaacaccagctaggagcggcagtggctaggatggtgtcggcttggggaggcgaaggcaggccaccgacactggctagcggcggcgatggatgggacgacgacggctgccgtcaagtcactgctgggcgacacctgggagaggaccgacgaggagacgagacagcatggcgcaaacgacgaagcatcagggcggcatggtggcttagcggcggctgctagtgttgagcctgggaaagggttgtggagcgagggcgtgacctgggaaaggtgtttggcggatcacggcctcatgctggtggcgacgttggcggcggcgcggcgcacggcctcttgctgagagataatttggggatcgatcaaatcatctggctgctcgtgacttcatctacggttttctttgttgtacgcatccatcgaattgggctgcaactgagctagatgtggccttctttatgaagggcttggtgtccaccgaaaggaataagttcactttgactctcttaactagtggccgaatctgattcgtatccctgaaccacaatactgggtatctcaacacccctaactattaaaatcgctgtaatttgacttcctcggtggttttgaagaacggttttgttgacgtggcgtctatgtggcgttgttgacctggtatctgttccacgtgacgctgacgtggcgcttaggtgtcattcaaacaaacatatatgtgcgggacccatttgtcattcagacaaaaaaaaaatttatggggcctacatatcatctctctccatttcttcctcctctctctccccccttctcttcggtctttacattggcccgtatgcggggagcgggcgccgaatcggcggcggcggcgggcgctggagcggcagcggcgtgtgagaggaggcggagcgagagggcggggactggggatgaggagcgtgcgggagttatagggaattgctaaaaaagtatcgtaagctttttcagtagaaaactttcgaatgcaactataggaatgacatcaagattgaaaattttagatccgtgccagaaagttttagatattcatacttgtgttgggttcacagttcgttcgagagagattatgaggttttaattcagagattatgagcttggagacgagacgacgcgaagctttttgcgtcatcgtcgctcggcgagctggaacgtgcgcttcagaaactggctggcgacctcgtcgtcgcggtggcagagcacgcggaggatcgtgttcgggtcggcggcgtcccaccgcctcgatgtcggcggcaccggcgccacgccgccgtagccgccgttgccgtcgtcaccgtgcccca

SEQ ID NO: 11233 - DNA, 1501 bp, Oryza sativa
tctaaacttgggctctgataccacttgttaatgtgcgcagcccggcccactgaccgtgggccacccaggtcacatgaggcctgctccaccacaagctcaaccggagtcacaactttaggtcctggacctacacaacccaaaagactagtctgatggatgaggaccgcccctaccttttaagtcgtgcttctccatcatcaattaccgttcattgggcatttgggctgagtactgtttcactgagtgagttgttcacgggaagcaactgtggacggcaaggacaagttacaacgatgcattttctgaagtattgggatggcttgtgcatggaacaagctgattgcatgctacgttagttatgcacagggatttggttagttgggaccatgctgtgtgtaatggttaatttgtacatgaggtaaagctgaggtgatatggcaagccaaagtattggttcggcaagattgcaagggtggcttaacttagttatgcagttgtacgagacagttagaaatcccgggaaacagtgggtgaaaatcgttgatggaatcaacgggccgtttggcagtacagggtatatccagaatctgcggggcttgcataatggggatatataaaatatgcgtcactaaagatgaagagcaatcgctatgttggtaatttcttcgggtgatttaaggcaatggtgaattttctcaaattatcggatattcagtctacggatgcggaaagcgtggatgttggatttattagctcggttcataagacaacaagaaagaaagggttcactacatgtctggtgagtttgatttatttatttggtgatgacgtcggttatctggccatggattagatcaagtcaactttaagacggtagatggagttgaacatggtcttcggggaagtctatgatgtgacagttaggaaggaattccattttgtttggcaagacgactgtggtaataggtgagaaggtggagcactgttgtaggtggagtcaagaagaagaaattacagggatagcaggagttgactcttgttatggtgagcctggtggagtcttatcggggcggctcggcgtgaacggcgaaaagggatcaactcaatttcaggtgcacggagtttcgtgcaaagaacaaattcaggttggcgtggcatattcatcaaggtggagtttgttagagtttgtgttgaatatgtgtacgcaatcggttacagtttaggacttggagttgtactaggtgttaggattagagtaagagtcggactctatcataggctctctcataaatagaggagcgtgcctgttgtaaccgatagggcgacatagcatgcaagagggagtggctcccggctatagtccgttggtaactttaatacactgtaatatgctggatcgggaagaagcgttcataattaatgccctggagatgtaggtctcggctgaactccgttatcaaatatcacgcctcggtgtcgtcaccatgtttagatctcctat

SEQ ID NO: 11234 - DNA, 1501 bp, Oryza sativa
gggcataaattatatgtttaattggatccatactattataaattttcgactttagaaacatgttattattattcatttatttggaatcatgctattacaatttcttgattatttgatatgtatcactacttacccttcagtgtatttattttatgatttctagaccaatggagcccgagatagggtgctagagctcacggttggatgtggaggatgagagagcggcgcaatcggtgagggagagatggatggcagaggctgcagacggtgaaagggatgaggatggggatggggagcaagccgtggttggaggtgccacccttctatattataagttgttttaacttttttttaagttaaacgttgttaggtttgaccaagtttacagaaaaatgtaataaaattttaaacataaaacaaagaaactaccaaaatatgttaaatgttacatatattaattgttattctaggttgtttagcatatattgagatttgagaaaaaaagactataataccccttgtcaaacggtttataggtaagagtggagagtagttgagggcaaaataggaagaaatttggatgagaagtgattaataggatcattagtactctattgtgataattattttgggacaaattcaaaccctataaatacaattattatgggatagaggtaatagatgtagtgaaattaatttggtgttatataagtgttgttatatttttctataaacttgattaaactttcaagaatttaacttaaaagaaaatcaaaattgccgtatttcacatttggtaatccatagcagctccgctatacatcagacaatagtagcagactagcagagaatttatgttttcatgccatccaatacgttatgccgaatagccttcggttacatctagctttgcttcagaaatctgacatgcaggtcgattattcaggaagttggaaacgcaagccagacggaattccgccacgaacacagcgcagaagcaactagctagcatggcgtatcaccaattcacaagtcgagtactatattggcatttggggcatgaaccatcgtagtagaaggtactaccagttacaaagcctgaagaacacagcacgtacggtaccgctatgctcaaattgaagctcgtacatcagcgttccccagttgataacgtagcatggatgacatgacactatatatatcttaggagattcctatacattgctctagttatgaagctcatggttcgtctcatggccagaggaggaagacgaggacgggcggcttcagttgttaccgccaccgtccttctgctgtgtcttgccgccgccgccgcggaagctcccgcgcttgctccagtttgcaccgacatcgccgccgccataatccccgccatatccaccaccttctccggctccgccaccaccccctccaggttccccattatagccaccaccatagttgccatatcctccaatgccgccgctgccgccaccatagt

SEQ ID NO: 11235 - DNA, 1501 bp, Oryza sativa
aacaagtaatatcaatagcatatatacactccttaaatatgaaccatgtgagatggtgctggatgtagaagtatatatacttaccaggggaggcaagaatggaatgaatgatggaaaatcaggaagttccccttcaggcacatcaactgagatcccaagttcaacattctttattctttgttgtattctcaacctgcgaatctacgtacacgaaaatagaaaaataaggatacagcacaaaacacatctgacactgcacagaagaactttagaaggtataacaaactgaaagcaatctaaagtacatgcagaaagaagatgtgccagatttattcaaaaggattaacgggtgtttccagttctctgatgatttgcaacacacctgtttaatatcacaatatctagaataaagattaactaacaacggcgcaagctgtgaaatcattgcgtaaacaatctaaaagtactatgtaatagctcagaggattgccatctccacgttagttgaactcatatgctgattaccaagcaaggactacacattatcttctgtattttaactatttgtgagggataatcagatcataccaagcttacactattgccatttaatgaaaaacagtaacatagaaaaaacaaagtcgacatacctcctccatatgcaagaagatcttgttccggcggctcctaatattatcctgaatctcctgcaagtccagcttttcaaaatcctggactgtctcaggcccttcaatgatacaaaacctgagaacaagccgggcatgactcaacatgagctccgtgcaatacaacaccaaaccaaaatgttatcatctctaaaggtccaaaacgacagagttcgggaccaacgttttgtcagctagatccacctaacgtgttcagtcgtactccagcaccaacacggaaggagccaagcaaaggctacaaaaactacttgaatttttatcgtctagatccggcatgttcagacatcctccatcaacagcgaagctgaggcaagcatatcatatatatatatagctaccctggtactcggttttttatcagcaagatccaccatattcagacaaactctatcaacagagaattcgtcccaaccatgaagcatatgctaaatctattcgaattatttctcccctcaatcccctgtatgctggtcaacacagtactgagcgtatattggggggtcaagctcaagaacactcagccatccagcgtgattgacccacgaccaaccccccaaaaaaaaacacctactgatcgtagaaaaagcatttaccccggggagccggcggcctgctcatcaccagagccgaacgacgctgctgcaggcgtcggaggcggcgaggacgacgacgacgacgacggcaggtcgggggatccgcccgacgcggcggcggaggacgcgacccgccacctgcgcgccggcagcggcggccgcagccggtcagcgtaggcccccggccgcggcgacggccgg

SEQ ID NO: 11236 - DNA, 1501 bp, Oryza sativa
cgaggaggcggcggcggcgagcgggcggggagggtagacgtcgaagggcttgacgaagaggagcacgcggcggagcgccattggagcccctcgtctcggcttccctgccttcttgtacccgcggttcgtcgcgttggcggcggcggcggcggcggcggcgccccccggcgtggcgtctgcgccgtcgggttgtgcggtctgtttctgacgacgacgaaatacgccttcgaatcaggaacacgtaaagcagatacggctaagatttgttttatcagaaaagcccctgcggtactaatttatcacacatggtgacgatgttagaccttcacagtgcatcgcccgtggcgttctgccccgaccggccacgttggagattccatgccacggatgcatctggtgcatccaacctgaagcccgcgtagccaaagttgggcacgcgttcttcatcagttttggtaggcatatgtcagagcgaggcgagaaacggggcgcacggcgcgttgggacagggcgtgaccccgtgcttcacccccaaaacaaagctggccggatttggcgacatcaacggcgtggcgtcggctgcctagggagaaaggaagatggcggtggtggtagaagaggagacggcggcggatctggctcctaatctcgttgttatccctgttccgcgccgtcaaccgtgtcgtcgtcctccgctccaaagccgcctcagtcagtccgaagcagcagcttgacggcggcctcctgagtccactccaccgccggtcactgcccacatgcaccgccagatccacattgtccgctccacgccggcgagcttcgcgcaaccccggcgaggcccagggcgaagcggcgacggagcaccggcctcggcttgctcctcactgccgccacctcgaggcctccgtcaccgaggccaccgtgcccgccatgggagagggagagagaaaggggaaagaaggagcgccaccactgaggccaccgtgcgccgccgccgccaccgtgtcttcttgcaaaccgcgccaccggtggaaggagaggaaggggcgggggagttgaggcgcatgggagcctactagtgaaggagagggagagaaaggggaagaatgagcggtggtggaagaggtttcggggtggagatgatgagattggaattttttgtggtggggcccgcatgagaaaaagtttggtggggtccacctaaagtcacgccgcagtgtggaggagtttcgcactgttctttcataaatagctgtttgggctcccgtgaaacgtgcggcgcattggggtatgagactctctcgtacccaaaacacatgttcatttctgcacaatggaatagcggcaaggtttccgagcctctaaagtctaaacggcgtggctttcagaaaaaaactttctatacataatttatttaataataggaaaaggtacgaattactcccctaaactatctgaatttcccccttccttccttccttcccccccccaacgaaccacg

SEQ ID NO: 11237 - DNA, 1501 bp, Oryza sativa
tggcgggtgctgccggagccggaagagaaagacaagcaggggcggagcccaataggcctgggaggggggttcccaggcacccgggccgaagcaaaaaaaattagctattaccactatgaatccaccatacaggcaccccttgatccaaaactcaggaaccccctcgctagccttcagcccaaaatctgcaaaacgccaaggcccaacaaggcccaacatctgcacttcacaggttaatccaacgtcgatcgttgggcacggcacgcatcgtcgttccatcttccacctcttcctctctctcgactcagcgttgcggcgccgccgcctgttggccagaatcgccacgccacgccacgccacgccgtcgcccattggctaaaatagccgcgtcgtcgcgttgtgccatcgccgtgccgatttcgtctttggctgctgcacttgaatcttgattaggtgattttgccttaatattggcttgttggctagggcgagcactctaaggagagtctaagtttgtgattaccatctcctcgtggaatggctggacggcgtcgccttctccaacagcccgacatggcaagccaatgatgccaaccgggcactagagcaaatgagcagatgcaaggtccttttatcccatgtcatccttaactccttttgttttcagttaatgtagtaagtaccgacataaagcttgaaaattttcaattaatctcgaatagttttttctctatattttaatgtctggtttcaagttgaactttcaaaaattttgagtatttgaccgtactgttgtgcatagttcgaatatataactgtttgtatttgtaaatgatttcatgacttattctttacttaaaatttaagtatgatcctctctttctttattcagtcctaatggatgaatgaagacagtgatatcacattttttatgatatattttgtgatttgtgactttcttatacgattgacaaattatcaatttcacaaatatttttagctgattttataattcaggtacacaatttctgtcctttttctcaacactttcttttagtataatgccctcaatgggagaatcgatgtttaggatacacaattatctgcataatactagtgttagctcaccagccgatctcattagagatgagagtgacaaatccttaattgacacttataagagtggcaattagtaaaatatccccacgcttagaagcatcgggtaggccatcgaatcaattcttttttccaaaaagtttgatttgtatgaatgttaatttcgtgtcatatattctctattcaacttaatagatcactttataattaagcacgtcacctttacttctagtagaagaaaacaggcgaagttgtatgagccggaaaaaggcaaacggactcgcatattagccaggtagttttaacatgcaacgttgcgtgcttacacgcttgctgagctaaacctcatgctacagcttaaatgcttaatacaatgtaatcaagg

SEQ ID NO: 11238 - DNA, 1389 bp, Oryza sativa
tccccaagaagcctttgattggctgacacaatatcctgaagtgttttcataattaatgtatgcaatggctgatcacccggataaagccggaatactatctgaaatagtacaaaaagcagaccaaaacagcgtaactttagctctcggtggcgatgtaacgaaattagcacagcgtccaactatatcatttgctaaacaattaatcattgcattgctctacttattgcaacataaattaaagataaatacccctaaaggtcctgcggatggttggtataccatagacggactttggttaatgagtaaatcgacagctgatcaaattcgggcatacttattagagcaaggtatatctgcaccatcggataaccctaaattatttagtgaaatgcaatcgctcaatgttattgagtcaacacctgatgatatggcaatttggcattgcagaaaaagcagattcaggatggtgtcccccgaaaccttttactctacttaaaataaagccggaaactatttgggaaaatgttagcgatcgcccagacttctttgctggaaaagtatctattgaaactatgactactgaggcagacttaacaaacaaacctgaacaggctgtaccatcatcagatttagaaacaacaaatagtgaagtcatattagacgagactgaaaatcaagttgaagcgaaaaaaaatgaaaatatgacagattttgttttggaattatttacaccttcagagcaaacaaccaatctaagtagtaacgatactatagagatagttaaacccattcaaatgatatctgaaaatatagaaaacggtacagtaattgatttaccggaagaagaaatggttaaccccaacatcatgtcaggacaagcgtttattgaatggttaagacaaggaattgcaacaaaaagactctctataaacgtaaaaaatgccaaacttcatatcgtgaagaatcacctatttttagtaacgcctggtatttttacagattattttaatagcaagggagttagttatacaaaaaaagatattgaaagtttgcaatatgcttttcaagatttaaaattgcacaaaagatatcatctacccaataaagatagccagaacttttggaaatgttcggtaattggcccaagaaaatcctcaaaggtaggtggatatctcattaaagatactgaatatttcttcggtaaacaggttctcattgacaatctacatttaacacttatagaggagaaacagaatgataaagcctcattcgatattttacttgactcatttttttccatcgtcgtttgcgtattgacaccataaaaagctatgaaaaagcaatacaaaagctatgaaaaagcaatacggcagttaaagaaaaactgca

SEQ ID NO: 11239 - DNA, 1501 bp, Oryza sativa
gaaaaggggtatgttgagaactaaattgaattttgaggtcaaaactaagggtaaaaattcttgaaaaaatatattaactcttgataagtactctagtatttgaataaattatgaaacatatatccttcagttcaactttaggcacatttagatgtttcttcattttaccaattaggtttctaataaatttagtttgactaccttaactgctttacttgaggtagtaaaaagtttgataaaatcacgaaaccttcatagtggttatcttaggttggctaagtgacaagaggatcttcatggatgtgtgttgcttagatttgttaaatagtctctaggtttatttaacatgcatcaaccaaccaattatgaacggcataaacatcagtcaagccaataaattagacttcactacaaacaaacaagtacacaagcacacaatcactcactagttattaattctactagccagttgctaagcatgatcgggtagattatccaaagagcgaaagattaacgactatactacaacgtttcttaactaccgcttgaccatttaatttggttatatacaaagaggcttggacaaagcttagaagctaaaaagtagaagactccaaacaccagagcttcatggattatctagtattgagtcagcttggtctcttgaaacaatgttcccctcgtggaagggaaaacacaaattagccgagctacgcctcaaaagtgttgctagattttattagcaccaaaacactctctgaacgctggacgagtcatttaaaaaaatagttttcgtttatctaccaaaaaggttgtagggtcattagtctactataatgatcactaaagtttcatattaactcaaaccaatagtttgggaaaatggtttcaatttctatccatcttttttatacacaaattaaccagatgaggtttttgaacccaaatagctttaaaacatccaacttttactaaggacataccccgatttccacctaagttgattaattaaaacttccggatgttacacttttgggctttaatctctatcaattgattaaggtttttccgttattagtaataacacagagcatcttgtcaaattcataactaaatagtcgaagctccattttaacccattcaaattgtagtaaattcattaaaatgtcaagaatccactaaaattggttttttttttgctgtttcagtagctttttagcttgtatttattgtgtgccttgtttgtcatttggcaaaatttgcaacaggacaccaaaaaattgcggcctttgctgtgagacacctgaagatcatgaatcttttcttggaatatcgtaaaaaagtggtaattagatgctggacactcctcccattattttattattcccaatcaaaatggagagagaaagagttatgtaagtaccaaaatgaccttgctctctcttcttttcttttcccgtcttcttcctctcgcttgctactgagccgagcagaggcgcga

SEQ ID NO: 11240 - DNA, 726 bp, Oryza sativa
tttaaatatccatataaaccaatgttttttataccacctgaacaagctgttcagcgattatttgaacgtaaaatcgtggtactcccaagaatatgaaaaagatcaaaaaatttctaaaaaatacccaaggtgctgtcttaatagaattttgatttatttttctttatgtatttcgtcattcttattttcttgattgacgttgctattctacaggctaccgtcggtaaattacagcgcactttttattcattaaccaatgttatcaaggaaagacatatagagcgtgctggagatgaagatataaaagaagaagaactgaaacaaataacaaaattagccgctaacttaatgggagaaaaaaaagatcagattgctgttactatctataaatatggcttcaaagatattaattcatcaaagcttgatgaaaataaaaattaccaacctaggccagacataacactggatacctcaaaagaaaaaatatatccaactaacgcacaaaattgtcaatcaattaaaattgatgatattaaaaaagcctctccattaccggagaatttacgtggtaccaatcgttatgcgaccctttatcaggtaacagtttgtaaaaaaatggataatttatttaaaggcttaacattaaatagaaaagattattctaataattggttacgtgcttcttcattaggcgtcgctcgataaataatctgttattagcaaaac

SEQ ID NO: 11241 - DNA, 1501 bp, Oryza sativa
acatatgcttgatttgacactttattcgataaattcgggtaataattaagcaagttctagtcatgcctagtgcaggaaaaccccctttgttctgcaaatacaatatttgagaaaatatatatgcatgttctgttgtcaatcgctcattgctcgtcgggtagctatatatagatatttacttcctagaaaaaaatgttgctcacaaaaaaaaaaaaccctactccatagcggaccgagcagtattctgcatatatgcacattctgcctcagatataatatgagtgaattgagcacttaatttgtaatcgctcatgatcattatgcttattcaattcagactgtcgttatcggtgactaacaaagtaattaacaatacaaaatattgagctacctaaagaaaacaaactaaccatgaattggcaagaacaaacaagtaataattacttaaccatgaattggcaagaatcaaactaacaatgaattggcagatatatatctagggaagtcaactataaccgaccccagcttataatatgtacgtgtgtgcactgcgtatttactcaaaatctacgtgcacacgttcagtgtgtacatatatatatatacagtatatatagttaattagcgtcggtatatatagacaaagaacagtggtgaacgttatttcatgacgaaggttttccgtacatttctcattgaattatatacgggcaagaaggaacatgcatgcatagttaattgattaattaggtttgttgatgatatggtccagctacgaacaatctaatgaatactttggtttcggtcgtcactactagtagttagtaaatgggataaaatcgatttgatctccaggccaattgggtatttttgacaccattcaattttcaatattgttagactaatttagggtggttaaatgctccctccgtccctaaatataagagattttggttggatgtgacgtattctagtactgtgaatctagataggagcatgtccaaattcgtagtattaggatacatcccatttacccaaaatcccttatattttgggacggagggagtagatgtctatacagcagtccattaaaaaaattatattttaaaactaggtcattggaacccatatatataccagtgacaacttgttaattatctttttcctccacctctcttctaaatctctcatcccttgccttttctcttctacctcctttgtgagctaagggaggtcctaatgacaacaaacttagactgttctcagctgcctatgccacgatatatccatcgaagcatccacaaatggaggaggacgtggcaataacatatagcgagctagcaacaacgacggtggtgaaggagcccaatccctagtttctagagagttgtattcattatcgcgtcacctggcctccccacccctagcacacctctgtctcaacttcttcaagatctacctactcgaatgtagcaatgccttactcttagctaggtggcca

SEQ ID NO: 11242 - DNA, 151 bp, Oryza sativa
ccccacccccacccccacccgccggcagatccagcgaactcgccggagatcgcatcggcggcggcggcgagggtagggttctggtggtggtgctagtgtgtgtgggtgtggaagaaggggctccccgcgccgcgcgtgtgggggggacata

SEQ ID NO: 11243 - DNA, 1501 bp, Oryza sativa
accacatatctaaatataccattattattattattattattgttgtggttcaaaattaactatattgaatttgatcgtgaaattgaataggcaaaatcatccacaaatgttgcacataattattcatcctatagcaaaacattgtatggtataatgtgaatttatagataagctttaaagaaaaaccttttactatatcttatatttttcacgtactactttggggatgttgtctaattcctaatgtaactataaaaatattgtttttagattcattctcattacacttcaatatatctaaaaaaacatagttctcagctcccatcctttgcatgtattattatggactattttttagagaacattaattatataatagtgtacagaccaagtagaagtagtaaaatgcttaatcaaaatgggtagcacagtagaagcctttaaaatgacggcatcatctatagaagccttcaatttaccacaaacattaactcgctgaagaacatggtatagaaaaactattaaccacatatataatacccatactttgcaaacggaaaaataaatctgcacaaacttcaaaccatcccttaataaagtaaacaacttacattcatgtcccctaataaacttatctctcgcgccaatcaataccagctagtgcgattggatgatataaggtagctagtgggcatatctcttgccaccatttgcaacccatcgcaaagctaatatctatctcaaaaggggaaaatcatgtagtacatattatgtgccaaaaattcaaagtaatgtaaaattccaatgatttggtataattttacttatgaccaataaattctatcagtgttatagttagatatgacgtacctgtatatctgcacttgctatcactaggaatacctcatacttattcttatacaaaaatatattaattccaaaatatgggtaaaaatatagcaaggaacgaatcctgtccacctaatggactgtgtagtctgcctcgataatgataaggccttgttagtccatatcctatttgggatccccgaattctacttggataagaggtcataatctggtataaatccttgagttctactttataacaacacaatacactgccattagttcttgacaaacaaatagaaacaaacagtggtcatagttcaaagtggtaaccggaagatgagtctttatagtaaacgcctcataggcgctatacaacatggatgcatggtctaaaaggcagacatacgtggattctgtggattggtatagatcaacacatggccacaagattgtattttggttccaatatagaagatgcaattagatgaagcactaccgtcaagttagcaggatagaaatggaaatgaaaatcaaaagttgtttgaagattcagttcgcttgttaattgaagtagttcagagttcttcagagtttttcttttgaatagaagccgacagtgaggaaaacatttcgccgatttcacttaagt

SEQ ID NO: 11244 - DNA, 1501 bp, Oryza sativa
  unsure (1)..(1501): unsure at all n locations
cgtcggcgatcgcaatgggggccgctttgcccatcacaacgtcggccgcggcgaccgctacggtcgcggcggcgatggctttcatgggcatggacgtccgggcggccaccgnnnnnnnnnnnnnnnnnnnnntcctccacgctaccacaagttggactttcccaagttcgacggccgcggcgatccgctccccttcctcaaccgctgtgaacaattcttccggggccaacgcacgccggaggacaacaaagtctggctcgcctcctaccatctgctcgacggcgcgcaacagtggtacactcgccttgaacgtgaccatgaaccgccttcgtggcatcgcttctcggagttgctcaacatgcgctacggtccacctctgcactcgacgcctctgggcgagctggcagcctgccggcgaacgaccacggtggatgactacgccgagcgtttccttgacctgctcacgcgcaccggctacctctccgaggatcaacaggtacaactgtttacggttggcttgcaggaaccgatgagtttagatgtgcagatgcagcatccgacgacgctagaagaggccatgagtcttgctcgttcgttcgaacgccgcgaactcgcagcccggccaccccgcccgccacgacacgccggccgcggcatactaccacttcctccggcggccaacccccaggcgccggctccagagccggccaccgccgcctaaccggcaggcacgccaccgcgatcaaccgcaccgtccgccgcctgtcaccggaggagatggatgagcgccgacgacaaggtctctgcttcaactgtgacgagccctattcgcgcggccacaaccgattgtgccgccgattgttcttcctggagttgggggaggacgacaccgacaacgactccgccaccgaccaagcagacgcggccgccacactccggatttctctgcatgcggccaccggagttcgcgcgtccgacgccatgcacatcacggcccacctcggcgacaccgacctctacaccctcatcgactccggcttgatgcacacgttcctgtctcaggatacagcggcacgtgtcggtcgggctcctcagccccgcatgggcctcaacgtcacggtggcgaacggcgacaaggtggcgtgccccggcgtcttccccgacatgcctttacagatcgccggcgaggaattcgccacggacgtttacgtcctgactctgggtggctatgacctcgtgctgggaacacagtggctcgcgacattggggccgatcctctaggatttcacggtgctgacaatgtccttctggcaccgcgtcacgctccacgggttgccgggacaccagcgaccccgtgctctggcgtgcgctccagcggcactactggactccctcctggaggaattcgcggacgtcttcaccgagcctacaggattgccgccggcccgagaccgctcacatcgcatccagttgctgcccgggacagccccggtggcggtac

SEQ ID NO: 11245 - DNA, 1501 bp, Oryza sativa
cggcttatgatgcaagccagaaggttcaaggcttacgatgcaagcctctaccctcctccgcctataaatagggcccagaaggtccaaggcggggataaccgatcttcggtctactgcttcttcttttgtagcttgtactcaaatccagaagaaataaagcttccgctcgcttattatttctgtgttccataactctgcgtttggtttgcttgtgtgctgatcagtagaatcgactggtttctcaacattgtcaaatctgaaccttccgataatatttccaattttaatacttcaattggtaaagtcctttataattttattttccttaaccatcagacaaacggatgatctctacattcgtgggcaccgtcctggttctgggttttacggaagtaaacaatcgcgtaggccgcacgacacttcaagatagggtgcggcgcactgcggccaccgtcgatgcagatgatttggccggtgatgtatgccgctgctggcatacacaggaacgccaccagcgaccagacctcctccggcttgcctgcacgccgcatcggtgttcgtgcgatttcctcctgtacgaaatccggcgaagtcacgccttgaatatgaggattgttgccgctcttgcactgtagtagagagcatttatattcaatgggagatgaaacaaaaacgaaataattaggctcgattgcatatatagttccgataattccaatggtaaaaaactggttcaattcattgccacccgggtaaaaaagtgtgtaaattactggagcgtgtttcatatatatacatatatggctatcaattgtgcattattctttaggatatatagttcggataaactattcttcttgagtgaaaaaataacttctatctatctatctatttccatctatctatctatctatctatctattattcttcttgagtgaaaaaataacttctaaaagcactccgaaacagccatgtggcactctaattaatcagtggacccactattttaggttttcatctattagatttacacttatatgatcgacccgacattatatgtcattagatctatttttcaaaaaaaaaaaaagaaaatcacatcccctcccgtgtcgcttatgtacgtgtccgtgtacgccctccccctttttatttttgaccgggtgtacgccctcccctttgttccttttctctcctatttttatgctattttagttagatggaaatcacaattatttataatatgtttttagaaaataaaactaaatcattgtcctatacatgtatgtcgacgtttgatgtcgtgattccggtatttgcatagtatggagatcgttgatactagtatatacgcgagacttaggtaaaagacacagagacgaggatttttatacaggttcgggcccttgaattgtcaggtaataaccctacatcctgttggccgaagccggtcgttgctcttatttatcataatcacaccagtacaatatttggggtagcc

SEQ ID NO: 11246 - DNA, 1501 bp, Oryza sativa
cccccatcttgcggagccgtttcttctttcgctccccctcgggctgcggcgtcagcacggcaccctccgggcgcctgctgctggcacgcaccaccccgccccctcggggaggagatgggggaggggtaccctcctgcttcctcttctcccgggcgtcggcaggacggctgccctccgggcccccgtcgcggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcagcaaagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggctcccgtgagcccctgggatcgcagacccgcgaggcggtcaagaacggcgtcgtagccatctcccagatctacggctggctcggaagtcggaggcgcgcttcatcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattatcgcgttaggggtgaggtgcgccatctggagatcataaaactccagaatatccatgaaaaaaatagagaatggcgggaccagccccgccattgcgaaagagaggaagaagacggaccgccccgggtagtgtggcgccgggagtccctcgcctagcgcgaccacctcccggccggtggcagattccggcatgaatcggcgcggcagcccggcctgcctctcgctcacgatgcgggaaggcggcagcatgctaccgtcgagcggtgcggagccccgtgccatgacgccggcggaggaggagcttgagagcgagcgagtgcggcaagggtagggcacgggaaacgaagagttggagcgcgagtggcgaaggcaaggggaagagtggcgagaggaaggaaacgaatcccttcctcagcgtctttacacccttgccaacgctatgcccggctcctcgcttcccgcgcccactacctcgccccctcgtttctcgcgcccacgcctccactaaccccactcacccgtttgcggcgcacgcggcagatgtgtggccgtggcggttgagatggggcagatcgtgcgcgcattaactacgctcgccaaccgcgaaaagcgccatcat

SEQ ID NO: 11247 - DNA, 1501 bp, Oryza sativa
cgtatcatagaggatggcataggtaagcatgcatgttgaactataccgataacagtggactcccaccggggccaccttatgtcgaaactagatttcgtcaatactaaaagggggtggcgaacaagctatgaaagtggatgggttaggaaacaacggatttatacaggttcagcccttctcgatgataagtaataccctactcctatccgaggaaatattccaccgatcgtggtatttatctgatgatcttggatgtgattctcccctcagggcacccccgacccctccttatatgggctaaggagtcgggattacaagagagcttatcccttacgatctaagttctatatatactttacaattgtaaccgactaagactacgggatacttccttgacatagaagttaacataacacccgagtccttatctttacatattttgttactctgagttacccccgatatccagtcaggtaacgtagccctgtgggtatatggtacccataatctccacagtagcccctgagagcttcatagatgacgagacaaccttctcccgagtggtaatgatcttttgacgagtgatttcatgaagaattcgagtacttgaatcatcctcaccacaactcccgagtacctcaatcatctcaagctatgaagggctaaaaaagaaaaaaaatctaggtgcatcgactagatgcaccaaattaggtgtagccccccgactatatgattagttgaacaacctaaacatatagtcaataaaaaaataaacaaccgagtggtttataaaaaatatagtcaccaaaatgattgaatcaattagaaagcatatgcggcttaaatcctcaaaaataatcataattcattggatataccgactgcttttgatatagaaaaacatttagcctaagcataaatgctgattttaataatttacttacgtgataataacatttgatatagtaataaaaatgttgtattaaaccccacaacttttgcagcttataaagaagcccacaaaataagcataacaaagctataaactatagggtaccttttaaaattcatcgtagcaatttcctaaggaattatctaacagcggtataaaaagatatgtaacggtattgggtaattgatcacgtacaaattgccgaagcagagtttgctgaaatcccaaaggaacgtgacaaatcacaccgaaggatatgggctgaaaacactatacgggcctcggcccaacactgttttccaataccctaaataaaaccgccgaaatgaagtcatcttcctgcgctgcttcgtcttccttgcagaatcccctcacaaagcgttattcaaaccttcacgccgccagagttagggttcagatccactgcagcattcgccatccaaaaacaacaccaactgcacaaatcaactacgggcgaacccatctccatcttcccccaaacgatttagcaacaatcccccgcaaccctctcaaccaatctcacggaaa

SEQ ID NO: 11248 - DNA, 1501 bp, Oryza sativa
tttggatggcgtagtacctacagaattttgtgatagaatctacgtgattttaaaaacattattttactagatcatattattggcagaagtagtgggtttgtcccatctcgccttttttttaagctcttttctgttcacttctggactttttggctgtgtgcctacgggcagaggccggagatgtaacctatttccatcatctaaaaatggatggtacagttgaactcacactagagatgcccttataaacatataaaaaccaatttctatagatgacataccaaaattttgacgaaataattttcaatttttatgatagtagacatatagatatactctctctatcctacaatattattgtagaaggctcaaccactcgtaataaaaaaccaagaaaatgtttaatcgccttcttggttggatcaccttgactcgtgcaaacaatatgattgggaggtttgatggtataggatttaaaataaatcaattttataggattaagaggtgctagttaatgtatacatgcattatatttatgagacatgagagaaaagtggttgtgccttatattttgggaggaagggtgtataaaaaacgaggggttaattctgttggaattaatgaatgggccttagcccactcgaagattaattctttggaaaatcacaaaagcccacctcatgggatggcatgcatgtggattttagtaccaccttgcttattctaggagagggggacctccttaaaagggaggatgccctcctagccacttgaagcatgtgtggtggagagaagagggggaacacacgtgcgcgctcgctctcctggcagggcagggcagggcaggcggcgcgcgtgcacgacgtacgcgtcgaatggtccgccaaaatccggtgcgtgcaaacggcgtgcagtccggataagttacgcgcgacttatccggtacggttacgcgcagtggagatcgtgcgggcgccctgatcaagcaacccttctctatataaaccgacccgccgtcttcacgcaacacacgcaaaatcaatctagagtatgcctcctactctgtgctgcgctgtcgctcgtagattactccatcccgctcgccggcgtgcacctgcgatcaggagagtaggtctccggaacctctgccttcgacgtcctgcaccgggagaaggtggcaataaggtttttgggaagcgctttgcgcgactgctccctgttcgtccgcgacggcttatcttcctcttcgctcgcgtgctgcgtgccttcgtagacgcctgcgaaacgtctcgaccgagcagctggtctttccgccacctcggtacgtattcaatatgttgcgcatatttgatctgttcatgttatactgtgtagtttacatgtgtagatctaatgatgcgttcgtgctagttttcgtctgtaatgtcatgattcatttatgaaatagattaaatcattatatgcctataatctcaacaatccaaaaactttgattttacta

SEQ ID NO: 11249 - DNA, 1185 bp, Oryza sativa
atcaagtagccatgagcattaagcagagccatattcctacccggacggggcaaggctgaacaaacggccgaacatacgtattgttatcggggattgctaattggtgcgtgtgacctccgttgctgtcgcgcacgccagctagcacctccagcgctgtttttttttctttttgcgattttctttttttgtcattttttcttttttcgtttttttattttttttaatcttcaacccacgtattttcaaatctttgggttgaaagtttttaaatctggagtcaaaagttttcaaatcttgagttgaaaattttcaaatctgaggtaaaagttttcaaatctcaagttgaaagttttcaaatcttgagttgaaaattttcaaaatgtcttacaaatttaaattttgagttgaatattttcaaagtttgagttgaaagttttcaaaatttgactttaaagtttaaattttaagtcaaaaattttcaaatctaacttgaaagttttcaatttgttagtaaaaaaactcaaaaaaaaggaagtattctcttaattttgtcattatccttaactaagtaactaactacgttaactcccaaaaagttaactagcttttccgcgcgcgacaagggtaatccactatggattcgggtatacaaacaaaacccttctgctcgtcataacacgccatatcacacgaactgtggagattatggataccccatatctacatgacagttataatttagtcggatatacggtaccaaatatagatagaatatctttatgaggactcgggttagtttctaacttgtatgtcaaggaaatacctgagatcttagtcggttacgattgtattttatctgtaatcacatattccgttagggatatagaccgtattttgtaatacggatctcttcccctatataaggaggggtccgggttcctctcgggacaatttcttttttcccagatcatacgataaataacacactcggcgggatcatccccgaataggagtagggtattacttcttgaataagaaggcctgaacctgtataaaattccttgtctccaaacccatccactttcctagcttgatagccacccccttttattattgccgaaatcttgtttcgacagttggcgcgccaggtaggggcagcgtcaagtttttgccgactaagtgcga

SEQ ID NO: 11250 - DNA, 1501 bp, Oryza sativa
gcatggttggttccaactaaattcgaaaatgctaccttatgtacttgcaaacaaataatttgtaatactaccattactactcattcattgtacagtaaatggcctttacattacagtaaactactacagctacaaccataactaccaatagtcctaactaattaaataccttggttaaagtcacataaagctagtaatagtgattctgaaagtactcctaaacagaagcatgctcagtcataaaacaatagcgctacctctgtacaacactaactgaagagtatgagcctacatgaacatgacaacagagataagtactagagcaaaaagtatttctatctaattacttccaactaattaaatagcttcgttaaactcagcatactagtattacatgtaatcaaacggtgtgcagtacttacattaacagtagtctctaatgctacacctgttcagcatacattttgatttgctaattactaaaatgtatatgaacctatattgatgacaagaacaggaatgaaatgaacacatacctggtccatccttgtccaccactcagggcttgcaaggatgtttcccgtgaatgggcagcgcccaaggccagttgccatcgactccagccagcaccatgtttggaagcgtcggcgataagtgtccccaaagttcttcaactgagtgcggttcacaaccttctgggccttctgaactgagtgtggttcacaaccttctgggccttctggtacatcttgacctcaaggttggcgtagccttggcggtttgggcaggtgctcgtgatggttcgtgcctcgatctcttccatgtaagcctcgaggaaagcttgcagctccgcctcgttccaagtggtgtgcccagcagccatctatgaaccaaagtcatgcaagcaaaaaaatggggaataaatcacaaaatgttgggctgtaccttccgaaggtgatcggagtcgaggaggtcccaatcgagcgccacagcaacgttccccggggtgagctggcgcaccaactggcagatggcttcagggaagttcaaggcgatgcagatgacggcgcgagctacagcttgcacatcttcttcggtggtggcggtgtaagcagcgtccgaacggagagatgtgaagaaaccctcagaggattccagatctgaaggtagccccctccttctaagcaaagcgatgggcgacggaggcaaatggaggaggtgatgggtaggggatttgtcgacgatgagtttgcgcttcacgcctaccgcagccatgcccttatatagagctggatcccctttccgcaatggcgatgcaagggcgccaaatccccttcaactgtgcagcacgagatcggagatgaccggtctctgcaatggccacagcgattccggaatcgggcagctgatgccttccctctgcacgaagcgccgatgcccctgcgaacggcacctttctcctcctccgatgcaccacaccaaagtgggcttgtggatgctt

SEQ ID NO: 11251 - DNA, 1501 bp, Oryza sativa
ctcctcccaaattcgagtcctcatcccatacgcacacaatacctccattgtatgccatatggaatcttcaccaaccacgtgcattgaactctagcctaagtatcccgcaagatatctgaccgtcacaaacatcgtcttatccccaagccgactcccgatccatcaccggcaatactctcccgaggcatcaagtcacctagacatgaattaaacaaagaaaccatattccaagaccaagctatccccaacttgactcattgttaacaaacaacagtattatatatgtatagtatccatctagaagccataaacatgaaacaatcacggatatccaaacaaacaacccgaaatcgaaactgacatggagtcggccagtcagaccgcgggctggccggtctgaccgctcaatcaacgccggtctaaccggcacacacagcccggtctgattggaccaaatcacagacaacagttcttgtagatcacccgtaaaatccaatcatctccaaaaccacttcaaaaataaattccaaatatcaaaaccaataatcttcgatgccaattgttcatcacagaataacaatcaaaaacactttgattttacaaggagatgacagacgccacccttgctaggagcaacatggattcagggtgaggaggaaacatccctacgctcaccgacgtcgccggcatgacaagcttgcgaccgctgctggattttcttgtgccatgtcgagctgcttctgaactgtcgtctccgagacctcgccgtcactgtcggatctgcttgcaccgcccctagatctgtagtcgatgttaccagcgctgccgctcacttcatcgccgaccctcattccgccactcctgctgctgctcgcaccctcgtcggcgttgttttttccatggttgacacggctgccgccgctgcttgatggactctaccgccaccgccgttgttcctcctccgctgatgggtggccaaccaccatgagaaagaagataggaacagagaaagagatatgtgagactgactagtggacccatgggcaaacctgtctaaaacaaatgtttctctctccatttccttcaaaaataataaaatagcgcagtggatgtccagcaactaattaccagttttttatgctgccctcctgcaaaaacatgttcttacggtgtccccagctaattacgtattttttttatgtcctgtagcaaattttgccaaaaaaaaactactctcatctctactactacctccatcccaaaatataaaaaactagaatcgaatgagatatttcctaatactactaatttggataggtggcagattcatatttcttgtaaatgttccatccgatcgattctatgttcttatattttgactcattcaatcgtatgttatattttatgatagaagtacttgtaaatgatagaagtacttaattaaagtggagattcattctccttccatccccttcttccactaaacgtacacgcttagcgt

SEQ ID NO: 11252 - DNA, 1501 bp, Oryza sativa
cacaaagtagccacgagagctcgccggcacggcagcgccccagtcagcacctgcagcgtgccctcagctcgaacaacaacggccgcggcgagcctgcaacatgacgctggcgtgcgccgcaatgcagcggagtagagtagggaggggatgaggtcccatgggcatttcggtcacaccgcgtaaaaaatcaggcccgctagcgcctcgtcagcacggaaattatattttagtcggtgcggtgtccactggcaaaataccatgattatggagtgtttttccccaaaagttagtttttgcggtgttttagagctaaaccacacaataacagtgtcctgtagtaaaatttcccttgattcaagtgtaggaatttttagtacaggattaaaatccttcaatttttttaacgttttttctataataaaaggggtctacaaatggagataataatgtgtacaattatatactcccaatctaaacaatattttcaaatactactttagtatatgagatgcagcttatctggactctgcagaaccgagcattgaaggatgggccaccacaagagttgtgtacttgtcacacaagtgccagttgcaggcagggtttaacttaccgccggtaaccgcacggttaccgcggttaccgggcttaccgcgggggtacggtaatataaataccgcggtaacctccttaaatacaaataaatttaaaaaataatttgaatttttgataaattttgcacggttttgtacggtttttcacggttaccgcggttaccgcgcggtaaccgtgcttactgccggggcgcggtaaccccggccccggcggtaaggtaaaccctggttgcaggtaggcgagtttaaggagtaaactatgccggagaagccacccgtactgttttcgtttttaattttacacagctccccttacctagatcgaatgggatttttcgtcctactccctccaaaaaaaaagaagaagaagctaacacattatctactaggttgacttttttttctttttatggagggagtgatcagacctaactaaattaaggatagcttattagagtgattaagtaaatagggatgtgctataagtgttattgaggaataaataatcaaatcatgtggttacatataggtacgctaagcgtgtacgtttagtggaagaaggggatggaaggagaatgaatctccactttaattaagtacttctatcatttacaagtacttctatcataaaatataacatacgattgaatgagtcaaaatataagaacatagaatcgatcggatggaacatttacaagaaatatgaatctgccacctatccaaattagtagtattaggaaatatctcattcgattctagttttttatattttgggatggaggtagtagtagagatgagagtagtttttttttggcaaaatttgctacaggacataaaaaaaatacgtaattagctggggacaccgtaagaacatgtttttgcaggag

SEQ ID NO: 11253 - DNA, 1501 bp, Oryza sativa
tgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccattttgggggttttgaatagagggggaggtgtgtgtccaattccaacaaaagccaaccattccaaagtatccaagtgatatgaatattcccaaagtctaaagttataaaaccacctaatgttgcctaattaatcagcgaagcatctacctaaattcatactagtggaaccatgaatagagtacccactagttggggttttgtttaatctagggtgaacaaggtaataatatcaatagcaataatattaaggtcataacaaaggtaaataggcatggccaaataaaacagtgataacgcgggattttaaataaagcgataatgcaataatttaaatcaaaataattttataaactgggattcaatatgttcaaggatgatgtgacttgccttgctccgggagaacggccttccgaaccttcggcgacgaccacgaaccacgcttcgggaacctccggaacgacgaaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttgcggattattgtaattaggttttgcaactataaaacatgtggaagcgctagcctggaaaagacaggaaggctgcgttgttgacatgcggaccccacatgtcaacctaaaggaccacggtagaccgagtacacagagacggtccacgggtcgacggaagcggaccccatgtgtcaaccgaggcgagtggccaacaaacggactccactagacaccacacgggctgcacatgtggaaaccatgctgctactgagcggacacactaacacggacaccacacggtcaccacccgcacacgtgaacgactaccgacaccggtacacgggtaccggggtcgacaaccgcacaacgggtacggggcgacaccgaaaggacgagggcggggcagcaagaggagagaccttaccaccacgcgacgaggcgtgagaacgacaacgacgaacgggcgcggcggagacggacggcgagggaacgacttcggcggcgatccttgaacgaaggcgagacacggccggcacgaggcttgacgacgcggaggcgaggacgaagacgacgacggctacagcgaccttgacgaaacaccgaggacggacgagaacggcttgacagagggacgaacgccacgacgaccgggaacgacgggaggacgacgacgacgacgaccgggaccggcgaggagacgacgagggcagccgg

SEQ ID NO: 11254 - DNA, 791 bp, Oryza sativa
ttgtttaaatataaacactggtactaaaatttgatcagtcaatgctaggtctaaggcttgtgaaaaaaattacaaaacttgctttgcgcaaaagaaccatagccatcctttgaaatacccctatcatgtgcattgttgatgtggtggcttgctgagtacggttggtactcacccttgcaaatataaacttaatcagaggccggagatgaagcttcggaggatccctatgcctattaccaggagggtgatgaagacgatgacgctcaataggtcttagttacggtcattgcctatggcaatggcatgccgctgccttaattccgctgccttatctatttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctggatga

SEQ ID NO: 11255 - DNA, 200 bp, Oryza sativa
aaacgaaacggagggagtatttcataatgaatctattgttattcttttctataaattcagtcaaacttagtttcacttgtgacaaacagagaattccctgtattttcggatggaaggagtcaaagagtacatggcattatcatccaaccgaaacttaattaacgccttgttagttaccccttgttatttaccgatagacg

SEQ ID NO: 11256 - DNA, 1501 bp, Oryza sativa; identical to SEQ ID NO: 10065

SEQ ID NO: 11257 - DNA, 1501 bp, Oryza sativa
ccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctctcgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgagcgtcaactgttcgggacagaggtattagcggaagcagaagagaaagtcagaatcatcagggaaaggttgaggattgcccagtctcgacagaagagctacgcggataaccgccgaagggagctcacttttgaggcaggagattacgtgtatcttcgtgtcactccgctccggggagtacaccgttttcagacgaaaggcaagttggcaccacgcttcgtgggaccatacaaaatcttggaacgaaggggagaagttgcttatcagttagaacttccatccaatatgatcggtatccatgacgtgttccacgtgtcccaattaaagaagtgcttaagggtacctgaagaacaggctgattcgaaacacattgatatccaggaggacctaacatacgtggagaagccgattcgtatacttgataccagcgaaagaagaaccagaaacaaggtcaacaggttttgccgagttcagtggagtcatcattcagaagaggaagcaacctgggaaagggaggatgagttgaaagccgcccatccgcacctcttcaccagctcctccgaatctcggggccgagattccgtttaaggggggtaggtttgtcacaccccgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccggccgcctccctcctctccccggggtcgccgacaggtggggcccacctgtcgggcccttccccaacctccggccactcgcccacgtcgcccatccgaccgccaccccgcctcctccggtccacatcggccacgcccgtgcgtgcgccgcgcctcccgcacccactccccctctctctctcgccgggccctcaaccgaga

SEQ ID NO: 11258 - DNA, 295 bp, Oryza sativa
gggggggcgcctccggatcttgcctccggcgccggagccgccgtcgtaggctccccgggaggccatgggacggcgccgatgtggaggggaaggcggggttagggtatcggggatcgcgcgctcgcggagggctagggttttgggagaggcgaacgaataaccgggggaagaagagccccgtggggggacggagggggggtggggtgggatggtgattacaaggagtttcaagggggttaagtggtaaacgttttttaagggctcttccttcctgacggcttcgtactttcgtagg

SEQ ID NO: 11259 - DNA, 934 bp, Oryza sativa
catatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactaacccgctcctccccccgcccacaccactccattttcttcctcatctccggtctgcaaaacggtagttaaacaacggggatatgttcgccgcgaaatcaaaccggggaagaatgtacatggcgacgaggagcgccgccgccaggctgctctcctcctcctccgccgccgccgccgcctctcccctttggtccagacgccggcgccgccatccattcctccatccgccctcccgctccaagaccacctcctcctcctccagcagcagcaagcctcctcgccgcccaccgcctcgcaaggacggcggcgggccgcgcccgtgcctcttccaagaactctccggtctcgtcgccccatccgccagcgatgaccccgcgtttcagcctcggcgagatgggcaggagcggtgtggcctcctcggccatgacactgcgcagtgcgcggaaggtgctcgacgaattacccctgagggagcggctgcggcttctggttctttcaccggtagcgttccgaacaatgacgctcttgggttccttcctgatggtgggattgggcctcgtagcactgcaacaggcggtgctccggacagtgagcaatctatccaggaggtgggcgatggaaatgctggagatgttgagaatatcagtgaggttgtgcatagggtaacagaagttttgcgggcagaggtgcctggattg

SEQ ID NO: 11260 - DNA, 791 bp, Oryza sativa
tataagggataaaaatccaagctttccatttttagacacgttcaaagaatgagaaagatcattaagtaaatcaggagctttaagttatccctatgatgatttctatactagtgtaacatgttaggaaacgataggcaaacaaacgataaagaacaatagatcaatcacagaagacacgagattttaacgtggaaaaccctcccaaagcaggagagaaaaaaaccacgggcgctagccagcaaaatatcttcactatatctagggtgaggttacatcgctgcacggcggcttacaagaggtatatatatggtggaaccctaaaagggatgacgatccgtaccgtgggggctctgcccccgcacccccgggcgtccccaggtgcacgggcctccgctccactacggcgaagcaggtctttatcaaatgtaaataaatttggattacaactcaacataacattcttacatgtagcatgaaaaatacacaagcatgcatatctttttaagataaaggatagaaatccgaacagctagcctctgtatctgcaagtaaacagaagcatccacatatatatgtgtcaagtccagaagctagagcttgacgtacaacaggcacgttgagacgacgtacatcacaggggttgatagataattaagtgcagttcttgcggcaggagtcgccgcagctcgtcaagcattcctgcctcagcgcctgaaggcagctctggcaagcctccggcgagcagccgtcgcactgcggggcgcacgccctggggatagtgtctgcgtaga

SEQ ID NO: 11261 - DNA, 1501 bp, Oryza sativa
aatctcagccgttggatagtcacgtggacggaagcagattggcctttcgggaaggaataagtcgactctaactccctcaatataggtccgatttaatttgtatcctcgactgcaatactagatatgttgatccccaactacttaaaaactggtgtagtttggctttctggactgttttgacagtggttttcattggtcgattggcgtggctagttaacttggtcaaaatagtcgagtcaccatgtggggcccacatgtcaatgtttcctcctctcttaatatggttttaacagttggagtcattatatttgattttgccgttgagggatagatccgatgtatatttaagggactcaatgcagacttattcctttcgggagtactagtacatgcgcttgggcctgggctaagtgcttttcaattgggtattggaccatatttctggcccaataggaataactgccatctcaggctctcggctgcacggcccattgattggggaaatatgggcttcggccatcttttttcgaacacacaaaaatttatcatgtcatactagtaggaaaaggagtacatctgacattcgtcggaaatgggacaaatccaaaaatgtaaaggaaagctagcagcgaaaaaggactagacggcgaacagtactcataataggcttcgtccatcacttttgcaattttgaggtaaatttctcaatccttttgaaacgcaaaataacatgatttaaacgtattgaaatcaaaatattgtatggttgtgtcgtatcgcatgtgcatccgaacgccagactcgttagttctccagaaattcttacaaacaaaagtattgactccagacctcacccttcatatgccgtaaaaatggttttgtttgtaaaaatggcagcaaaattgtagaaaaagagcttcatgcgcgtaagaatgtcagaattgcactctgtatcacccgcttacgcataacgtaagtcgaaagctgagacagagcatcactgatgctggactcaataacttctttggatcactcaagagtctgatctcatcacacgaacattcaaactgtaatctcaaatttccggataaaatcatagctctatagtctatactagtaataagtacggtcatgtaaatttcgttgcaagagccaagaggtgcatggctacatagtttttgttcagtgaagttgttcttctataatactcagaaaagtaccaagtggttcttataaaactttttttttattatgtcccgttctgaaaagtaacactccttccatctttttctcaaaaaaaaaagagaaaaatatctactaagtcttgacagccaaagtcatggtttggcgatcaaggcaacgactaggattaggaagcttcgtgtcaaccgattaattatctaattaattaattagcccatctgcttacttaaacgaaacaaccgtgtttaattaggcactaagcgtaggcacactgaagaagtaaccatgtccgggcacg

SEQ ID NO: 11262 - DNA, 1501 bp, Oryza sativa
ttacaactaatattaatgtgttttacttcttttaattttcattttagtttgttttctattatttaagattaactatcactatattttccttctcaactattttataaaaccttctttagcaaaataaactaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctctgatttctatataatcaccaaaataaatttactagaaattttggcatgacctcccctcttttttgaagaaaaattgaagcttgctcgggcagttggaggaggaagaagacatatatatataggggtaggactttagtcccggttggtaacaccaaccgggactaaagctatgatctttagtctcggttggtgttaccaaccaggactaaagatcccggggggggggggggggcttgataggccttgacagcatttgaatcgggatctttagtcccggttggtgttaccaaccgggactaaagatcaaatatgcccgttaccctttttaaccgggactaaagatcatctttagtgatctttagccccggtttttattgcaaccgggactattgtggaattcggccgaccgacgaaagatggtttctccaccagtgagcagacgactccatttataggcagcaaacgagagttcgatgccactatattgctactagctacttattctatcaccaatttgcatgtggaagtaacatgcatcatggatggtaggctttggtttaggagtaaagaatctcacagaattgtgtttcgattcattcctcatgaccccatgcatgtagtttaagctagatcttttgattcatttaagccaacatgtctgctgatctgctctgacttttggatagtccatgccagtgaagcttgggaactagatatagttttatgattacacatagctagcgcactactggagagatgggcatctctgccggttcgcaaccccctttactcccgggtaatgaaccgagacgtccaattcgggactaaagatacccatctttagtcccggatgaaataacccagagtaaaaatggatctttagtccccgggactaaagattctagcgccattttagtccggtttcctttttttgtttttattcttgcatttattatcaccctcaaatccccacaaatcatccccaaatcacacaaatcacccccaaatcatgcacaacaagtcatccccaaatcatgcacaattctcagcccatccacgaaatcatccacaatccacaagtcattcagaaatcatgcacaacaaatcatcctcaaatctaaaataaactacaacaaaaattacaaatcattcaaaaaaaaatcagaaaacacgccaccgccggccacccggccgtgtgccgcctcccggcctccgc

SEQ ID NO: 11263 - DNA, 771 bp, Oryza sativa
gaggaggacgctgggtcagtgcaggcgccgctgcagccacccatcccaccggcgcacgacgagttgcagtactggtcacacttgctgcagatcatatgcaccaccgcgggctctggtaacaatacagcactaccagcacaacgcacacgacgggtacaacgactacatcaacagggaagacaaccatcatatgggctttgtaacgttatttggataatggcaagaacaggaattaagatgtgagatgtcataggcaaaatatcaggcaattccgctatttatagctaggcgactgatgctcaagcttgctaatatatgcacttgtatatatctgtgtgtatcgatcactggatattgcgtgcaggtaacatgcactgaatacgtcgtttatcatatctctgtattgacttcaaagatggagggtggtatgacataatatattagttcattcaaactatgtgccgttattcctcttgtgcttgtaaggtcaaatatagcttctgatttagttaaacacacacatatataaatcacctgagacaacgtcattaaataattttctccatgcagtttgtacgtaccaaattaagtaaaatggcccagcaactagcttagccagcagtgcagcacaaggattttaattaatcatatccatgatgcatgtgatatatattctccttgcattgcaagtctaaatgcaatgagtcaagtcaactccgatacattcatgttgatctccattacaataacagatatacgattacagtcagg

SEQ ID NO: 11264 - DNA, 1501 bp, Oryza sativa
aaacgtttgtaggaaatttaatggacttttagtatataatagaatagatatattgataagtgaagagtactgtagggataaaacttatcaattgaactatggattagaatataggtaaaaaagtataaattgattagatttgtgacaaagttaaattttaggagttcatttattttggaaagaagggagcaagtctctacgtttcagcaagaagacactataacttttggatgggccatgacaggaaaactagtcatgtagccaggcttgtggctttatgggtatttttgttttttgttttttataatttctctattcaattgggcagaatatgttccgtaattattcatgacatgcttttatgataccagtcagtaaattgcataaacttttgtcatttggcaaattttgtcagagaacgaaggaggggaggccgatgactggcggcgaggcaatctaaggtcaaagggaacgagacgatcgaaaccatcgaggtcaaagggcacgagaccatagaagccactactaaacttttagcattaattagagctggaatacagactataatctataaatatattttaaagaataaaataagagagaagagcagtggtgttactgatctgtagccagctacagcacggacttcaagacgtaatgtgtatatgacaggtgggaccagatattaatagtgtagtaaacaactatagtatgaattggctattacattggctataaatgatttggagctagtagttagctatactattaaacttgctcttaattggctgtgggaaactggcaagcgatggatgggccttgccagcttgggcatgaatatttctggtcagcaaaaaccaaaactgttactctctccgtcccaaagaaacttaattaggaggagatttgacctctcctaaaataatgaatctggatagagggtctgtccagatccattatcctaagaggggtcacatcttctcctaggttgagttttttttgggacgaagagagtacaccataccgaagtttgcaaaattaaaagagaacacaaaactaatcatcgcacttagccaaagcccaaagatattgtaagttttgctataaagtattttactttctcaataacaataaagaaatacattttattacacaaagtcctaacactataaaaaaggatgattatacttgttaggaatcggacataggtgttggattttttgaccggtaccctgcagcggtacctttgaggtttcaggaatgaaaaaaaaatgccagctcaatgcatcgccacgaatcaagctgatgcattgaatagctccccatcaccactgagatcatcatcactcccatcacccaagaacacaaccacagaatcgacattcaaaaacaaaatcaacatatgacaccatccccaaagtaaatagagagagaatcaaaatcaactaagaagaacacacagagaataccactgtcaccgctgctaccattgttgaacagg

SEQ ID NO: 11265 - DNA, 247 bp, Oryza sativa
tgtaacatccacaacaaatgagagatttatttgttgtaatctccacaacaaataatagattcaatgtgtggtaaccttcacaacaaatgagagatttatttgtgtggtaatggagatctctctatatataacgcaaggcagaggctctcaaagatcgaatcttcctcctgctgctgttcctacgtgatactctccttcagttcctgcgctatctctctgtttccccggttctgttcatcccgcgcac

SEQ ID NO: 11266 - DNA, 1082 bp, Oryza sativa
cattaggtaataatgtgtctctagtactaaatcacgcgtaccagcatgtacagatatatgctcaattggttgttataagtaccttcaaaacaaaagatgatcgaaatgccaaattgatcatagtagcaaacaaaagagattagggtcagaggagatagcaaacatggagattaatgcttcttcaggttctaattgcttttctgttgcactattgcttaactcctcctgtggatcttcctcatcctcaccaacctcttcttcttaacccaatagcatgtttagtttgattttacactaatgcaagctctgccaatttgtttttataatcagcgatatatcttcgataaagtgctaagaaaagaacaagtaaactattgcatggtcttgtgaagctgtctttcgggtccaacttaactatattggtaggtctgactatctgtctttacctgctatcgatgtaaaactgccctatgtggcagctctggtcctccctttacattaccagtaggtaatttgtctagtgcctgtaccctttcttttgatagaggagtcagtgtaagccaatgcttaggtcttcacctccagccaatcagaatctgaagtcagcggggtattccaatatagctacttctaaggaggttccctagcactcagaaaccctgggggccaggcagtgaaacgttccgcagactgctcacccggccacacctcggagccgatgaaggctggcaatacaagcatcatctgtccaacagcctacttctcatccgtaaacatcacagttcgttagtgcaagcgggaatgagaacaccactatcttagaagaaattagtagaacttagttcagaatgtacaaatgtatgctagatactctcactacgattccagattagaaccggaatagttaaccaatggaataggtgtaggcggtttgatcgtttccttttctccgatcataaataacctgatctctttctttgtctttcatcaaataagtacaagaattgcatagatgaggattcggtattgatcgctaaaatgcgagaaaaagacccacgtttctctgttcgtccgctgtcaga

SEQ ID NO: 11267 - DNA, 546 bp, Oryza sativa
aggccttccggggctcactgtgagagcctttatctttatcccgcgatatggtttctgatctttccgtgtatttagtcttgaccatttgtatttactcattgaaaggattgacaaatgagtactcgggttataaatatttcatgtttagtataagatttggacaaggttttaaaaactttaaacatcaatattttctcaaatgcttagtttaaagaaatgtatgggtatatttgcctttaaaagtaatattatacatagatttttcgtatagtagtaacttttatcccaaacaatgaccggaggaagtatgtatttataattgggtatctaagtaatattcaggagagtggattcataattagtttatcatatattaatctatcttattaatttcttgataaccatttaagtgatatgtaaataatgatagcatcccctcggtctctcgagagtttagaatagtttgccaatattcagtacaagatcttttactctagtcaagtagtactttatatgtgattatttttttaattttttcaagtatga

SEQ ID NO: 11268 - DNA, 1451 bp, Oryza sativa
  unsure (1)..(1451): unsure at all n locations
ttgttctctgtaactcgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcccgaagcatcggaccaatgatcacccatgacttctgtgtaccactagtgccacaaaggcctttggtggtcttattggcgcataccacggtggggtcttcnnnnnnnnnnnnnnnnnnnnnnnnnnnnnnnnnnnnnnnnnnnnnnnnnnntgaatccttcgtgatggaaatgccctcgcctacttgactaaactaaggacctcaacggaagcttatgtagattttctacttttccattttccttcttgtttatcaatcaccaatcaagacaaaccgggcactacggtgagacgtgaaaacacccgatcctattccgacctcgatatatatgtggaatcgtcttgcgccatatgtactgaaattgttcgggagacatggtcaaagcccggggtaaggctaaaggagatttcttgaagccaacatccagccttagtggcccctctctgataaggttttaaagttttcaaaacgaaaatcaaatgatccgaaaatcgtataaaaatgtgtggttccaaatgcgctaacgcgcaacagctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacaagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgtattgaacattggttttttcctgtcaataatatccgttaaaaagaagagagagagagagagagagagactgccatcgccatctctctctctgtcatgtcaaatcgagattgtgtgggtgttcggtatcacaatccctgtattctaggttctggctggttagagcagaggactcgaaatcctctttagctttgcgcgttggactctaaatcctaacagagtggttcgattccacctcagaacgaccttcacgaaagtg

SEQ ID NO: 11269 - DNA, 350 bp, Oryza sativa
  unsure (1)..(350): unsure at all n locations
agaaaatctacataagcttccgttgaggtccttagtttagtcaagtaggcgagggcatttccatcacgaaggattcannnnnnnnnnnnnnnnnnnnnnnnnnnnnnnnnnnnnnnnnnnnnnnnnnngaagaccccaccgtggtatgcgccaataagaccaccaaaggcctttgtggcactagtggtacacagaagtcatgggtgatcattggtccgatgcttcgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccgagttacagagaacaa

SEQ ID NO: 11270 - DNA, 385 bp, Oryza sativa
tttccgggcaaaaaaggccccagccaaaaacttttataagttttgttaaccaggaaacaaaaccctttttaattggatttaaccccatttatttgatttctgaaactttaaagggcttattggagcccggataaattagtattattttttaaaaatatttgtgttttttccattaaaagaaaaccctttaactatttattggccaaaaatccccccagggcttaggtaagcaagggtggggaggcccccaaaatcgggcccctgttggtaacgggtacaaggggaaaaggaggggttctggcaggcggggccctcggggcagttgcacaagccgggaggggcgcggctggtggttgggctcggcttcaagccggccggccggtta

SEQ ID NO: 11271 - DNA, 915 bp, Oryza sativa
ttgtagggtgtaacactatagattgtcacatctgtgctctgcattataccttctacgtgtgtgtattcagtttagatttgattgtatacactgcattacctaaataacaataaacaacacaaatgcaagtgattgacatcgcatcactacaggcgaattctagctcggtacccatcccgcgaaccggtccttaatcgccatgggcacgtctagcaaaaccatgcacccacagcccaccatgtagtgtattttaattaggcaacaccattgcggtggcactaatccaaagctattgccaataatcaagtctatgctttaatgtggtccccttttgtgcactagttgaactaagcatggctaagcatctcctaaaccaacatctagtcattttaatacccaagttatcaatggcataagggaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgcgaaaccacgaatcgacgaaacgggcgaaatctacgcgacaaacaaagcacacaagcaaaacatgctataagactactgaaacaggaagcaaaaccatttttaatggattctacacatttttatgaatttactgagacttgaatgggattaatcggagctcggatgaattagttatgaattttagaagattcactgtgtttattactataaaagaaaaacccttaatcaatttattgcgcaataattcatcccagggctgacgtcagcaaggggtggggcggcgccgacatgcgggacccacgggacagaggcacaggagagagggagagggg

SEQ ID NO: 11272 - DNA, 1501 bp, Oryza sativa
taggaatacaatttcgaaacgactgaaattgaaaataaaaaataaattaaaagaacacaatacgatatattagttaaaattcgaaataaaaaataaaataaaatctgaaattagaaaaagaaaaaaaagatttcaactagaaatataatttataaataattttataaataactaaattggtgataaaaaataaaaactattgaaagaaaagaccatctcaaacacatgaggagattaattaagtaaaaggcctataaaggagtagagtggcggcggttgatggaacatctaaaaactattaataaaacaccagatagaatcctaatgacgattaaaaggaaggatgacgggcaggtcgtgaagcaaccggtcaaggcggttggtaggacttctagaaattaaaaaaaataaaccctaataataatcaatttgatttttaaaatcttaatgacaacaaaaaggagagacagcgggcgggtcgtacaagagtataatgctagcgccgccgattgttggtgggacttttaggaagtaaaaaataaattccaaagatgtgtatgttcgatttttagaatcccaataataataaagagtagggggtggacgggtcgtagaggagtatagtgacaacatttgacgggatttctaaaaactatcaaaaacgaaatccaacgagacaataaattataaaaactataaggttcaattttaaaaggttcgcacttctaaaaagtaaaaaacaaataaactccaatgataatcatgtttgattttaaaatctcaatgacaataaagaaggaaggcagtgggcaagccgtagaggagtatgctaacaaaaccactgacgttttgtcggaacttctagaaagtaaaaaatgaaccctaacaataattatgttcgattttgaaaatatcaatgacaataaagagaagaggcaatggagatgccatagaggagtataatgacagtgtttgttgggacttctagaaattataaaaacgaaacccatgaggacaataaactctaaaaagtataagatctaatttttaaaggtttccaaagagaatgaataaaaaccatgtagatcgagccagcaaataaagaaggatatgacataagtaaatgatagcaattgatgtgatttttaaaaattataaaattagaaacaaggggatgataaggtttggtctttaaagtctcaaaacaacgagataactatttaataaattaataaattttaagtaaaatcatattaaaaataccaacagctagtttgaagaagagggagagagatggaggtggacgcgagcgagagtctcccttgcgccacgtttctcgcgtccgttcttctccgagccgcgtcaaacaaaaccaaacaccaccgtgcgagctctctctctctctcccctcccccctcctcctctttctctctcctccccttctcctctctctctccttccgctgattccgtcaccgcctctctcccgccgcccacgcggg

SEQ ID NO: 11273 - DNA, 1501 bp, Oryza sativa
ggcccaaccaacccacctgaactacagtgcattgagtcgatttattaagggtgagactaatcacggtgaatctggtcgatcgcccataaccgtgggtgcggctattcgaatagttttactctggccagaggtgcacaactgtacccacaaaacacaatccaccggcatgtcaccgtgcctacgcagacacgttaccatgtcgagtgattgtgataagacccttcatataactcttccctaaccaaccacaccatgctaaggtttcacccccaccccctaccccggaggtgggcagtcccctcgtgcgccacggtgaatccggcagctggacaaccggacaccccggccgatccaactccataacgcccaccctcgccaccggtgcctaggaaagggtcgagctatactacagatcatgcaattacccattcccgcttgtggtaagcactgcaagtcttctagggtttcccgtgaaccggtccttaactgccatgggtgcgactagcaaaaccatgcatccactgctcaccattcagtcacattttagttggataattatgaccaatgaaacatggtcggatgtctcgagcacgcagctcatcatgatactagatgtcaaatagtgtaattatcccattttgtgagctagtggtaattaagcatggctaagcatatataattctagctagatcaacataagtatcatgagctagataaactatcatccattggttgacaaaggacggtaacaagtaaacatggcacaagcgagtagattggtaaacccataatcccatgtaattagcaaaacatgcatatttatttgcaaacggtaaaacatttataaattgggatcaacatgctcaaggggaaatgtgtgacttgccttgcttctttgaaagaatcttccgaacacttttcctcgcgaccgcgatctttcgaaacggcggaaactacacactggcatgcaaaatgagaaaaaaaaactctaataaaaaccaagaaaacagtacataaaaagtaaacaaacatgtagagctcaattttagatgaattctgcaagttgaatggcccaatttggacttagtatgaattagatatgaattttaaaagttttcagccatttaaatcaatttctataattattaccgatttatgacacaattattaatggtttatgacgtcaccgaggggaataggtggcgccgacaagcgggccccacctgtcggtggctcaaagggacgggtgcacggtggaccgagtccacacgcgcgccatccgcgggtgcaccacgtggtggccacggtggaccggcgggcaaggtggcaaggacgtgtcgccgaggtggcacctgcgtgggacggcaccacgacggccacgtggaggcctggattcacccaatccaacggcgcggtgtggctgccaggcacagcgcggtgtggctgccgggctcggcacggcttcaagccggccggccggccagggagcggcggcgcacgg

SEQ ID NO: 11274 - DNA, 1501 bp, Oryza sativa
cgtgctaacggaaaacaagggaaaagctccatccagatgctacatcgaccgcagccttagttgacatgatctagttgaagagttgcatacttgcaatcattagatacagaaccttgttctatattgttctgtattagtcgtggcttgtaaggaccttgggtagtgtaatgggattaatctcatagaggttgtagccagtgtccaaatgtggcaccactacaagattaagcagaatggggaagaaactttaagagaaaattccctgtgtacccctgaaactttctctaatcctgtccatgccccaaaattttgctcattcccttgtatacctctaaattttagtttggatcccttccataccctttttgttagttgaccgtgagttgatcgttaaattcctatcaagtagtccattttgccctttggtatgaacaaacatataaaattatggagtatattgttcaagggtagaaatttgctatatgagactattatctcaatgagtttgttatgcgagatattattaatcataaaatttatttatagatatgaaacaaaaaattaatattaatttattatttattaaaaaatatttatgtataaatagatttgtcttatacaacaaatatgttgtacaatactatctacaaaataagctacacatacaatgtttaattattaaaaaataaatattaatttttatgtcatatctaaaaataaactgtcataaataatatcttgcattagaaactcataaatataaaagtctcatacaacaattttctaatactccattaatatatatgtttttcataccatagggcaaaatggactttttcataagaatttaacggttaactaactgtcaactaacagaaagggtatggaagggatccaaactaaaattcgggggtatacaaggaaatgagaaaaattcaggggcatggaagggattgggcaaagttttaggagtacactaggaattttctcaacgtttaagcagtgtgttatatgcaattatgcatcatataccactccaatagagttaggcatagagcagattttggaagctaggatgctagtatgttacaatgtattacttgtggcaatcaatttttcatgaaggaatacattttttctgtcaaatattttcgtcagtattttttttccctgaaaatctatactttcctggcacgatcttgagttgaatttaattgattgcctacctcatgccattggcaattggcacttcgttgctcatccccctgtagctattctggagcatttttctatttttgcgataacaaatgcattatgcaccctgctacattttttcaatttttttcatctcatgcttggaactatgctcttcagggcatagagcactgtttatcctggatgggatcacatttcccatccccacaaggtattattccattggttggattttcttttatgctttcttgctatgccacatcatcgttatacccatacccacttc

SEQ ID NO: 11275 - DNA, 1001 bp, Oryza sativa
caaatattgtattatcctaggcggatgtcttaaagctacacctgtgaagttatattttcgtagacggcaccttatgctgtctgctctatataattcacacaaagttggtctctccaataacaagcaaaatatagggggaggttttgaactcaaaattttcggtggatttttcttcagtggttagatccatacatttcctctcttatgattttcttttatttttgtaggtattaattgtgatggatctatgcatgaaaaatagtgaaagcaccatgtgcaattttttttcttttatgcttttctatgctatgattgtgatggatctatgtatacaccttgatgccatgttgttctatcattcccttgtggttaaatgtgatgctttcattattaaaattatatgtataatattgcccacttcccaatcacctagatctagataggagagagagagagaatatgtattttccccactcaccacatagtagaaaaactatatctatgttatatttatagatcaccatcccctaattatttatatttttcattcccatagtaagcaaagttaagtttgtttataaatatgtaattttttcagaaaatttagtttttttaatataattgtaaacacaatatttttagagatatggacagaaaatggccatgaaatataattgatacatggatttttgaagggctacatgaaatggatccatcatggcgagcgacaagtggatcctgatgacaaagaagatcggctggatgtcaatcacacatggaggatgctgatggtgatagttgtggtgataatatcattgagttagaggaaatgctacattgtgtagaacctgaggtgctaatggggtcagctaggggtttagacaattttgaagctttacagaaggcaacgaaggatcttgtgtacgatgagccaaagagttgtgacagggagttctcaacattatgatcagtgcttgaacttataaggttgaaggccatat

SEQ ID NO: 11276 - DNA, 245 bp, Oryza sativa; identical to SEQ ID NO: 8733

SEQ ID NO: 11277 - DNA, 1501 bp, Oryza sativa
tgaaataggcgcaaatgaatgttaatatgcattttgtattatcccctctgtttctgtttacttgctgctgtctaacgaattacattcctacccttgtaaatcacacatattgctattatcattaaaattcacacatactaatcatctttccccaaaacaagcattaaaattcattatgagaagtactagtgctagtatgattacatttttaagaagattaggaggataaagacatgtcaaaaacaagtctacaaatccttttatgtctttgtaactcactataattatgctggattggggagaaacgcttctaacaagtgctctggagatgtaggctacaagtgaacctgtgagaggtctatggatggaagcgcgatgaggtgcgcaaggtggaggtttagggtttagggtccagggatagacatgtgtgcaaggtggagcatgacgacgataaacataatttgatcgatggattgaacactttaggcggtggtttaagccattcgatggctactttcaatagggagatgaccagacatggtgcttcgattgatggtggcagaagcgattggcaattgatggagtcagacacttcgggtggatggttcaaactttttggtgaggcactttcatcaaggagtcaatgaggcttgaccctggggttgattgatgctagaggcgatcagtgtacccgatcagtggagttgaacactccaggcagggtggcacgggtctttcagtaagctgcgttttgacaaggagtcgactagatatagcgctcgggtcattccatggctaggaagatggcatggcgatttgtcggcactcactcacgactagattgatggcattcaataggaagttgtagcgggtggaccctatatgatggtttgagaattgagaggtttcttcgacaaagtgtggtatgacaggactgcgccggtggcggcatatatgcagcagacagctaaattagggcaatgacggtgaggccgttatattgagtcaggccaatcgtgcaaggacctggatgaactatggatgtcgctggagatacattgacactcatgaggtctcatctcatggaggtgtgcacgttctgcatcgaggctgagccggtggtgactagggttgtgccgagccatggctaggctttgttcgagccattctcgcatgagagtcaaatctggacaagatcatgccgtttgtgatggaaactgacacaaatttgtgaggattctagaagagaaatgacacacactcgggagcaatcaaatatgtttcttgacgggtggacgtgatttgcagcgtcgagtagatcaggttgagtctacactgcttcggcgagtggtggtgcaagtggaggaagctcggtggcggctccccaccaatgggaccgatgtaggcaggggtggggcatggggaggatgtgtgtggacgggcctcctggcagtggtggcggcccttacaggagggtcccaggagacgatgttgtggaagg

SEQ ID NO: 11278 - DNA, 316 bp, Oryza sativa
gtggtgaaatgcttatatttccaataatctctattaaatatgaaggtatatatagtcacatgatcaaatatattacttattacaacgtttgtctttaaaactaacaatactgttggtttggggttaatttcatacttttctttctctgtgtcccatactagctaaaccctataacaggagtaatgcattttgttccctgctgcagttttcttcttaacttattatggttttcttgcttagaattttccagcttatagaattttaaaaattcagggtgcatcatgctcctttgttatggttgtttatatgtttcagc

SEQ ID NO: 11279 - DNA, 1501 bp, Oryza sativa
ccagaagcatttcatagctgtcagccacagagtgaccctaatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgaccaaaagaccggctgtttggtcgaaacttttcgcaggtgtctacgaaggcacgaaacacgcgagcgaagagaaaggcgagccgtcgcgaacgaacagggagcagtcgcgcgaagcgcttcccaaaaaccttattgccgccttctcccggtgcaggacgtcaaaggcagaggttccggagacttgctctcccgatcgctggtgcacgccggcgagcgggatgtagtagtctacgagcggcggcgcagtacagagtaggaggcaaaccctagattgatttttgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgaggcgagcgagcgcgcgcgcgtgtttcccctcttctctccaccacacatgcttcaagtggctaggagggcatcctcccttttaaggaggttcccctctcctagaataagcaaggtggtactaaactccacatgcatgccatcccatgaggtgggcttttgtgattttccaaagaattaatcttcgagtgggctaaggcccattcattaattccaacagaggtatcacgcgcgcgataccgagtaggaaccggataggtatcgtgcctctggtacctctagtacatggtaccaggtaccaggggagcacacgtggaatctcacctatacaaaagaaaggaaagggataagtcacttaaagtatcccgtagcaacgggatcccattgtgtagctgccctcgtttccgaaacattgaagaagcgatcttccatgaggccgtttggcatgctcgtattgtaacatcaagctctgtaggctattcatttgatttacacgtgatataggagatgtaacattagtttacattagttttgcaatcacatctatctaattggaaagtaaaactcaatagcaaccaggacgagccacgtcatctgttaaataatggcagtt

SEQ ID NO: 11280 - DNA, 405 bp, Oryza sativa
ggaggagcggcatttcgcggcggcgcggcggggggtttttgggtgaggcgcggcgcgcaccgcacgcacgcacgcgacgccggggggcggatttttctggtgacgcggggggtttcgcggggggtcgaggattttcgcgtgatttcgcgtggaattctcgcggtgtgcggtgtgcggatgccgtggggtaaggctggctgacaaccgtggtttaccaaacatttcgaagtaggttaccgtcgcccagcggttcgacggttatcgtaataaccacgtgattactgtaagttataccgtagtttcaaaaactgaaaatattattgtatattttataaaccctggctgatacggaccatgatatcggggtgcagggtgtatcattgatggggcggagctacaactagc

SEQ ID NO: 11281 - DNA, 1501 bp, Oryza sativa
tttcaatggctaggattgttccttgctattttgtcattttatggatccaactgccattatttaacagatgacgaagaatccttgctattttgtcattttatggatccaactgccattatttaacagatgacgtggctcgtcctggttgctattgagttttactttccaattagatagatgtgattgcaaaactaatgtaaactaatgttacatctcctatatcacgtgtaaatcaaatgaatagcctacagagcttgatgttacaatacgagcatgccaaacggcctcatggaagatcgcttcttcaatgtttcggaaacgagggcagctacacaatgggatcccgttgctacgggatactttaagtgacttatccctttcctttcttttgtataggtgagattccacgtgtgctcccctggtacctggtaccatgtactagaggtaccagaggcacgatacctatccggttcctactcggtatcgcgcgcgtgatacctctgttggaattaatgaatgggccttagcccactcgaagattaattctttggaaaatcacaaaagcccacctcatgggatggcatgcatgtggagtttagtaccaccttgcttattctaggagaggggaacctccttaaaagggaggatgccctcctagccacttgaagcatgtgtggtggagagaagaggggaaacacgcgcgcgcgctcgctcgcctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcaaaaatcaatctagggtttgcctcctactctgtactgcgccgccgctcgtagactactacatcccgctcgccggcgtgcaccagcgatcgggagagcaagtctccggaacctctgcctttgacgtcctgcaccgggagaaggcggcaataaggtttttgggaagcgcttcgcgcgactgctccctgttcgttcgcgacggctcgcctttctcttcgctcgcgtgtttcgtgccttcgtagacacctgcgaaaagtttcgaccaaacagccggtcttttggtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 11282 - DNA, 1501 bp, Oryza sativa
tggctctttgcctatgatgatcagagagcttctgtaggagagagtcgtgtttggcaactagctctttctccttctccacctgctgatgtctgtcattggaagactaaatgtctaggatttcttgttcagtgttactacctccgtttcaggttataagactttctagcattgctcatattcatatagatattaatgaatctagacgtatgtgtgcttagattcattaacatatatatgaatgtgggtaatgctagaaagtcttataatatgaaacggaggaagtagcaatttgctgttgaagaggtttcttctttttgctccaagataagagattgagacctaatttctacgcttttaaaacaaaagaaccattaattttgtcccagctatttttggcaaagtcatgaaagtcattctcagttagccaccaattctcaaacttaaatgaattttttggttttctgtgagaaggattaagtaaaatcaaaataagagcatgatcaccataaatgaaagggagatgataaatagtagtattaggaaaattagcacaccattcaacattagccaggcatctatctagtctttcataaataagatctctacctgaccttttattagttcaagtgtaagcagggccattataacccatatccatcaagcccacatttctcagatgattacaaaacatggagatacgattaagatcagggagagcattaccatacttctcccaagggttcataatgtcattcaggtcacccatacaaatagtagcacggtgattactttgattaacaaaactactaatctcctgccaaattctgctagaactatgatgagtaggatcaccatatatacacaaaaggttaaataacatgagtggcctgggacctgagtctgccacttcagtagcatagttgaaaagaccggaccagtgagtgacccagtcaacctcctgttcaccggtccgatggttagatcgatggctaattgatactccatccgtaccaaaatataagagatttagaagggatatgatacttcctagtattacgaatctggacaaagagactgtctagatttgtagtactggtgttggtgacatgggggcgagggtatcgtgactagaggcttgggtagccgcggtcacccacgtggcctgaccccctcgggggggtcgggcccgaggatgatgtggccacccctccctctgtctcccctaggggtcaggccgcccctgtttcggccccaggggctggggcgccccgaccccccgtgattttggcgccacgtgtatgggttaggtgagcacagcggggctcacctaaccgcatttattgcgggttggacgagcgcgccacgccgcatttaatgcagcgcagcgcacgcttatccggtccgtgaccggtcgcagtgtgtgaccggtcacagaccggtcagatcgcgggttaggtggcaacaggcagcctgtcacacgccttgccccgtcccgtcggaa

SEQ ID NO: 11283 - DNA, 1501 bp, Oryza sativa
ttcatcgtaaatattttactttcataatttgttaaactatataattaaatttctagatattgatggtaaatgttagaatttctaaaagcaaaaagaagtacaagagatatctctatgaaaatgcatgataaagtagcagcagctagctagccagcacacaattgtacaaagcaccttaattgataacgagcgcacaactgcttatagatatggaaataagcgcacaaacccacacacagattattaacatcatgctgtacatatacagtaccagagtacgatatcaaaaaaaggacaggctaacatgcacatcaccgaaaaaaaatcgaaagcacaaacatgggaactaaagcgatcccaacacatgaccaaaatcatcaataaccacatcgacaaatattgcgcacacgcacgcacgcttaatgccttgtttacatcaatcccataattgggggcttaatttgcaccacacacacaatgttagagcacaacacatacaccatcacttttactctctttctgccttaaaatctcaataatctctctctgtgtgtgtctctacaactttgcatgcatgcccatcaaataatcatctttagtgagttaccttttgctttcttgctgacagctagctacacactgcctttgttatattaccacatgcacacactctctctccttttatgtgatgtttccttagcattgtaaaccagctttcatgtgatgtttgaaacttgaaacttctagaccccacttggtcaccactcaccaccttattgcatctctataaatacccttgctatcccacattccaaactccatgtccaaccatccaattccaagcactactactcatcactagctcacacacaattgcatacacctagctcaaaagcctttctatttcactaattgtgtgtgttcattgctagttgcattgtggttttctagttaattaacaagctagctatacctagcttataattagctagagtgtgagcttataattagttagttagttgaaaacaagctaagatgaggagcaaggcgtccatgttcttgaagcagatggtgtcgacgatcgtggcggtggtgaaggcgaagtcgacggcggtgagggccaagacgagcgccatgaagacgcggctgctcatcttcggcgtcctccgcaaccggaagctcctcgccaccgccatcaaccacaagatccacgccatcatgggcggcgccgccgcccaggacaccaccaacgacggtggcgtcgccggagtggaggacgacgacggcggcggcagcaagaaggccgtggtgctgtacaacaccgcgccgagcttcctcacggagcgcggctactacgatcacgccggcgaggaggaagaggaggaggaggacagcgacgagtacctgacgcactcgttgttccaggaggaagacgacgaggacgacgagctggtgaacgcgccggggtcggtgatcgacctggtgcgcgacgccaaggaag

SEQ ID NO: 11284 - DNA, 1501 bp, Oryza sativa
tcccggcctcctctcccttccccatccgacgtggcgtccacgtggatgccacctcagccgcccggccccgcggagaccggtcaaaggtttcccggtcctccaatccatcgcgccgccttgcgtgcacccggcccgcgtgagccgtgtcgctgccttgtgggtcccaccttgcgcccggcacggtggaccgcgtccaccggcttgcgtcgcataggccacgcctcgctcggccttgggccgcctccctcccgcgcgccggcccgcttgcctcggccgcgccgcaaatgccctgggccgcgccctcttcactcggcccaagtctaatatacatccctccttgatttcccttccaaaaagggatttaataaatcctttttcctttgttccacaaatcaattccttattccaaaattctatgaatcattttcccttggtcctgcttgtcagtgaaattcaataatattcttgagaatattatttctataaattccatagaccatttctcatcttctagaaattccgattaaacttccaaaattcatatctcctcgaccgctcgtccgattgactccgttccacttccagtatttccataaaattgagatctatctaatggcactattatttagtctaaataggatctttcttttggtcttttgtttaggtttttgattgcttgcgtatagttgcggttaccggattttcgtcgatcgcgggttttctcgaagattcgtgaagcttcatgaagaccttgagcaaggcaagtcaccctttgaccaattgctcctataattggaaaatcattattattttgtttgcaacttgcattattagaatcacacactcaacttgcttggcctcagtatgcgtgccaaaccgatggacctacccagtagtcgcactaattcctgtagattgtactaccctgatttccttgtcgctccacccttgtggtacttcagtatccgtgttctctgagcgcgtataccaactattccacatacaccgttgtctgtcgaaaatttgggaaatgggtttgagaagccttgaaaacccgacatgtggcgtcggtgtgtttgaaaacaaaataaattgtgaaaactcgcaatgcgggggttgtgcctgtgtggcactgtcccgtattcgcatataagtaccgattcctgtgggaaattcatccgagcatataacaagtgcgaccacacgggtgcaatgggacgcccctggctgagtaaatagcaaaccaaggaagccttgatgccaagagacatgtggattcaacggggtggtgtcggggagaaccctcgggcttcctggcacagtatggtctgggacctaatctggtgttggtctgggacccctctcgttggcatatggtgaacctgtgtcggctttcgaaatgccttgtcatgaaagccttaaggtctcccgacgtggctgatctcatgggctgggtgatccgggttagtaatgtcgtgtgggtaactgactgttcgaacag

SEQ ID NO: 11285 - DNA, 1051 bp, Oryza sativa
ggggacccgccctgctgatgcggctggctcgggcgcgccttaggggtcggcgtggagttcgggttggggttgccgccggtgaccatggcggcggcggcgagggacaggcgagatctgaatcgggagctagggtttgggggggagagagagggggggtgtcaagcgagcgaggaagggaggtttcggtctttcgggaggagagagaatggaagatagggggttgagttgggtgttgggcaaccgtttcttatgggctgggctgtaacagttgagccttcatgggcttctaattttagctccacatcgtcatcatcgtgcaagtagtgaagaaagataaaccttcacaccgtttcttcctcctcgctctctcccttcatgaggggcgcctctcggcggcaggcagcgatgcggtgggaggtgaaggagaggcactgacggacagcaggcggcgatgcaggtggcagcatggtgccgctcggcgccaggcggcgatgcggccgaaggggagagagcgagatagagagaagggagagagtgcaaggagagagaagggagagagtgcaaggagtgaggagaggatgacatgtgagtcctatatgttggctcataataattttttcttagtgtgtgaatgataaatggatcccacatatatgtttttaactctaataccatctaagcgacacgtcaacgttatagaccaagtcaatgctgccatgtagacgcaacgtcagcgaaaccgccctctaaaaccaaaggaagtcaaattggacggttttaatagttgaagggtcaagatatttggtgttgtggttcaaggatactattgtcgaatgacaactgtttcacgtcgaaggatatggtaaactcgatgaattgttggaatagtaaaacaatatattgattggtaaaaatattttaggatcaccccattacatggcctagggggctatttatagtcctagtataggctcataccctctagggtttagttataggggaatttacatgattacccttatgatagggatattaaaatgggtatacaagg

SEQ ID NO: 11286 - DNA, 359 bp, Oryza sativa
acgagttgacgcaacggacgacgacgttcgatcgcacaagcttttggttttgcttgaccggccccgcccggccgcacctattcgtacgctggtttggccgctgaaaacttccaaaagaaccaagctaaaggctaaagccgcttgcacgcacgtgtagacagtagaccacctttattagggtatgtacgatggttatcaacagtggtttaattctttgcattgctaattaggaatacctgttgtctgttgacatggaagaaagagaaagaggaagagccaaacatcgttgttatacataacaacggctcttaatcgagatttctaatgggtgaacgatcgttctaggcgattggtttttt

SEQ ID NO: 11287 - DNA, 1501 bp, Oryza sativa
ctcgttttacctttgcgaggagaagaccatcgggatcacggagtgtgcagaccccgccccagatatgtgcgtcgtagccgcgcgcgtcgagacggccgacactgatgatgttcttgcgcagcttcgggatgtagtacaccgtgtcgagagaccgatgatcaccattcttgcatcggaacaccacggtcccgcgcccctggatttcaatcacagagccgtcgccaaacttcaccgtcccaacaacgccggtgtcgagctcggcgaacgccgaacgcactccagtcatgtggttggtggcgccggtatccagaaaccaatctcttgtcacctcctcctcaccaccatcctcgtggtccaggatcaccttcttctccgtgaggtgtacctcctgtccaccaggtgttcgtccgagtgtcgcctcgccagcaagtgacacccctacgacatgtgccataagcaacgtcggttcttcctcggcggcttgcaccaggttcgcctctccccggcgttggcgtcgtggcttgcggcactgccttgcatagtgaccaaattcatcacaattgaagcactttaccctcgagatgtcgcggctgctgttcgcaccagtggccgcctctttgccctttggcgacccaccgggcttgcctcggtgattctgcgtgccgggcgcgccgcggcccttattgccgctgttgccggagccctcctgctcccgctgcttcacacgtgcctgccattgttcctccgtgaggtacaattttccgccatcgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtccgcgacgacggcagtgagccgcatcgcaaactcctccggcgtctccctctccttgaatcgcatcgactcaaattgacgacggaagccctgctccttcgcctcacgcacacggtcaacgccgacccgcatggtcttgatggcgtcccacgccgccttcgccgtgtcatgctttgccagcccgcgcaacatctcacgcggcaccgcctgaaggattgccgagagagccgcccaatcttcacgaaactccgcgtagccgggatcgatcgccgtccacagcccctgcgcctgcaggttgacgcgcatcaggagcgcccaatccgggtagtttgtcctcgagaggactgggaggcgagcggtgtgcgatgcgtctctcccctgagacacgagcggaagtaatgcgccgtctgctccattccccccgccgctgccgcttgcgccgccgcggccgttgccgctccccccgccgccaccgccaccacgacggccaggcggtgtgtatgacatcgccggatcgttccagtactgctctgataccaattg

SEQ ID NO: 11288 - DNA, 1501 bp, Oryza sativa
acaacctttgaaggttgataactgattccatgtatgtgtggcaactttatttctaggaggatatacaacgtagtggatgacgaccctgccccaagatctgaggttttcgcatttgctcggagcttggttgagaggaagcatcctggcctgataatggattctgtagtactaccagctactcaggacagaatcgtagctgctgagaagcgggtctctaatgctcggctaaaagaggaacttggtgtaaagcttcttcacccaacctataaatcaggcctgcagagtattttggattcttggagtgtcgaatcttctttttcaaataggaatgttgacgtttagcatgtgtatataactatgtgaattgttttgattttgtgctttgctggaactatgaacccaaaaaattatatattccattatgtcctcttccattcgagtgactggttctgggcatatactctatattatatgcatctcaaacttgctgtgacttaaatatcctggataaatcttagatttatttatttatagaagcgatggtcaaagatttatccaccgatcgtgcagtcgatgacaatgccgccggctagcctctcggtactccggtacggcacggcgtcgggcagcgtgctatacattgagcttccatgagttcttgatatatggactggattgataacacaaatgctattagatgtgtagatttcaaattaatctatcattttagctttatcctaaatcaaacatatctatttttgcctagtttatactactttataaagagtgaatttcagaaaaccgagttttgggatcaatgtaacgcataaccatagattttatttatttttcacataataccatctcttcagtaccattaacacaaaatcactggttttaagaatcttgaagacgacacgatcgagggcagagctagctagcctagctcggcaaaggcaaaccaactcatcgccatgccggcttgctaggctcgctgtaattctgcagcatttggttcgtttgctctctttggttacgattagtggcctgtaatttttccgcaagtagcataataagactatatatatacgagtattcttactaaacaacagagataatgcgcaaaaagaaattatctgaaaaacaagagttatggttcattattcaagaaacaataaaaaaataaagtgttttattaatgactactaaccccagagttcggccaagaatattgaggaagaggaaggtgagatatgggccagttgttggtaggtttaggagaaaatcacttcgcgtgtatcattaattttttttatggaagcgagccgatttggctctccctggtgagccagccttttctcacccctttgggctagttcgctccttggagctaggatttttttggcgataccaaaacgattagccttaccaggccaagctaggatccctctatgtcagctagacccacttgttaggttgaagcgcggcctattagggccgg

SEQ ID NO: 11289 - DNA, 1501 bp, Oryza sativa
gtaaaaacttcgggtgactaaactctagcaataacctaaattttcttggcccagctatatatatacagatcgactcaatatgaagtcacgcatataatttgttttactaatctggttgtatagtttttacctgccaaatatgcttatgatttatactaattaataatgggtacaaactttgactttttgattttatagtatgtctccaaaaaaaaaaacagagggactagctagtgaagttgagttttgaaacaagacctagtgtgtacgtgactccaaacaagcactgacgtacgttgcgatgatacgaggatgcatagatggatcaattctaaaatcaaacaaagtccgataaattaattaagttgttggttaatcattattccttaaaccaaatgagcatgatctcagacttcttgaacgaacactcaacacgtacactaatttcataatttgattccaagcatccaaaggaaaacattccacaggtcaatactatgcttggttctcatgaaaaccactactagactaaaactgtggatcatctgcgattggcacctgcgacatttcagctatttgcagatccatgtgcgtacgtagtctgatgtctccttcgaatgaaggaaattttagggcttattcggtttggacgagtttgaattcacaggaaaagaaaaggtagaggaatagtaatggttgcacatattaattgattttttccgagtggtttgaatggatagaaaaattcctatgttttcccgtacaactggtagaaaaatgtgatgtgacaacttgtataaccctcttacattatgttgttgtacgcgcttttagtattactagctagttagtgcatgaaaaacgatgtaaaccattagtatatgattaattaattattatccattgtacacttcgaaaattggattaatttgatatttttagagaaacttctctatataaagttttagcacgaaacacacaaacccaggttgggaaacgtggtcgcgttaaaccagagattagtccagctcaaacccagtttagagcaggtacaataacagaatataagccaactataaacatattttaaagagataaaagatgggagagaagagtagcgagctacagatctgtagccagctgcagtacggactctaagatacaatgcgtgtatgatatgtgtgatcaaatattaatagtgtagtaagtacctattgtacgaattggctattaatttggctatagatgatttggagctagtagttaggtatactattaaactttctcttaatcttaatttagaacacgaccttaaacgtcgtgaaacacacaagattcttttgacttcacaaaggtcacacgccaataaatatactgtacaccatcattcgacaatcagcgagctatacattattcactcgaccagcttacaaagcactgcatgccctatagctagtttcagtagctagcaagccattaggaagacacacatcaacaagaa

SEQ ID NO: 11290 - DNA, 1501 bp, Oryza sativa
gatggcagacatcacatcggcgcaaaggatttgcaattactattgtgcatctaacctcgaaggaacaaagaacaagaagagcaagaagaagaagaagaagcagcacctgctgcttgtggcatcgaagatcgaagcatccatgcccagcatctcgagctccgtcttcttggcagggctggtgcacgtcccggacacccttctgcatccaccaatcaatgaatccagccgcaaaatcgggaatggtccgtaggagaaacgtacggcggcaatagcagcagaatccgatccaaaatggaggagcaggggaagtaagtagctggccatccttgcgcgaggaggcgctgggagacgtatcgggcgaccaaaccggtgccgaacacgagcatgtgcccgggcctcggctgcggcggcaaggcggaggcggcggcggccgccatcggcttgggggagcggacgcctcgtggaagagccatggggattgagattctgcagcaaagcggcggccgccgtggtgggtggggggaagcgaggattaaacggtggcgacccgagagctatcggcgagcggcgagcgccaccgcggcggaggaagcggcggatcctgtggggttttttgcggcggcgcctccctgccacttcaggctgagggtatagatggcgaattttttttatttataattttttttattaaaagttttacaaaaataattttccattttgaaaattaacggaaggagtcgcctaccgccctctgggagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccggcctccgctagggcgattttgtactgtgggggggggccgcctgcaaatgggcggcgagggggcatggaattttgcaggtgacccccttgctgtcctgggggagggcgatttttgcctctccccctataaagcccagtccctcctatgtgaaatttcattatattcactaaaaatccaaaaaaaacaaaagagagagaggggagggcagcagcaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 11291 - DNA, 1501 bp, Oryza sativa
aaataaagttgccacacatacatggaatcagttatcaaccttcaaaggttgtttcttctaatggaaatgggggagctcatgctctcctagttcaaaaaaaaatcaaccttcaaaggtccagtagaaaggtacagtacgtaaataggttactgggattacaaagggagtaacactatcagtatcaggacctgattttagttcttggtttgatggtatacaacaccacaaccaaatattgtacccaaagtggttatactcagatacagtattttactaataaaaacagtggttgctactacatagaaattttatgatacctgaatattttgtggaaaagtgattatgaaaatggttctgtgctgtggacagatatacagccaaagtgagtctcttttggcagtgcagtctcataatttgttcttgtgagagttgcacaaggtaatactaaggaagattcaaactagtttgaaaatatgattgaaggcagaaaaactggaaaagtagcagccgttttgaagacctgaagtaaaaaataaaaaataaacaaacaaaccttgcacttctgatgctcatgctagccaggatagcctgacaaatgtcagccacatgaattcgtgcagtgtactgtttggattccctcgatttctgtcttcgtgacaaagatttgctcttggctattgtgtccactgcactgcaataatcaacacaaagggtcataatagtggcacttttagaaagcaagtattgggaactgtaacaaaagcctcccatgaaaaagttctcattttcatccattacatacttgacaagtttgtagcacaagttgtacaccgtattggttgaaatcagataaaaagtgctccaaatctttaattttaaaaggttgattttattggtggaattcagaatttcagtagccaagtcatgcagttctggagtaaatataacttttggttcaaagactacaaaataaaatggattgaaattttagcagactgaaaccttcttcctggcccatatattccacctaaacgaaatacaaaggctgatagatctaagtcatctataacattcaaccatcctttttcggcagcatatcttaatttcacagactcggtcttcggattcaccgtatgactgcatgaatagcagattcttcagctttcagttaaacaattattgcagaagcacttacagaaagccacttatcttactcctcatcaacccatgcaccaccacaatcaccatacacacctgaaaaatgataataataattacaagttattgtatggcagaaaaatttttcagggctagtttgcacatttatgatacgttcagttaacctgaaaagttggtatcgacttttgaatgctagctaggattttataagagatgtgagtatgatgcattgtttgccatgaaaatggtgttgttgcctgatgtacctcagatcgaatcgagcattgaaccaaggaaaaaacaatttctgcaagccattgca

SEQ ID NO: 11292 - DNA, 1501 bp, Oryza sativa
caaagggtcataatagtggcacttttagaaagcaagtattgggaactgtaacaaaagcctcccatgaaaaagttctcattttcatccattacatacttgacaagtttgtagcacaagttgtacaccgtattggttgaaatcagataaaaagtgctccaaatctttaattttaaaaggttgattttattggtggaattcagaatttcagtagccaagtcatgcagttctggagtaaatataacttttggttcaaagactacaaaataaaatggattgaaattttagcagactgaaaccttcttcctggcccatatattccacctaaacgaaatacaaaggctgatagatctaagtcatctataacattcaaccatcctttttcggcagcatatcttaatttcacagactcggtcttcggattcaccgtatgactgcatgaatagcagattcttcagctttcagttaaacaattattgcagaagcacttacagaaagccacttatcttactcctcatcaacccatgcaccaccacaatcaccatacacacctgaaaaatgataataataattacaagttattgtatggcagaaaaatttttcagggctagtttgcacatttatgatacgttcagttaacctgaaaagttggtatcgacttttgaatgctagctaggattttataagagatgtgagtatgatgcattgtttgccatgaaaatggtgttgttgcctgatgtacctcagatcgaatcgagcattgaaccaaggaaaaaacaatttctgcaagccattgcaggtgacaattactcacaccttggtgcaatgcaggggtcagttcacaagtccagggaggaatcccagtctggataaactcattcttgattccacattggtcattggtatgcttggtacataaaaggttccagcacctgtgtcatcctggtgaccaaggaaggagagaatagccgtatgtttggcagcaaacgtgcaacattttactagctcaatatctcttaggtagtgaactaggcaggatatggttgcttatctagtttactcaagtagtcctttctgtgttagctaggtaacggttgtttgttttcttccctagaaacagcagtccactagccatgtagtttggttgctgtgttgtgcccataccaccaaaaaagcccacaccaccaacttctcttctatgttaatggaacgagaagcagatattatgcgtgtttagaaaactaacataaaaaagatgttgctacagttgaaggacgaattgaaattatgcaggtcatactagagatgatcagatgagcatatgtgcacttacttgttgaagaaaggtaacatagccattgaaggttactattgcttagtgtagtttgcaggttggaatgtgaagaaagcaactgtagatattagatgcaaatttaatcattattatgttaaatttagatggaatttaagtcaatcgaactgacatcaacaagcaattgagaac

SEQ ID NO: 11293 - DNA, 1501 bp, Oryza sativa
tacatcggcttgtcagccgatcggctgtttgatctactgtttacatatcttgtcagttgcaggaccaaactgactggcacacccgcatctcaacaatctttggacctgcacagcagatctcccaggccgatgtttgttttgtgttgaaaattttgctgcatttttttataaacttaatcaaacttaaaaagttttgattagaaaaaaaggtaaaaactacttatattataatataaaacagaggaagtttcttactagagtaatttttttaggaacaactactaggcatttgctcggtagtataattttataagtatgaaaaaggttatttaaaagacttaaaggaaaaggatgtccagattaaaattacaatagttgtaaccaatcagcaactatttgcttgagagaaatattcactctacgcatattcatgaaaatctcattcctgaaataaaacaactagctatcaaaagagggatcaatattttgaaaaatatttccatttgagcacgagaaaattcaagaaatgtcgttgacaaacaaccaaatccaaaaaataccatcgatgagtgcgggttctataaataccatcatacaaataattttgtcccagaaatatcatcgtcgttagggtttcgtccatcccacacagttaaatacactgttcatcctatagcacttaacggagggttgctggcgaaaccttaacggcaatgatatttttggaataaagtagctcgcacgatatcattttatggaacttgtatttgttgatggtttttttgaaattgggcgcttgctaatgccatttcttgattttttttttttttgagaatcttactagagtgtcttgccaatcgtccaggttttactagtcaaatagtcttcatagttcataggtacaactgtacaggtacaactgtacaaaattacgccgtatctttcccttgtctgaagtggtacagtagtagtgtactcccttcgtactcgtaaaggaagttattttggacagcgacacggtctccaaaacacaactttgacttcttgtttcattaaaaatatttattgaaaagtgatatatgtatacttttatgaaagtatttttcaagacaaatctattcatataatttttacattttcaagctcaacaacttgatagttatttatgatttatatttttaaagtttgacttaaaaattatcctaaacgacttctatgggtacggagtgattagtatctttatcacgaggtacttgtactatctttcttcccggtctagcacgaatctgaaagggacagcctctcttagcaagagaggcctttataaatagccgcacggttaatctcacaactcagtgcagtagtagtagcatgcaaaggatttgccctgctcactgctcggtcactcactcactcaccatgaagtccatgaggctttcctacatccctcctgctgcttctgctgctccacagagccccagctatggcaggaagaagaacg

SEQ ID NO: 11294 - DNA, 1501 bp, Oryza sativa
catgaaagtatatttatcaatgaatcaaatgatatgaaaagaataaataattacataaattttttgaataagacgaatggtcaaacacatactaaaaaggcaatggcgttaaacattatgaaacgaaggaagtataatactattggttacatacatattgacactttaaaatatatttaggctcccaggaatactggcgccgctgggaagcctccattgatacctaataatttgcttatatattagcccctctcctctgcatatgctacttatttatatatccacgtttggtttttcagcaagcaaagtctacaagaggcacaactctatctgcatagtgttacacattatacaattgttcattattgtggcttccctgcttctgaaagaaactggaccagtcttcatcagtgtcttcagatcgatctcattgccattgaaaattgataatatgtgtactatattttttagatgaaaagcccagtaccgtcctcatgcatgcatgcatggactcgatccttggcttgtgcttgctggcgacgatttccacttgttttttttatggctagtaggtgcagttgtggagaatacgcaacctacacgtagtaccgtttttttttattggagcatccatcagagtcaaacttaaatgcttatttgacctgaatttattttcggcttgaattttgtgttttattaatgtgctatatataggtcaactgtacttatgcaaacctgatggcatgagctgatgagcccccttttttctttcaaaacttctgaagaaaatgacacgcggagctatcttctgaacttttcagttgaaaaactgaagctcgtttttctgcaaaactccgaaacaatgatttgttatttcataacaatagtgataagcagtcttcgctcaggactttcaggttaattaacatactacaaccggtcaacttgaacagcattgcaagtagcactgtggtacgagtgccacctttttattagaacagtacaaatgctgactaatttagcttttataattgttcagagttctaggggcaaataattgaccggtgatttgacttgtcattgaaaatactcccttcgtctcattttaagtgtacctatgagttttcgtgtccaactttaattatccgtcttatttcaatttttttatgattagtatttttattgttattagatgataaaacatgaataatactttatgtatgacttattatttttttaaaaaaaatttcaaacaagataaatgattaaagttggacacgtaaactcatagttgtgtttgaaatgggagagggagtaacaagggagtagtttacaatattacatatagaccccgttcttttctccaacaagagttggatgaagattaagattttcgtgtggcacgtttttcaaactgctaaatggtgtgtttcgtacaaaaactttctatatgaaagttgttctaaaatatcatattaatctattttttcaagtttataat

SEQ ID NO: 11295 - DNA, 1501 bp, Oryza sativa
atcaactgcaggtgtcagcccaaatgcgtagtgaatatcattaaagactttgatgataggaagagggacttgattggtgaaattggatttgatggacttttggatatcaagcttaggctgtgtttagttcctgaaaaaagttgaaagtttagggaaagttggtagtttggaaaaaaaagttgggagtttacgtgtgtaggaaagttttggatgtgatgtgatatgatggaaagttggaagttgggggtgaactaaacacagccttactaaggtacacatgcagtttggggcatggcaactgagcaaagttgatccgaaatcatgcgctattgttaaagatgtcaaccaggagctgccattcggttctaatgatgtcaatgcagtttttagcttgccatgctcaggtcaacctattatcccttgctctcaagatgaattggatgggaagaaacaaatattgtgtgaaatatttgagataccaaacttttcacacctcaaaatatcactcttagagagaatcctaaagaagcagtatggttatcccaagacaatagataaaaagagggttttcatggcggcttttgtgctttatgtatttttctagtgattttgtttgtgaatctgtcattgcagatatgtacttcttttcatgttgctactcgtaagtcctaatgtattctgatttttcttgagatgtggtgtgctctgtgattcataatgtataagcaaccccatacctactactaataaaacaaaaacagtatataccgctactatctaaaaaaacagtatataccactgctagcttggcagtatatactgaccgaacaaaaaaaagtagtacatactgcttgattaagtgattaggaatgtagtatacacatactgacccaaaaaaaattgtatatactgctttatcgacgaattaatgtagcatataatgatactacaacgtcaaaacaagtatatgctactgctatttaataagtagtacatagtactaccagtagtactaactgtatgctaagaaaaaaaaatacatatactgcttctttgaagaaaaaaaacacaaaccataaaaagtagtatatactgctccatcgagaaatgcagtatatactgtcaaggaaaaaaaagagtatgaaatcagatttgtagtatatactgactactgatagtacaaactaatctaacgagtgtatagtatatacttactcccaaaataatagtatactgcagcagtgcacatttagcattataaacagacatgcatggatcaattattatagaacaattatttttccaccggttgattttcctccatccgttggacatgcatacttgatttttgaatttttcaaaccggttcacctgggagtacggaagagtcgtccctctatatatatataccattgtccaagcatattgtatcactgtcatttggttgtttcatttgcaatattaattgtcaccgtagcgttagcacggacacactactagt

SEQ ID NO: 11296 - DNA, 1501 bp, Oryza sativa
gcaccgttgcggcctgcgggagctcgggaggtggaggtggaggccaccgcatgggagcaaaagccctagagttgcaagtgagcatgagcggatagtgaagttgtgtcgggaggcggatgcacgaggtcgtcttgtgcgtgtgatgcggtcggagaattgagggtacccatcagcgacaattagggaaacatgaggttatggttgcattttgtttcataccgacggtgagtagaatgggggttgaattgggcctaaatgcatacacatgtttttctaatgatttgtgaattatgataagttttttttttggggggggggagggggaggttcatacttttagggcttcacaggtcaatcattgggtgaattctggctacccctaatctcgtcctcagcataggccgtcaaactttcattggcctctgctcacgatgatgtgcgactctatgagaaggatgttgcaaacaaagcgaccactgccttgggcccaacgacgaaaaaaaaccccgccacctctgaccaggcatcgccaccactatccctattgccctctttcgctaggggtaatacaactagagacatacctagattaggggttgttggcggtatggcatgaggcccttcgaccaaaacctgccgaaggctatgcgaggagtggggatccaagcccgagacgtcaaagttagtcggggcgaagccccccccaatggcgaagactatggaacaaggacggcgagaggcgaaggatcgtgcgggtactctgccaagccggaggcctcttgggggaaggatgtagggcgaagagtatatgccgaagggagacgacttcgccaaagcaagcttgcccccgcgagggccgaagaagccttttccggcccatcaagcctaggggccattgggccgacgatcgcctaacggcccatcaggagtccatgaacctctattacactatgtatctatgtaaatgtccctttcataagggtaaccatgtaaattcccctgtataaccaaaaccctagtagtaagaacctgtaataggggctataaatagtctcatagggccatgtaatagggggatctaagaaaaattctctaatcaatacactttactttcaaccactgttgagtaaccacatctttcgacgtatgcagttgtcgtttcgacaacagttggcgtcgaccgtggggacctccgagcaaaaccactgagagcaaacgccaccgaagaatgtcgtaaaggagaaggttacaaggcgaaaggaaagcgacgccggggtggatatggctgccgaagagggagcagagccttcggcgcttatcgccgaagatgggggagcgccatctgcttccgcacctgcgccatcactaccgccttcggcccctgctacctatgtgccatggcgaaggcggctgcggcggcaagggcactccagaccagggcggagatcctttcgacaagccaactgctggtgccccaagccgctccgtcgcagccggcagc

SEQ ID NO: 11297 - DNA, 1501 bp, Oryza sativa; identical to SEQ ID NO: 8814

SEQ ID NO: 11298 - DNA, 509 bp, Oryza sativa
taatagcataatagtaccacataaaaaccatggtagaatctattatagaattgcgcatttatcgtgaaacattttgaaatcaatatttggtcaaaatttcttatgtatacattaaaacttaaaaaaatccagtactctaaaaaaaattgtaattctcgatacacaaaaatcgtcgcgtccctatgacccatgggcccttccacaatttcgctcacgcgcgagaaaatcccgccccgcgctcgtctcttcgcgcccagatatttcaccacgtcagcaatccgcgccgaaacgcatcccacccgttcaccgcaaacagcggcgaacgacacgaatccttccacgtcatcgatccgcgccgcatgctttccaccaatcagggcgcacatcccctcttctataaaaccaatcggccccgtctcctcctcttcccaaccgcaaatcttgcgatccacacacagcaaaagaaccaccaccgtttccccttcccgagaagaagagagcagcatcca

SEQ ID NO: 11299 - DNA, 1248 bp, Oryza sativa
agtggcatataatggattgtctctttacattaccttcgggcattaacttttcttttccttttgttggtgtgcacttttctactgtgaatgtgaataacattatatacataatttaccttccgcaaagtacatctcaaagaggctgcctctatgtcacttaataaaaaggaacgaaccatatggtaggatcaataattaatgcaagatgtgtggaagtggaaaggttcacttccatcttatgacacaaacttcacgccacgtaagaaacatggttagcaactactcatgcgctgccatctataaaattactatatgtaactctcatgcgacaacaacataactaaatagcgtgttcctaaaaacacccggtgtagccatttgtcctccatttaaccaatacgttcgctgcaattttcactttcttgtcacattcttcctcccactcgttttctccggtgtgtacacccatttttttacagtattataccagaagtactgcattaacactaagctcttaccttccagcacatgcaaccatcaaccatgggtgatactatattgcaagtgcatgcacacggttgacaacccgtaactctagtctctagtacggcactagcacatgggattaggcaaaacggggagctcgtcaagcctctcctggctgaccagtgctgacgtgtcagcccgggaatggctaggaaaggaagagattatattagccagtagcagaagagcagagaatctagcggccaatcagcaggagcgtctcctccccccctgcatgcatgacgcgcacacgaacactgaaagtccgaaacatacttgtagtaaaaggcacatttccagatggatcatcggtggacgcgcgcgcgcacgcagtgactaaaaaaatgggcaggcaaaggccaaattgcaagccgacccggccgggcgcgcgctatcgcacgcagctgcctcctgcctgtcactgattgggctcagttcactcaccaataccacatcggtgtccatccatgaattccatcgatgggcaactgaataatgccgggctcgtgaccgcttgcctgcctgcccggctggctgaataattggcacagaggatagggttccatctgtctcgccattagagggagaggagacttcggcctccgctttcctggaaacttcgctttcgctctgttcctctgcatctctctttggctctttgcacctctgtttttttaagcgtctctctgtttttttttaagt

SEQ ID NO: 11300 - DNA, 1501 bp, Oryza sativa; identical to SEQ ID NO: 8816

SEQ ID NO: 11301 - DNA, 972 bp, Oryza sativa
tctccccctcacctccccacatcaaatccactccatttgaactcatttttcgcaggattttttgtggaaattgaagagaaaggtagactcctccattcccccctcttttttttcgtttttattggttgaatttgtagatcgaagggtaaccctagaaccccttttatgcccaaatttgtgatttttagcatttgttcttgggatttacttgttgtagtgctacatgtttgcaatgtacgcattggtgtcacgatttttttaaccatatatgtggtaatgttaatttttggattgtttggttggatggatggatgaaaaattagggttgaggcatgaaagtaattttaatttgatggacttgatgctatagcctataggttaaacttttaacaattaattatatgaaggggagaaaattttggttgcattatagaaattgattatagttaattagaactaggttgggttgtatgacggagtatttgtaatatttcgatgtataatgcactagtaaacttgttgatagttgtaggtggattaaatattttttttggagtagtagctttgggacaaattaagttatgcattggttataatatgtcggtttggactacgtttataaatgaatatttaatttttgttgcaaagttacatttgattttttggtgtagatggatagacttgttcgtgtttactacggtggtagagtggtggaaccttatgttggtgcacatgttgagttttaggatatgtcattgaagaccattttgtttcccacccacccaactgtagatgaactaaggtcacgagtgaaacaagttcttggatggaccgaggataatgtgtagattcgtttttatgggagatacgatgttggtcaagggcataagtatatattaaatgtcataggtcagttggaatgggaagtttactttgatttggtaaaagagtctcagtttagatctctatagg

SEQ ID NO: 11302 - DNA, 1501 bp, Oryza sativa
gtacagccgctgaccacttagcacctcctgtcctagtatttaatgttgaagatgcaagcagcctcccagacccccggaacacatccgtcaagtgaaacccccacgaatttccaagcaccacgcagcatgtactttgcgtgtaatgccaaaatggatgaacttttttttctgaagttgttggacacaagtcaaccaaccggccctcttcccaaagataatcgaatccaactgaattaacgaccaaaactgaaaccaaaagtcacctagtagtagtacaaattcgtgagctgaacccgcaggaaccccaaccacgcgctaccccccaaattcgcagccgcatcacgagacgccaccctcaaattctcgctaacgacgaccgcatcccgagacccagccgacgcatcagagaagaagaagaagaagaagcggcgcggatcgggggaacgtaccggagcaggccatgtaggagagcgcggcgaccgcgccgcgccgcgtcatggcggaccccttgaacagcgcggcatcgtcgccgccgccgcccccgcccccgttgcccttccccgcctccgcggacatcggcagcagcgccccccctcccttcgccatctccgccgcccggatctcccgccccccgaagcctccgccgccgaggaggacgagcaccaccacgacgacgacgactcaggaggaggagaagtcacgaggatatttctaaacgagacgcggtcagcccgatccgacggccagcctgcctcgtccgcgcggtcgcgatgcggaaaacttcttctctctccgccttcctggtgcccgagcgtggccagcgcggccgccgccttttttataatgaagtggaaacgcttttactcccaccgtcccataatctcccaccgtcccataatatagggattttgagtttttgtttacaatatttaaccactcatcttatttaattttttaaaaattattatttattttatttgtgacttactttatactttaagcataactttttattttatatatttataaaaaaaaatttaaataagacgagtggtgaaaaaaaaaaattaaaatcacttataccgtggacggagtgagtactacacaaaaattgcgccctctcgctgtccgcggcggccttcgcttcgctcgatgggcttggctttccgccgttggtgagttggtcacatcacatcatggatggatcgcatcgaccacgtcgaggccggaaaattttttggggggaaagaaaattaccagaaagccaacacgaggaggcagccctgccggctgagtggagtctcttatctcgacctgacctgcgaatgcgcgatgtcaccacaagccactgagagcaagtacaattacagggctataaaccagatataaattatattttaaaaagataaataaagaaagagaagagcagcggactatacatctgtagccagctgtaacacggacttcagaacgtaatgtgtgtataacaggtaggaccaga

SEQ ID NO: 11303 - DNA, 1501 bp, Oryza sativa
cgccctgccgccggagacggggaagacgacggcgaggggacagcacgccaccatccgcttgaggaaagaagaggagaggaaggggaaggggccggccggggggggggggggctcgctggcgcgtttatgccctacggctagccggtgaggcgggtagtgacgcggtggggcggtggcggtggaatgcacggtggggcggtgacggtggaatgcgcgatgggagggagtggcggcgacggaatgagcgaggggaggggaacggaaggagagttagggttaatacctctgcacgaatctaaaagcatatccgacggtccaaaatttgaaagatgggaggtgggattttctgtcaacatatcctatatatctatacaaatcatccccactactaggaattctctacttcctggtgcttccacgtcaccccatttgctattaaccgtacgatctgaatcattcggcagggaatccatgaagcagcctcccagagttccccggttgtttattgggccaaaagaagcccatgttatggcccaactcaacgggtatccatccctaaccagaggaaaacccgaattttttttatttatacttttttttattaaaatatttacaaaaataattttttgtttcgaaaatttacaaatctaatcgcctgccgccctcaagaagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttagtaactttttcatttaagatgttttagatatccaaatattcgttacaaaatataaaacacattttaaaaaatctcagatctatatttcaaacgatattggatggagataaactttatataaaagttgtatatcttgatgagatctataactttgtagtttatcacttttccatttaaaatcatttggagtatcgaataagcattattagtttttaagtaattaaaaccggtgggaagggtttgaacacaaataaaaattttgtatttaggtcccttgccgctctttgagagggcgatttttaaaaatcgcccttcttgagggcggcaggcaattagatttgtaaattttcgaaacaaaaaattatttttgtaaatattttaataaaaaaaagtataaataaaaaaaattcaggaaaaccctccagttccatacaccgcaccacctgaggtggcggtgcccgtcacttcctctcccacgtgcgtcgtgtccctccatctatatggcgctccctctgcctttggttcaagcccacctgccgcctcccagccttttcgcctcctctttggaatgtcatgagaaacgaaaccgctgcttcgagatcagacttcatggttgtcatcaaatacatcaatttactgctcccataacgtca

SEQ ID NO: 11304 - DNA, 1501 bp, Oryza sativa
aacctatcatcttaatgactttctcgtatttaatacgtgactctccattcttccatacaagattggctacatggacatcgagaaatgtaaatattaatgaatcgcttgtttacgaggaataactagtactccctccatctacttttgatagtcatattttcatatctgaaaaatttatttttgataggcatatttcaattcaacaatctatcatcttaataactttctcgtatttaatgcatgactcttcattcttccacacaagattggctacatgagcatcgagaaatgtaaatattaatgaatcgcttatttacgaggaatgactagtatcatgtttaaattgatgatgagtagaattacttatccttggtctgtgcgtcaagatgaaatatgactatcaaaagtagatgaagggagtagcatgtttaaatggatgataataagtagaattacttatccttggtctgtatgtcaagatgaaatatgactatcaaaagtagatggagggagtagcatgtttaaatggatgataataagtagaattacttatccttggtctgtgtgccaagatgaaatatgactatcaaaagtagatggagggagtacaaattaacagaccataagccattaatacaactattaatacctatttaaaatttccagtcacctaaaatctggacactccccttttctataggtgtttatcgtgagaagacaaaattaatttgactcaattaaccacgcactctttctagctaagagcaggtacaatagcaggctataagctagctataaacatattttaaagtgataaagaaagagagagaagagcagcgggctacagatttatagccagctgtagcacagactctaagacgtaatgtgtgtatgacaggtaggaccatatattaatagtatagtaagcaactattgtataaattgacaattacattggctatagatgatttggagctaagagttgtgtcggtgacatgggaccgggagtatcatgactagaggcttgaggcagacacaatcgcccacgtggcctggcaccctcgggggacgtcggacccgagggtgatgtgtgcgcccacctcttggtctccccgaggggggggggtcggtcggaccactcctgcctcgcccccgagggccgaggcgccccgacccctcgcgggttctactccgcgtgtatgggttaggtgagcacagcggggtctcacctaatcgcatttattgcgcctcggctaaacgtgtcacgccgcatgaaatacagtgcagtgcactcgattatccggtctgtgaccagtcacagaccggtcaaatcgcgggttaggtggcgacaggcggtctgacgcacgcttcgccccatcccgtcaagacgagagcttctaggcactcgtccccagctggagctagcgtgttacatcccagagatggcacgttagccccgatcgatatatgccaggcttcatcctaaccattacaggcaaga

SEQ ID NO: 11305 - DNA, 1501 bp, Oryza sativa
cccgagcgtgaatccatccacgcgtgcgcgtgcacgtacatacgtcgtatatacatacatagtagtgtggcgatcttaacttgcttgcttgcgcgctatcggatccaagctctgatcgagtaaggtctaagatagattgattaagatccaaggatatgtcgtccctgatcgatctcgttcttgttaagcttatttattcggctagctagctctttcccgccactgcttgcattggtatatatatttggattgatcgagctcctcgatctacatgtcatgcatgtcgtcttttgtttgggttcagattcatactaattaaaaggagaacttgatccatgctatatagtactatatgacaataattcaacaaaacaattgtcatatcccgtatggtttatgaatgcctgaacttttcttgatttggtaggagttaaattgctctccatatgtattaactgacggtaaacaactgctagctccatccgttctcaaatgtgaacatttctaatatttttttgcccccttcagcttcagaatcctgacgaaacaaaagaaacataactacttgctagctaccagcacaacgtctaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagactagtcttctgctatactctgttcttaacttataaatacaggcctcctagaacatttcccctcctctcaggtggccaggatattttttttcttggcctctctctcctgccatcttcacattgacccaaaatgtagtgcatcccctggaaaagctatacctcccccgtatcagcttccaacttagtacatccctcctctcatcctcaccaatgttttcactgctgctctgatcatcagcaagaaaaccaatcccactgttctatcagcttcttctccccctgagatggcttctgcaaacaactggctgggcttctcgctctccggccaagagaatccgcagcctcaccaggatagctcgcctccggcagccatcgacgtctccggcgccggcgacttctatggcctgccgacgtcgcagccgacggcggccgacgcgcacctcggcgtggcggggcatcatcacaacgcctcgtatggcatcatggaggccttcaataggggagctcaagaggcacaaggtatgcatgcacgcgtgtgtctctcgttttctagtagtacatggagtgatgggtgtttgatcttgatatttgatgttaacgcagattggaacatgagggggctggactacaacggcggcgcctcggagctgtcgatgctcgtcggc

SEQ ID NO: 11306 - DNA, 1501 bp, Oryza sativa
agatgcttttcaacaactcaattggtaatgtaccgacctcccgggtcagatcattacttctcggctcccagagccattccacttgattaatcggctcccagagctttttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaataaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataggccattttaggcgtgcacaaatcaaactccaaccacctttgatcggtaagtgagcaagcttctcgtccttgccttacccggaacccggtttgtccgaccccgccccggcgttcccaactattggcatgcgaggtttccctgaaccgactagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacggataccgaagtaccacaagggtggagcgacaaggattcagggtagtacgacctacagaaattagtgcgactactgggtaggtccgtcggtttggcacgcaaaccgaggccaagcaagttaagtgtgtgaatctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattattggaagtggaacggagtcaatcggaagagcggttgggaagatatgaattttggaagtttaatttggattttctggtcaaggaaaaggatttattaaatcctttggaaaaaggaaatggacgagggatgtgaatcagacttttctcgggtggcattggcgcggcccgagggacttgcgcagc

SEQ ID NO: 11307 - DNA, 1501 bp, Oryza sativa
ctatatatatatatataatcatccgatatcttgttttaaagatttaattataacaaatataatggtgtaatcaaatcataaattagataaacggtttaggagaaaaaatcatttggagattgcttaaaaggaaatcaaaccaatcacagccaatcagaataggacacatcacccagtctaaaactggatggcttcatccagccaaatcgcccggatgcactcattgagggaatattccctattccgggccggccctatccacccttccctccaaccagacactaaaaaaatcggatgatcatatcccatcaagtccacctaaccaaacacacccggcatcaaagcaaaccaacccaaaatctctgtccctgtccggttccggatgaaacatagagatggaccaaaagtaaagatctctgattgaaactggacatgccacaacaaacttgccagctcaaacagtgacgagcagcgacgggtgacaaggtgaaattttacaacaactggcaagtttgacggactcaaggtcttcgttccaacggcggcaaagctgagataaggcttgagcttgagtgcttgaccatggcatatgcaagtcgtggatgtgaggccgctgaaaaaccagttttaagcccctgcaccctgaggcgtgagccagattagtacccaactcaaagttcacacttcacacaccacccagccaaacaaagcagaatttccatcatgtgcactctgggcaagcagaggggcagaggtgcgctgctcttttatgcctggttatttggttaatacttggcttttttactccatcatctttagttagtacgtattaaaattagttgttgcgagtgagctgtgaaacatttcagaaaaaaaatttagaggactttcagaaagttgcaccttgtttttttaatgaagtactttctccgttttatattataagactttctagcattatcctatatatgttaatgaatctagacatatatgtgtgtgtctagattcattaatatctatatgaatgtggacaatgctaaaaaatcttataacctgaaacggaggtagtacaactttgtgtttcaaattacatttagactgcattcgtttctcacttctcccaacctctactctctcgttttccacacgtacaatttcctaaattgttaaatgatatgtttttttaaacattatctataaaaagttattttaaaaaatcatattgatctattttttaaaaaactaatatttaattaattatgtgctaatgagactctccgttttacattcgctccatttgcagcatggtagggactaggacttgcgaagttgggattgtaagattaccagagttggagcattggagggtagggctgattgcgtaaccatgaagtagctccagtagcgatcataatatgtcgcaatatttatgtttcactaattgcaggcagcgagggcctgatgtctgtcaacaaaacggtgaaactgaccatgcccgttc

SEQ ID NO: 11308 - DNA, 1501 bp, Oryza sativa
aggcggcggggaaggggcggcgtgcggacggcagaggacagtgcgctggcgacggggggaggagctgcgcgtgggcggcgggggatggcggcgcgcgggtggcggggggaggagcagcgcgcgggctcccccgtcagtcgccgcggtgggcgttgcggtggcacagtggcgctgggatcgggattgggatcgacctccgcgccgcgctgcagtctaggagcaacctcctcgcgtggtcgacggccgctgaggtcgacagccgccgaggtcgacggcttcctgtcgcgtggtgttcatgcgacgccgagctgataccaacagctgcggcgacggcggccgtgcagcagcaggtgccgctcgtcgacggcatcgagccacgccagcgcccgcttccccgcggcgtccgcgcttcaggacatcgtcgccgtcgccgttgacgaggcagaccggcccgacggcgaacacaggcttccccatctccttctcgtagtgctcgatgtacctcttgttggaattaatgaatgggccttagcccactcgaagattaattctttggaaaatcacaaaagcccacttcatgggatggcatgcatgtggagtttagtaccaccttgcttattctaggagagggggatctccttaaaagggaggatgtcctcctagccacttgaagcatgtgtggtggagagaagaggggaaacacacgcgcgcgctcgctcgcctcgctgggccgggcaggcggcgcgcgtgcacgacgtacacgtcgaatggtccgaaaaattgactcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacacttgcgaaatcaatctggggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgtcttcgtagacacctgcgaaaagtttcaaccaagcaaccggtctttacgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaatccaaaaaccttattataggcactgtgattttacta

SEQ ID NO: 11309 - DNA, 1501 bp, Oryza sativa
atgaaggtcgaattatacaatcctcggtggtgaagataaataatcctaaatagggtcttatcagttatcatgctccaccatgcaacaactgtgagtctgtgactacctaagtttttcatgtgtcattcatcaaatttacatgcatgtactctcaatggtggaaggttggcaaaaaccatgaaccaagttggacatcttgatgttagtgtagaaaaagaagatatttttctcacatgaaacaaataatgataatttagggagacatgtctttctagatttctcaccaatatagtctgagtgtaaaatgatatagaatacgggaaatatcctacaaaagaacttggcaaaatgatcattatgttttttccaaaaaaaaaaactagactctaaaccgtgtggtgcgataattacaacattttaggacctaatttgcaacacgtgcatgaatttcatagaaacatagaaaaagatcccgcgtttcaaagaggccttatccggttaatccaattcatggttgggacctggatggggtggctgacacagacctggacaggaatgcgacccaggagcggcaatgcacacatacctggttggccacaatccccagttgtgcaagaaacgaagtgccttaactgaaactctacatggccagttgccttcatacacagtagtgccttccgcgtctcaaacaccatgcccatacggccattgccgaccaaagatccctcctttctgctccagtgcctgcccttaataggtccctgtcacacagcaagcaaaagccaatgtgaatttccagaagaaaataaacagaaagatgattcagctgtgctattctccagtgtttttttcttctccttttgcatgtaaaagatttttttatttctttcttgaaaagaaaaggattttccttgcaaagatatcatggacagaaagcaccaaaaaagtgtcaaactgtgcttgctcttgctcaccactaaagttttttcctagtccacaccaaatgccaatattcctattcccctccttatttagaattaacaagcacatcaagggggtagaaaaagtgatgcatatcatatcacaacagtgctctatcttcttccctcttgctgagaactgaaaacagtaggtggctactctcattggagccccctcccccatccacacccactacttaatattaatagttagttaatactctctcctaaactagtttagtcctcctctaatcacacacacacaccctagtgactaattaagcctccccttgttaatcctccctcaaccactctttccttttcctccctctttgggaagaggagaaagacaagtagagagaaagagagagagagaccacccactaatcctcttaattaaggcttaactaaaggcataatcttgtgttgttctagtcataattaaggccactccctcctaatgtgttaagccacaccctttcttcctcctcttcttcttcttcttcttcttcttcttccta

SEQ ID NO: 11310 - DNA, 1501 bp, Oryza sativa
tgtgcttagctgcacgatgcacacagcacaaggcagaggcagctgagaagtatagcaggagctcgtcgttgctttttatgacttgccttctcatcttttgtcctctctctctctctctctctctctctctacagaggttatgcaggtactaggaatcagcaggggtacgtgttgctctgtgattgggtggttttcctggcgaagggtggcccacgtgtcattcgcatacatgctatgtgtatgcatgcactcatcattcagcaagcttgaaattgtgtggttcactttttgcaatttacctaaccatgtcataacttaagttaaacaggttttatgcaaattaggtgtttgttatttgcacagtggcggataaaaaaaaaattggttcgttggtgtcataacgtgcctatcgatatcataatatgctaatcctatcttactataaagttatcccccactaactccttaagcttaacatgcaaagatgccacattatcattcactaacaagatgccacatcatcatccactaacaatcatcacatttaaacattatgcaaacatgctatatctttatagtttttataattcaagagcttttcaaatacaaacatgttaaattatcatccaacataattcacataatgtttcaatgtatatctttattatgttttatgatatcctatatacttatatagttcatcctcacttagttagtgcttaaatgattaatttatggtccaaattatatttctcctttttttccctctaattaagtcatatcacattaattgtttttagcctttagatgattaatctacggtccaaactatctccctacttttcttcttccataaagtcataccaccttactttttgtgtttgaatcactattctacatactatttaaatttaaattatcataaaccacattaatttacttaatctgatattatctagctatcttacacgttttctttttattgttatcatactgaattttcgcagcaatgcgcggggtttcacctagttatacttagatcgtagtgttataatatatagacaaacaatttaaccgtagattttatcaaagtcatcaatgtcaactgacacggtatttacactgtagatccatcctgttggcatacaaaagcgtgacaagcttgctccttcatgtggttttaattttgttgaccacttaatgttaggcatggtagctaatagaagtatgatcagctttagcaatatgaatatgccaatcaaacaacctctcagctcatctgtcgtagtgcaaggccgatggcatgtcagcatgtgtgtgacgatgaaagcaacaaagatttgtatgattaattgcattgttattcccttctttgtggtgcaagatgcggagttcgtcttgatctcctgtgctatattagttccctcgttcttaaatacttcctccgttttacaatataaatcattctaacatttctcacattcatataaatgttaatgaa

SEQ ID NO: 11311 - DNA, 917 bp, Oryza sativa
aagaacacaatgatagagcatgattttagaaacatttagaaaaaagaatcatctaatttgtagttcatatgagtgagatacactagtttcaaatttttcaaattttatttttgcatacacctccttaagtggcctgtatggaaaaatcgattttttcatacgggcgcttaagtgagccgcatgggccgtcttaaagaggcccgtatgggaaaatcgatttttctatgcgcgggccgcatgcaaaaatgaccctcgatttttgcagatgccactagttatagtccgtttgtaagaattaaggggtctcgtatagaaaaatcacttttatagtagtgatttatgcaaattagagcgtggactaattgctggctattcaatcttgagagagatatgcatgctctggctgacctggagattgcagccaatgcaatgcaatctactgccagcttggttgtgattgtgattggttgagaggataaggtatgtgaagaaatagttttattttgggacaaaacactgtgctaaaaatagctatatttcaagacggagggagtatacaattaaccagtgacacttggtagttgtatataggagtagttcatctcttatcttttccgacatccttatccagacctctcgatctactgaactttactgggatccacgaccaaattaaagaagcttttctttctttctttctccttgatctactcggtacgttacgtagcgtagcaaactgcaaaagatcaatcacactttgtgctagctgcttgtttgcttcttgtgcttagctgcacgatgcacacagcacaaggcagaggcagctgagaagtatagcaggagctcgtcgttgctttttatgacttgccttctcatcttttgtcctctctctctctctctctctctctctctacaga

SEQ ID NO: 11312 - DNA, 1501 bp, Oryza sativa
agcaccaagaacacaagaagagctaaccggagcagatgacaacacgttgaaatttgttttgcttacttgttgccaagaagggcgtggagcttgatggtgagctcgtcgtcgtcgtcggtgaagttgccgcgcttgaggtcggggctgaggtagttcatccagtggaggcagcagctctttcggcagcggagcagccccaccgccttggggagggagagagggtcgatggggagagcgcgccgcttgtcggcaggcggcggcggggcccgtggtcgagcacccggcgcgttagaacatctccaccaccgagctcgccgtcgcgccggccgccacctctcctcctctcccgccgccgctatcacgtcgaccgtctctctctccctctcccgctgccggccacctctctccccctctgtcactgcgcctactcaagacttgagagaactcggagagaagagaagagaaaaagaaaaaaaaaagaaatgcggaacccacaccattgtctcacttacatgtagaccccacatatttattttattttattttattgctgactatgatgccacgttagcaaaaccacccatatatactacctagggaccttgagtgaacggtttcgtataatttaggggtggagatttctggttttgtggttaagggacctcaaaaaatctcgatgtaaagttgagggacagccggtgaacttattcctttcaacaaaactgtacaatcctgtccagcaatgtgtcatatccaatcacaatccctcatattttaagataaaataattacttctataaattaaagttattattatagagaactgcaactgataatccctccgtttcatatcgtttcatattgtaagactttctagcattgtctatattcatataaatgttaatgaatctcgacaatatctatatgatatatgaatgtgaataatgctagaaagtcttatattctgaaatggagaaagtattatcggaatattgcaagctttggttgtcttgtaaaattaggcctaacatgtactacatatatttgtagtactcatggtttgtcaagttggacccacatgtcatatgtacatagcgcataaaaagttacagttttctgataaatgttttttttctattgttgcaattttgtgaaaaatataaagttaacgttgtggttaagtgatagttttgtttaaataattgcagttttctctgaaatttactgttgcttgttttaactccatgcgggcctaggaccaaagcccatggcccattcaattgtgcggtgggccggccatatcgtcaccgactcggaggcccactccgagcgcgaggcgaaccgcctccaacctgcgcggctcaaataccgaccatctcccaacccaacccaaacccttgtacaaatccaaacgaggcgaggcgaaccttcgagaagcttcgagaaggttgtggttgaggtcgaggaggggaggggggggagatggcggcgggaggtggtg

SEQ ID NO: 11313 - DNA, 1501 bp, Oryza sativa
gcaattcaatatatgggtttgcagccatgcacaactcagtaactgatctttaacggataactcatttattctagtatttttagagtttgctattttactactcacattcttataattacatattagaggcaaacgatcgcgagtacactcacgtacacatttacccatggatatatatatgtcctatataaattatacacacacacacacacacaaaatcttcaccaccaaatccactcacctgatatgtaccacatcatatggatttaaattatttaattataagataaatttaaatatccatgctaagcctgtgactgtgtgactcaactacaatgaacggattttaccacaaacaactcaaaaggacgaagctattatcctcgattaactttggtgctaactgctaattaacgttagttctgatcaagcacgtacgccaaatattaattggcagaaatatatgcatgtgtttgatttaatagacacggtatatatacaactgtcacttttttcgtcctgtcattttctttcgaggaaccacatattttgacctctaccgatcttttttcccttggcatgcatgtgtcgatctcgcttcgcttttttgacagaatatgcatatatgcatagaattttaataggagagatatctcgtctcgctttgccactacacctttttctttttttcattattgtccgatccgtgtgcctcttaatttctgatcttttttttcctcgaaatgcagtacatacacagatactagtataaacgtgtgcatccttatttatatgaacacacatacatcctacctctgtacgaacgtagatatctactcgcatgaaaaataattacaagggctactatgtgtatcgcgtaaaattatatatctagtattgaagaaattaatattatacttctagagttctactatacttccttcgttcaaaaaaaaaaaaaaaaggtcaaactagaaagggacgtgaaaaaccattgagacggagggagtatgcatgtacggggaaaaaagatatacacgtacttatggagtttgtaatcggtgaccggtaattagatcaagatttctttcatttctttaattaatttccaggaacacacatgcaggctgcgtagacgtacactacttttccttgagagtatagatacgttagcttctccagtagtggaatatatttgtactaacgtataacactactatacgtaaccattagtgctagtaatacgtagtactcccttccctccgtttttagatatttaacatcattgatcttttaacacatgttttaaatacttttgtaaaatatgtaaaactacatgtatacatataagtatatttaataataaatcaaatgataaaaaaagaattaataattacttaaaatttttaaataaaataaacggttaaatatttaaaaaaattaacggcataaaatatttagaaacgagggagtattaattatacttgtatgtatacgcagg

SEQ ID NO: 11314 - DNA, 1501 bp, Oryza sativa
atttgcctttctccttaatttcatcttgggaagctagggtttgaaattttgtgggacggagggagtagttaactactactctcttcgcccacaagagtcagacctatttcatattttactttcaaataagttgttcctatttatagtatttatgcatacaaaacttaaatagatagataaattaaatgtttgatcaaaacccgaggagtcatattaatacttattggttgcatgtgtgcaagataaattaatttgtgcttgttctcagggataaaagtaataggtgtaacttttgtgtaaggaggtagtagtttcaaaattttacacatcatctatacccaacctaatatctcactcttacaatagttagttgtagatatgtactgtatcattaatatctaacacaagtatctctctcacatagtttattgaagttcgtagtacaactggctagaaatatgtagcccgtttttcttctctcttctccacataaatacaaatatgatgtgataatttgtatggtccgcttaaatcatctcgttgaattcgctcgctcttactccctctgtttaaaaagaatcaacctaggagcttctaggacaatgtatatacaccctatgtctagatacattattctaggaggtcacgtccccttccaagtaattcttttcgagacggatataagagtaaggctgtgtttagttcagcgtaaagtttggattttttgttgaaattggagatgatgtgactgaaaagttgtgtgtgtatgacatgttgatgtgatggaaagggactgaggtttggattcaaactttggatctaaacacagccttagggccctttgaatcgcaggattgagaaaacataggaataggaaaaacgtaggattttgattggaatgtaagtataaaacagaggattgcaaaacgcaggaaaaacacaggaatgaccgtttgattgaaccacaggaaaaacataggaattggatgagagatatagactcaaaggaaagttagcaagaggttgaagctcttgctaaatttcctccaaaatccgattgtccattccataggaattttaaaggattagataggatttaatcctttgttttaaaggacttcatagaaaatttttctataggattaaaatcctctaaaatttatgtttttcctccaaagttacaatctgttccaattcctttaaccttttctcccccagttctatagtgcccgattgtcaacccaatccgtttgtacgcacggaaccacacggcaaaaccaggaaggaaagctgcccgcgcccactgagaggtgggccccacacgtcggcgtcacgtcaccccctcgacctcgcatccccaaccccctccacatctcatgctcctctcctccgcctcacgcgcactcgccggcgcaaaaccccgctcgcctgaacccttcgccgccgccgccgcggtcttactccgccgccagctcgccgcaggcatggcggccgcgccggc

SEQ ID NO: 11315 - DNA, 1501 bp, Oryza sativa
caggaattagccattccaaaccaggagtcaaattaattaccacattattaacattgatgaatagtgtgaaactaatcacgaaaaacattgctcaactcacccataaccgcgggtacggctattcgaatagtttaaactctgatcagaggtgtaccactgtacccacaagacacaaccccacatcatgtcaccatgtgcctcaataccaccacggtacctcggaaaggagttgtcacatcctgatttttgtcttaggatttataaattatttaataaattattaatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagaagttcagcaattatttaaatattaaattaatcattaaatggtctaattataattgttaagagcttttcttgtttaaaatccttaaattataaattgttgtttaaaaggaattattagaaataattttttaaaagcttaaaagagaagatctaattttaatttgttaaatctcaatataaaattgagctagataaaattttattaaatactatgcttgctcttctattttctagaattttttgggaattatttgaggtagggaagtatttttaataaatgaaacaacatttcacgaattattttaattgaaaaagttttaaaaaccctcctttaggttgttgggccgtttttggcccaactctttctcttttccgcgggcgaaccggcccaagtcggcccagtccaagccggcccaacccgacgccgcccgccccctcctccccttagccgccgacaggtgggacccacctgtcggggtcatccctaacctccagccggccgagctgccgcccatgccgagcccgagccgcctcctttcccctccgaatccgttccaatccggcctcttttcttccgtttgtttgaggggttttgatcctctcgttctcctctatctttcccctcaagaatcggagcgaatcgttgggtattttatccgaatcaaattcgttttcgagtttatctccaaaaccgagttttgattttcttggatcgatttctctcgtttggagttcgatctcttcaatccaatgctataaatagcatcccctagtcgtcctctaccgtttgccccaagtcccgagctctctcgtcgcccgtagcgctgccgcgccgttgccctagccgctgccgtcgccggcgaccttccagccgcgtcgcgccgccgtttgcgttgccgccgccgccttgtctcgccgccgttagatgcgcatgagggagagcaacctcggccgcccgtcccccttcgccgccgaccaccggagcccctttgtcgccgtcaagccgagccgccgccgccgtcttccaagtcgccggcc

SEQ ID NO: 11316 - DNA, 1501 bp, Oryza sativa
cgcccaggacgctggcgaccaccgatctcgccggggtggtcggcgcgctgaggaagcacgactcggagcggatccgcggcctcgccaccgacatcgtccgccggtggagggcggccgtgaagcgagaccttgtcaggatcggggtcgccatggagaagctctctcagacaccggagcgcatcgaggccgccgatcggccagtctccgatctggatgcgaaggtgaagcgcgcactaccggtggcgtcagcacggcgaaggcctcagagccatcgctgcccaagaggagtgctccggccgacatgggctcggcaacaaagccgaaggagccaacccatccgccgaagaagaagccgccggccgccgcgatggtgtcaagcccaatcacagtgacggcggcgagaagctgatgacggctgctacaaagcggaagctcgatgaggcgcagaagcggcgcaagacggccgacatggccgcagcagcaaagccagagggctctaattcgctcccgttgttgaagatggtggcgccggccgtcgttgccagccacggccgccgcgagagcatcgagctccacaacgacgaagagaagatcgccgctgcgaagcggaagctgcgtgagggctaccaagacgcagaggaggcgaagaagcggcgcaagatccatgtgatcgaggacccaaagatgctgaagcacaagcaggagaagatggatatccgatcctgagcgtgcggagccgagcaagccacgcctcctccatggccgagaagaagaagagcttcctcgtgtcgtcccttgggaggctttaggcttactagagatttacctctgaactgtaaatgaactgtgcgtccaaagatcacagtaacatcttgtattggcatgagaaactctctgaccctgtacacaacataccgtttctatgtacgtacgtatgactcgatcaatcaaatcaatcctgttagttaatgtaactggatagtatgtaagagtattaatgtattatcagtgaaatcaatggatcaatcttatgatcctcttaactttcctctgttttttttaacacatctgtagtacaaagtatataaaaaggtcagatgtgtcagttacaattctgttgagtgggtgaaatttccatacaataaattccctctgtagtgtcacaatcctgctgagtgagtgagctcattatttggttgcgtctccacgcctccagggctcaccgcccaaacttgtcgggactagctatccatcacgtgacagattttagatagttggattagactcatttgatcacttgattagaagagtctatacatgtatcaatatatattaattatatatatttcatatattttatttattagatctttgcttcgcaaaaaaaatatcaccaactcatctactaaaagttacaggtgtaactatactgtaactatagtgtaattacagtgtaactatagtgtaattacaatatacttacatgacttacaaatgtaat

SEQ ID NO: 11317 - DNA, 284 bp, Oryza sativa
aggggtgagactaatcacggtgaatctggttgatcgcccataaccgcgggcacggctattagaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagc

SEQ ID NO: 11318 - DNA, 1269 bp, Oryza sativa
  unsure (1)..(1269): unsure at all n locations
ggggggcgagacccttgattcattcacgacnaaggatgccacagtccagatcgatacgcattcgatattcaatagcgggggaggccagagcgcgccccgtatcacgttaatcggaggaccactttgaatcgagatggccggtgggtgcaagcgcctgtggatgggcaggcgagcaccgtgaccgccgtcaacccgacaggtaaagggaatggaggaggttggcgcatgacgccgcccatggcaggcgagccaggggcacggtgaaaaggcgagggaatgggggaggtcggcacacggcggcggttgccctagcgggcgaggcaagggcgcgccgtgcgtgtcgccgcccaccgtccgtccccgcgctgaccgcccacccccagtgcgccgccgcaaccccgcccattcccgggccgaccgcccctgcgtgtccggatggaggcggcggcggccggggacgaggaagaagcggcgatgcagaacgtggaggcggcgacagtgcgggacagagaggagggagcggcgaactccaggaaggagctccggcgaactccctccggtgcaggagggtctccgtgtccgccgtccacgtccgccctccgcccgcccccgccgccatccatccccatgccgagggggcggctgctcgtcgtggccgcggccatagccgccgccacctcctcgttccttgccgcctctgcgtcacccgctaccaccgctccgtgtccctagcctgccgccgacccgcgagagagaagagagagaggggaagagtgactggtctgccatgtgtacgccacgtaggataaaaccattctggattggtttgagggggataatttgtccgttattaaaagttctgggtgaacgatgtctggttttcgggtttagggggtaatttggttgaccgcgatagttcggagggctaattcgtactccctccatcctcaaaagttacacatattacatatttgagtttttccaaataagttgttcctatttgtagtctttatgcattcaagacttaatgaagagataaattaaatgttttattagaacccaaggagtcatctaaatgcttattggttgcatgcttggattcacttattgattttgtaacatccaaggtgatttaatttctccttggtcttggtgtcaaaagtaatatgtgcaacttttgtggatggagggagtacgttttcctttattttttcatcatgggttaaaaatatccgcacttgtaataacaataagatgttgatgtgacca

SEQ ID NO: 11319 - DNA, 1501 bp, Oryza sativa
gtatttgacaaacagattcagatatatcacttcagcgcaataggaatctacacatcattcagaggatcagagtatgacaaactgactagcagcttatttaatgctcaactcaactaaaatagaagcagcaaccttatttaagcgtggatacattcctacagacaacaaatttagccatgcaaagaaagaaaaaagaggataacacagaagctcacctccaaagatgtctagctaatgtagccggtaggtggtgactgcacaggatgaggagaagcacatgctcgccgtacagccgataggccttgacggcggacggcagcgcacacagccgattggaggagagaggagacgccatccactcaccatgagcctggatctggcgctgttggcgccgaaggccactggatctggagtacccaaactcgggacagctagatccacagccccccgagctcgggttgtccaaacttggagccctagccggcttgtggtcaccggcgttgcacctccacaccgttcgccatgaccgtgcctctcctcctgctcctgttagatctggtggaggggagggcgccgccgccgttgggccgccgcacgctcccctctgtccctgccaggccgccgctgcacacagagagaaagggagagagagagaagtggagaaatcgaaagaaatggagagagagagagaagtcggccttatctcctccgggagtgggcaccgccggaagaagaaatatctccttcggtttgggtatatagtggcacaactcaccggacgggttagtgcttaaatccgtttgaggtgagtaacctcacttctgatgggtcatccggttacgacccgtcacaggtaactagtcacctgtgacgggctggaagtagaacccgttacaaagtactatgacctaaaatcagtgagggaaaaatctatataatcaagggcctaggcctaatgaaaactaatccaccatataccttaatttaattaacttatggacttatggtgcactaaatggttgtatacttgtattgattcctttaacggttgaacccaaaacggtagcaccctaagtctctaatcaaggtaatttaatggggaacaaaaataaattagaagaacagatcaattctaatcagtgagaaggatcgatggattggatcatcaattctaatcagtgagaaggatcaattctaagctattgggctaaatacctatacaggatatatacctggatcggggctccgattttggctgggccctaggccatcgcccttatggccctgctccaaagccggccctgggagaggcggagagggagataaaggagttgacgagaagaatcggggagatattttcttttcctcccatccatgcttggctcagctcaatatgtgatggttctttaaaacaatctgacacagatatttataggtgccaatttttttataagatgctcaagatgaatgcgaaatatcttatatgtgtcatttagagcaa

SEQ ID NO: 11320 - DNA, 1501 bp, Oryza sativa
gccggtcggtgaagacgtagacatccaacaacggcggcataataggcaagccgtgcaggcggaaacaccagtcggcggcggacgaggcggccggtcggtgaagacgtagacgcccaacaacggcggcataataggccagccgtgtaggcggaaacaccagtcggcggcggatgaggcggccggtcggtgaagacgtagacgcccaacaacggtggtgtgaccaaccaaccgtataggcgaagacaccagtcggcggcgacgacggcaagctggtggtgatgttctgactgattcattcctggagcgtaagagataagcttaaagccatgaatcccttttgtgcatatctggatctggatcttgcagaacaaacatataggatgagtagtatctgatgtaaaaacagtcctcgatgaaaattcaagtactttaaaatatttataaatatgtatttcttctcttgtcaattttgatttccacgagcaaatgactcattacgtttaaacactctgcccgactagtcatagccaccaggcaccgggagtcagcctaagtacttcccaaacatgcatatgagtgacatgagttcgtcattaatggaacaaagtttcacggatcagaatttactactcgggtacttttgcaattattaagagcagaaaataaatttatctcatctctatgcttctgatttaattattccgagtaatactaagcaccttgcgttattcggtccatccaacgagcccccgggtgctaggaatcggcccaaaggcaactatccattggcaaaccaaacggaaagcataggaagatggaactccataactcgataggcacttttgtactcagattatgtcgcaagcaatcaagataaatattatgaaaattgttaaaaaatatgatataacatatgtagcccccgactcactagtcaacggcgaaccaattgatgtagtgaggtagaggaaaagaaaaatatcatataaagaaaaataatgatgacttagctttgtaatattccccttggtgatggcagaggtggccaatgtgggaacaaagtcgtccatcaataacaatgaagacaccaatcggcggcgacgaaggcggtcgacggtgaaagcgatgcccaccaacggcggcataataggccagccgtgtaggcggagaaaccagtcggcagcagcgacggaagcgagacggtcggtgaagatgatgtcgctatcagtagcaacgtagtaggccggccgtgaggacgaacaaaccagtcagcgatgaagtccatgtccatgaagatcgtgtcagtgatatcggaaacaacgtgcctgttatatggctgtcgcatagtcggacatgtaaatacaaatcatatctgattaggagataaaagaatgtgcaagcatgcatctgtatttgctccagtagattaattgactcatatgcactgatcgatgcttattggacgatcggtctcaagcctgcgattgttggtagcagcctg

SEQ ID NO: 11321 - DNA, 1501 bp, Oryza sativa
gattgcagtggcagtgcagagccatgctctgtcgcacgcttccttgcggaaggcggtgagaagcgtctctcgttcaactccaaggacggtgaccatggatgctagtagtaacgccgttgccagattccacatctctgtcgcgtgtttgtcaagcaaatccgtgtatatatactaatataggccttgtttggatccttcgggctattaaatagccctccgaaattttactatttaggagtattaaacgtaaattattgacaaaaccaattctataacccctaggctattttatgagacgaatctaacaaggtatattaatccatgattagcggatgattactgtagcattactgtagcaaatcatggattaatatacctcgttagattcgtcttgcaaaatagcctaggggttatggaatgggttttatcagtaatttacgtttgatactcttaaataacaagatttcggagggctatttaatagctcagagcatccaaacagggcaatagagtactataagcttaagctatatgtacagatgaaactgaatcttcttattgttttttgtgaatagcccgtactatcctttgagtttcactccggggttagtttaatctctgatgtttcattttatccaaacaaaccgttgaaatctagcatttggcttaacgcggtcgttaaaccgaacaaaaaaacaccacgtggcattgccatgtcatcctcgcatgcaaggacaacaatcaaactaccattccatccttatatatacaccatattgcagaaaaaggaaaataagtaacaagccagaaactcatgacataaataatatcgggtgggctttctatgattttaccttttcacgtcatttttttcttgacaattatactcctcaacgtgtttactattatcaaacgaggtggtactataaatagatctaaacccttagataaaattaggtctacaatttagattattttttattactagtaaagagcatcatagtgtaccttttaaaacaagcatgtcctagctataactaagatctagagaaaatacttaagctgttagggtgcgcccggcccattgtactatgggccacccatattacattgggcttgctccaccacagacccaactggagccacaactttagctcttttctcgcaaaattaggaagccacatcaccggagaaacatagagcatttgatttcagctccaaacgatgtaaaccgttggatccttaaattcgtgaaacttactcctgactcttgacgaaacttcttttgcaaagaagacccttccgcatcctcacgtgagagaaaaggagaaaaaaaaagaaggaaaaaaacttgctttccttcgtcgcttccgctcctaaatcacgccgcatcctcttctctcttctcctcatcgttgtcgccgccaccgccgcttcctccaactcctccaatgcctctgcagtcgccactcctccttgtcatccacgcattcaccatcca

SEQ ID NO: 11322 - DNA, 1501 bp, Oryza sativa
atgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgttcggctcttcgctgccactggcgttgttcgagtcgcgtgaaccattccttatctccatctgaaggggataggtagaaatatgagaaaaggaggaaaaacaggggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggaccgacatctaaagtagacaagggataggaaccaattcatgctcaaatccaaattaaaccaagcaaaagaagactcaaataaataaccgagcatgatgatttttatgcatagaacatttttcatgaactcaaataaagacactaatgcaactaaacaataaattaatgcatagactagttgcatagaaaatgatgcgcataacattgcccccatcgaatatagacacgacctaatgcataacccccaataaattcccgactgactgtcgaataaactccaactaaaatttttctaaagccctagactgagctaataatttttttttaaaaaaaaaatccgatccgaatgaacgaccaagatttttcccgcaaaccaaagaggcaaaactccaaattttcccgaaacaattccaggtgcaaaaaggcatatgcagatgaaaaaaggggttcagagggctcttagggtttccagttggcttgtcttacggtcaaagtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagataaaccgggaagcttgacttaagc

SEQ ID NO: 11323 - DNA, 1501 bp, Oryza sativa
tagtgctggacttctcgtgaaagctcaaggatacaaacatagttgaattgtaaatacaactagcatgtaacaacatttagattttaacatgaagttattctgctattagcatatggttctgttgaataaatgaatcatgtgcattggtttccttgtgccacaacttttatgtgttaatatttcttttcttctgagcatgacactcttgttaataatgattataatgatgtttctggtgtcctaatcctaatagagacgggtatattgctttagcaccaacaaaggataatagtgaaatgatttttttcgctttcacccattaactaacaatccgttgattagttatatgtaaattaatctatatccattgatttagaatggaaggattagattgacataatatcacactaaaacgtccctataaaatatcaaacaatacgattccaagaatgatctagtgaggaagatattcattgcctcttcaattcctccgtctcaccattttccgcggtgctctctctctcttattggtgagacatcatatattatattttcttcggcgtttttgtgacttgtgtcacccttttcctccaccttctaatttgttagtctcctcacccaccgttggccctcctcacccatagctccagtgccaccaccgccctgtcgctactgtgcatgtcctccaagctatccctataaaataaaacactgtctctaactcttataaccaccttctcgactttagaatctaactagctagcattgtcgtcggagaagaaaaagggcatgatctccaagtctcggtgaaaattaaatgaaaacagaagaaatgagaattcttttaaaggaaaaaaaacaatgagaattttaggtgactgaaatctagccaaccccagatccccttctccctttacaaagtagattaaaaaagggccacctatacatttgtcgacaaattttcttctaaaaatttgacagatataattatagtacaatcgtaatgtaattacactgtaacttgtatgtaactatagtgtaacttgtatgtaagtttcacgtaattttgaatcgttagatctattacaagatttattctggtgaggaagaaaaaaatcacagcacacacatatgtgaaagaatttgttccacgacctccattttatcgaaataatatgttacagagagatttttgaaagttgcatacaacttacattatagttacagtataattacactacgacatctgtcaaatttgtgggagaaaatttatcgataaatatatagcaaaactggaaaaaaaaagagtttacggcagtccacttcggagattgttggcgcacgagcgcgcggctcgggcgctcggcggccgaattcggcacctctcggcccagttcgccagttcggcacccgaattgctctctgctcgtccatcgtcgtcgtcttcgtccaacgctccaactaaccacccctcccgtttcgtcctcccctctgcgttgcg

SEQ ID NO: 11324 - DNA, 1501 bp, Oryza sativa
atgttttcaatagaccgctttattcttaatattatcaacgttcacaatatatgataaatccaactattaaagggccacatctattttttattaatgcatgtgagagctctttcgaagtactcaattagcccaattaattagactcaatatgttgcttaagtagtattttacagcactaccgcacatactaaaaaaatcttacaaacttttcattcattgtttttaatttgttagaagttatagataattaaacactcaattgatttatgtaaaagtctattcagcaactaacattaatgagaaactgagttaaatagaaaattacttattgcgctggtagatgcaaaccttcacattaatagctatgctatatttaatgacttcaaactatttggtcaaattcgagcaaagaagttatagcactgaaaaaatacatatgtatagatggaaataagaaaatatgtgtagacgatcaacgaccagatttcctggttaacatgggagctcgtataaagtgtccaatttgagtatatagaacacaaatgaaaattctactcaacccctgatgtaaagttgggatataaatcaggaccaagggaccacatgaaattaaatccatgagcagaacttatacatcttttttctgaagaacatgcaaaaaaaatgcctattgcattagaaaattaggatggttaaaggtcaatatgaaataaagggatggtcagaaaagctaagttttacaaatatatatgttatactcccggtattaaatcccctagtttatttgcccatgatatatataaacaccaccacctgctttcctacttaatttacttttgaatggggaaagaacctttggaaaaactctttgattgggggagagaacctacagaaaagttgaattagtgtgcagcaaaaaagatagatggttgatcttaattggcttcgaaaataacatcatgtgtaaattaactaaggttgcttatgggttcctaattaaacattggttagctagaaattaaatctccacacaaattaaaaaccatacaaatccgcagaaaataatcatcaccatgtaactgagaagatcatatctcatctcataaaataagaatctcccacccagctgatttgtgcatatatattgcggtcctctataggtcgagtaaagggatttgtgtgcatatatagtgttgtctataataaagaacattaaaaccaagaacaggttgtttttcgcagtaaagaatcttattcatcttaagttgttaacataacaagcagctgcttatgtgcgaagaacatccaaagaaataagtactaattaacagcaaaactcattattcctcaaaaataaatttgaaaaaggaaaaaaaaactcatgcacatgaatgttggcatagttagaatcaagcaaccactttcagactcgaacaatcagtacacaacaaataggcaaatagaaaacctcaagaaacttctatcaacagaaatcaatcga

SEQ ID NO: 11325 - DNA, 299 bp, Oryza sativa
  unsure (1)..(299): unsure at all n locations
tcttttctctctttgttggtaaatgaggtagggtattctagtgattcgtacctgttttccgacagaaagctttggctgaaaggatagnaatagctcttgcgcaaggaatataaatagcgtacgcgtactagtccagggaatataaaatatcttacccgtgaggggaaggcaaaagggaaaaagctagtattttgaaaagggtatagtagctggtattcggattgagcagtgccataaaaggaaagcgttgttgtttttcctgttcaaccaccccaacttgtgacgtataacgatgcagg

SEQ ID NO: 11326 - DNA, 1501 bp, Oryza sativa
cttttatttggatttttgagatactagttatttataggttaagttcgatatttcactccgtgggccggctaattaatgaaagtaattcctggaggggaatcaatcgaagagattgcctgcccatgctacaattacttactctttaggactagagtgctaagctgcctccccggcaccaccactataatgaatggctcaaacaaataggagatgagaaagtcgagtagcagcactgatgggaacattttttgaaactagaatggttgatagtcaaataggagactcgcgttgtaggtaaggcttttcaaaagcctcgacttggctaacgccctttggttttgaggatcaatttgcccgtgcttgctggtgtcagggttgcagataagttgtttcggtgccatttcctttgttatgaatgaaaggcattttggagatttgctcagttgataccgaatttgaagataagcccttccctctcgtgaacaccttcgtttagtagatcggtacggttccattcagaagaaactattatacgtggtcccgtggagtacgaataaggcttgaaagttttccttcatattgtttgctagcttccttctccttgtttcctgcctttcattctttatgaaattcttattgattttctttgctgactgacgttacaccaagaatttatttaatagcgtatatatagcctgggcatcgataccagccttccgttcgcatgatattaagaaagtgcctactactcaatttcgcattggcaaatccttccacttgctatctaatgtagtatataaagcctttcttttctatttcttctattggctggtctgggggaagcggatcacgcgaagatctatagtgtttaagtccatctttctcttcctgcaagctactgagatatgcctcagctgcaggtgctttgtatctttggtcaagagttggcaagggataccaatgttgtcgaccacctacctttgagcatagcttttaccatattcctccctcgattcgccattcattccttcacagctgagtcaatagctgtgtcaactgaatgtagttcttttttaaagaacgaggccgctaaggtcaagggacctgatccagaacattgaatccaaccatcagcattcgcaagaaagagaaagaactcggttcaaagaatcgcttcggtctaaaaacgagtcttccaagatcatgtctatgtgaagagcttgaaccaagcgttcacacgcatacgccctctgaagattggaaagaatccatcagcgagaaaatcaaatcgtattctatagaatatggtagtggtaattatataactgctttgaggaggaagagggaaattgtcaataactgtttgcaagatccacgtatattaaaagaatatataaataaatatgtgcaaacgcactatgaaatccgttatagatattatagtcctaattggaataatatgtgcttattccacaataatatcgaattcaatcaaccaatt

SEQ ID NO: 11327 - DNA, 322 bp, Oryza sativa
ctgcagcccctaacaaggtttgtcccaaaatatagcaacttctccactaacattcacttcccaaccaatcacttttcctaccaagctccacttctcaaccaatcacaaactcttcctatttagttctacttattttcttaataaccgatgtccaactctaaaacttcttatattctgggacggagggagtacttgattatttctggtgatcatgattgctacttatggttctagtggttgtgtcttttatcatgtccccctccttgactatattttgctgtggtgatgacattaaactagttacattttttccctttctagt

SEQ ID NO: 11328 - DNA, 1501 bp, Oryza sativa
gtcgacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttcctaccatccatatatagggaatccataccgtcggcttgtcgatccgggatcgcccaggatcgggtggaaggtcggagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaattgccttctctttctgtcttccatttgaattctgtgacttatcctgcaatttggagagtagttgatatggtctttcttggctttggctttcaaagtgcagttcgaaaagagtgagttgctgtcaatggcgggaatgaaatatataaggatagggtggaaaagagtgctccatatccatatatgtgcttggagggaaggccacatctttaattgtattctttttcgaggtcatcctcttcagcctgtgttagtagtgctagttttgagtttctttttagtaccttccctacttaggggttctatagaaaggcttagaggatcctaaagtgtcagtttatgttggaattgctttgctcttttctttctttgatgcttggaaggaaggcctataaccaatcaatagtaaacatccctcacccaactaccagtctgtttagagaaatgaagaagcgacttgggttgatttagacaatgttatgtatcgagaaactcaaggccactcttcctccgggctcgaccaatcaataatagaacaactcaccaacacaagcaagttgaacgagtagatcaatccatctgcctacccgcttaatcagcgtagcaggcatgcccacgggaggcaccctccaaatcactaaaagcagcactataccaccacaagtagagaatcccaatgcgcttttcactaggaagacgaggatgctattctttaaagaaccgagcttgacaagcatttcccatccatctttccccttcttgatgagcgcaccacgactcattcaaaagagagagtaaaaggaaggatttcccatgccaaaggatcggaacagatcgggtctcaatccatccgtacttgcaatttcatcatgatccttatcaacagagctaatcgatacatttataaacaatgataccttgctttgtgtttcccatctgttcaagtggataatcccgattcggttttcgagggttcgctcgtcatttattcgtagtaacgtcgtattgcctatgcagctaaatcgataggaataggatttatcaaaggaaagggcgggtggacatacgttgcgggtgtccagttggca

SEQ ID NO: 11329 - DNA, 416 bp, Oryza sativa
cccgcttttctttcgtattttcttctttcattttgtaaacaacctggtagcgaagctgcagcttgataattcataggggccatggtgtcaaaaccgggttacctaactagggaaaaactgttccgaagctcttccaaagcgtggcaggctgggcagcttttaccgaagcggaccccccgcccatagcaaatgtttgttgtcatatttcaatctagggggctgcggcacaacctgggtgtggagacatgaatgagtcgaaccctattcatcatgacgtaatgtcaaagaagtggctcggcgaggggctttatgctgattcaaggccgaaggacaaagctcttcctcttcgtgcttgtcctaaataatgatattcactgaggtgtgctggctctgcttcaatccgttttcttgctcca

SEQ ID NO: 11330 - DNA, 1501 bp, Oryza sativa
ttccattcattcaaccttatatatttgatccccttctcccaggtgcgagtctattattgaggaactgcgagctccttttctagagcttccttcccatttaggcggggtgttcaaaggggttccaccgtcaacttaagttaaggaaccccaactcccaatttggcatttacttcttgtgtttacagctcaaatctctatcgtcgtcttgacatccaattccttacggcagagacctaaaaatacccattgccggctttacttttgcctgtggagacggggtgtggcataccttcccaaaagcatacgggatcctatctttgaaaaagcaaagcgtcggctagttctattctaacctgactgacttcctcaccaccaccgcttacggctatttcacgcttatttcattcgtagggccaaaagaaagagctccaacggcggctaaaagctttgaagctccttctacccttcctgtgaatgaattggataaaagcctttatgcccgagagtgaaaggtgctccagcttgcttggtgaacactgacttactgaagaccggaatggaccaatgtgacattgactcaagaaggtagacaaaaaggccaactatagaaaagccaagctgactgaatgaaataccgcagttcactctgactccggttcggtacctactctatatctgaagattgaccacagcgtaatgccttaccgctttacaccttgctttccttattttagctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaatataaaatatcttacccgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccagacccatgccaactggacacccgcaacgtatgtccacccgccctttcctttgataaatcctattcctatcgatttagctgcataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaa

SEQ ID NO: 11331 - DNA, 1501 bp, Oryza sativa
agctactttacctcagaatccctctctagagagaattctctttcaagtttgaattgttccattaacccatctactgccaacacaactacttcttttctcttttcacaaataccttcttttctctctttgttggttaattgagtagggtattctagtgaatcgtacctgttttccgacaggaagctttggctgaaaggataggaatagctcttgcgcaaggaatataaatagcgtacgcgtactagtccagggaatataaaatatcttacccgtgagggggaggcaaaagggaaaaagctagtattttgaaaagggtatagtagctggtattcggattgagcagtgccataaaaggaaagcgttgttgtttttcctgttcaaccaccccaacttgtgacgtataacgatgcaggtatctggccagcattgaccgttcgagttgatgagcggaacccagacccatgccaactggacacccgcaacgtatgtccacccgccctttcctttgataaatcctattcctatcgatttagctgcataggcaatacgacgttactacgaataaatgacgagcgaaccctcgaaaaccgaatcgggattatccacttgaacagatgggaaacacaaagcaaggtatcattgtttataaatgtatcgattagctctgttgataaggatcatgatgaaattgcaagtacggatggattgagacccgatctgttccgatcctttggcatgggaaatccttccttttactctctcttttgaatgagtcgtggtgcgctcatcaagaaggggaaagatggatgggaaatgcttgtcaagctcggttctttaaagaatagcatcctcgtcttcctagtgaaaagcgcattgggattctctacttgtggtggtatagtgctgcttttagtgatttggagggtgcctcccgtgggcatgcctgctacgctgattaagcgggtaggcagatggattgatctactcgttcaacttgcttgtgttggtgagttgttctattattgattggtcgagcccggaggaagagtggccttgagtttctcgatacataacattgtctaaatcaacccaagtcgcttcttcatttctctaaacagactggtagttgggtgagggatgtttactattgattggttataggccttccttccaagcatcaaagaaagaaaagagcaaagcaattccaacataaactgacactttaggatcctctaagcctttctatagaacccctaagtagggaaggtactaaaaagaaactcaaaactagcactactaacacaggctgaagaggatgacctcgaaaaagaatacaattaaagatgtggccttccctccaagcacatatatggatatggagcactcttttccaccctatccttatatatttcattcccgccattgacagcaactcactcttttcgaactgcactttgaaagccaaagccaagaaagaccatatcaactactctccaaattg

SEQ ID NO: 11332 - DNA, 562 bp, Oryza sativa
gttcttaccacaagaccgggcctatgaatatgcaacaccgagtttatgaatttgcagtagtaggtcatattcacaaacggatgttggaacttaaaaaaagagtgggtgtaagaatctattaaaaaaaatcacatttgcatattcacagactcgatcttgggacaggaaccgtgtagcgagtgaatgaacaacataaagcgagttcaccagctactcagctcctgccacaagatcgggcctaagaatatacaacacgcagttggaaccagcagaacgtttatgaagaagagatgtagttgtgtgctaggtttggttgctatttataggggataggaagaagctgcgcatagtctgaattattaatgggttgtacacaggaattgtgaatgattagaaagagaagaaggcgcgtcggactgcttcactattcaattaataattacacagagatgacggcactttcgaagcgttagcctgcttcactgttaaagttaataattacaaaaggataccgtcacttttggcggcactggttgcttcactattttctttaataattaga

SEQ ID NO: 11333 - DNA, 1501 bp, Oryza sativa
atcctctcacctcactatttatatgcctctccacaatggcatgtcttagccatcgtataggatcaaaacagattctttgtgaaaccagtggatgcaatggctgtgatctctttaaattattgatggtttttttgatgtcatgctgtcattgccatgctacagtcattccttcatggtttgtggtgtgtttctttcctcggcctacaatttaaattattatttttattttactcgtatgttactattttctttctcatgtgttctttgtttatctgtttttgctcaccgcgatctgaagttcttcagtttttctactgcttctatggacattgatcctgatgatgttgcttcatggcaatgatcaactaagctccctatcagaccactattttttctatgatattcattcatacggcaatggttctttaagtttattctcgggtactaattaaagttcacttgctatttcataggaggcctatatctctgttagtatcggaatgatgcatgtcagcctaagttcgttagcatggatgaatgaacaatcttcctttccaacgaccttgactcagttgaagcaagcatcagaaaatgcataactctatcttgctattaattgttgaatttttgtaagttttttaatagttgcaaggtgtattttaatcacaacaatcaagtgtaccctacgcttgaagtaatgtataaatttagaatagtgccaacgtaggaatacatcaggctagatatatgttgcatctaaaagttttcttttatcatataaaagtgtcgcggcaacgcgcggggtagtcactagtttttgttaagactgacgaccgatgctatctcagcttcccgtcgcttgtctctgcaataatgttcttttcagctgatgggcgatatgcgctgctgattgttgctttcatacgatatagtattaacattcgatcctttaacgtgtttgaaaaaaaaaggaaaatatttgtttgaattgatttggtgtttttcaagttctgaaatctatacaggaccaatcattaatattaaattaatgtgatgtgagaactagttaatgctatggatgattcgcctctgcttgctcgagcttgctgcaccgctagctgttggtggggaggagccaggtgacacctggcagaaaaaataccaagaaatttactaattttttattaaaattcgttccagaagttcatactttaataattaagtcctactctttatataatcctgtggagattatggatacctcatacccacacggcgtggttatccgactagttataggggataacttatatctatggaatatgtaacagatcatgacttgggtattacgtttcctttatattatggaacggcctaaagtcctagtttgataatattgtaaagtagatttaggaaaccgataccgtattggttaaggtttctatcttgtaatcctgccctctatcctatataaggtggacaggaggccctctagggggta

SEQ ID NO: 11334 - DNA, 1501 bp, Oryza sativa
aagagaggtgccttttgcttgataggttgcccgcaactaattttatcaagttcaaattttgctctgccatgaggcaatgggcatcaaattaaaattttctatataattcatgtacatatatcaaactaaaattgtgctaaatgatatgcgtacgctcctctaatgggtaaattatgatttttacacaccctgggtaaaaattatgcagacgataaagaaaaatgtccagttctaccaaaacaattttgctgaactttttcatctcaaaaaatttaaatttacaaataagccctcagtttggagtatttataaatggccctaagataaaacttattaataagtaggctattttttttataagttggacaagtaattttgttatgtaattcatgtgcatatatcaaactaaattttgctatgtcgtgtgcatatgaaactctattgggtaaattatgatgtttccacataccccctctagagatagagatatacactaaatattatgtaaaggaaaaaatattcagatttgtgatttttttttacaaaaatacatcaaatttccttatgatatttggaaatattttaatcttcgataagttagtacaaaactaaactctctatcctaaataaattttacgagaattgaactagccgttctgacaattgtgtaaaattattgtgttctaaataaaccataaaatatgtacaatctattttccatgagttttaaaaacaaataaaattgacaaaattgaaaattgtagaaaaactagaaaactaataaatatatgttctaaataagtcataagtgttatatacacgttataaaagtaataaacgcgccaactgccgcgccattttctaattatttgcctaatttcgagtctgtatgagaaagttatgcctattttaagaaatgacacccgaatgacacctattttcggtagaaatttagaaaattctacaagtcacatatttcatttattcgagtttattttttttatggttggttcttgtgtgctcataagtgtgaaaaaaataaaaataaaaatgttggacatctctctcctctacgctatagaggagaagagaaaaaaaatggcgccggggaggggggcggcgccagccacactgatgccctccccctgccacctcatcaccgccctgccacgtcagcacaaggacggcgccagagtggctggcaccacaaaaagaatcatttttaggataagtttttttagaagtctatttacgaaataagtttttcaaaaagaccaaattgtgaaaaatccagcaaaacctcccgtttccgttcggatccatacagttttctcccaaaacgtacgcgtgttacagtgcagtgtaacggattttgcccgaaactgaagctccaccaccgtttcccccacagatctcactcctcgctgctcccccgccatggacgacgccgcgaaccccaccccgacttcctcctcctcctccgccgccgccgcagccgcgg

SEQ ID NO: 11335 - DNA, 1501 bp, Oryza sativa
agtaaagaaagggatatagcttaaagaaccaacatttgtaatgtttcgctaataattaaagtttggatttcatagagaacttgtggaattgtgttttcttccctagcttttaaattttcaaccctatgatgctacgggaaggtttgtactatattacatataagttaaattatagtatagttacaacgtgatattacaaatagttaaacaaattataactcactataacatctatataatttagtataaaaagttgcatatattttttaatactttatataagttatattatagttatggtaaaattatattataactatactatattatagtaaattttaaaggttccaaaaaaacttgtcgtagatttttaatagtccccttaaagttttaagctgaagaatgtagaaaaaaatatataggcattacaattttaaatggttttacattaaagactgtagaaaaattataggccttgcatttttaaacggagagagtatttaagtaggaaaaccccactcctacaaacacaaaggtatgagggtattttttttagtatttgaatatgattggactttttttcatatcaccctttttctagtaagtgtatatatatattctagttccagtccaattagagcaagtttaatggtatagtcaactgttagctctaattaatctatagttagtccaatagttaattcatgcaatatttaactataaatatatactacatcattaataagtaatcccatatgtcatacgcatattatgtcttgaagttcatactatagcctattttttttctctctcctctctttatctccttcacatatgcttgtagctgacttaggccattcccaacccaagacactagacagtttctataaactccacatcattaggaaattagtactagacactactcttccaatgcaagcaccactattctatactaaaatttagtgctacttatctcacatgatattttgaatgttgtgtagaaaccatgtctcatgcatcttttcttatttattcacttgttatattattttttatcctaggtggcagcttgttgggttgggaatggcctaatagtctggtattgttcatgctcttaacgcatgcatccgctcctttgttccctttgttcaggaccctgtgttctcactggaccaggaagcttcctttgtttcacctcgagatcattattcattagtgccttcagcgttccaaagaaaaaggaaagttgccaccagccgaccagcgtcgtccactcctgtccctctcgtcattaatcacgcattaggtagattcgtggttcttgatttgaataagtcgagctcaccatcatgttcctatccagccacatggaaaaagacgagcagaagaaacgacaagaatcctactccctccgcccataataagcgttgttgtaggtttaattgtctaactttaattatccgtcttatttaaaatatttttattgttattagatgat

SEQ ID NO: 11336 - DNA, 1501 bp, Oryza sativa
gctggtgatgcacatgcatgttatctctctctctcttaaaagaatccatggatgaaactgtaggcgaattttctcccgttgaccatttcatatcataaaacatgttggccacaaggatcaatttgacaaatcttaatggttctacatctatcgttccttcgtttttagcagtgacactatggagtatggacagagcaacatgatcaccaaaacacctagtttcattattaacatgtaggagtataaaacatatggaaatatacagcaatgttatactattatttgaaactaattttgaagataaatctggccacgacagtgtaaaaaaaattgaattgaagtacgaaaaaaaatatgaatgagcaagatttaaagttggcctcatcttttcgcttaattatatttatacttataagctaaaatttgaattttcatctttaaatttaaagctgattttgagttttttaatcaaagtgtattttttatcctttgtttttagatcgctaagaacacatatataaaagttttgttcacaaattatttttcatttgcaatcatgtcgttggcttatttcacgaataagccaaaatggcagggtaatttccttgccacgaataatgactatggttcataagttgacctgctaaccatcacaacgtaatcccaacgttggtctaatggccgggcacatgacaacccttagtttggtggaaccgattgtacgggtatgttttttttcttctgtgccgggcaattaatataccctatccgtcaataaatatttgatgttttaattatattattcgattagatttttgaaacgttgatcataaataattttacaaatgttttagatgattagagcaagtataatagtgagttataagcattctataaccttatgtggaggagagaggtaaacaaaaaagaagggtgttgactctcatgcaagagctagcttaacacaagctccaagacaaatacattaaatatataagtgagagatagagataggagaagaaaatcataactaatcttatagctaatctataatatgtgttgactttaggatgggctaatagtagaaagtaggctatatcaggccattcccaacccaatgactaggatggtgttcatagcattaaataagttgccacctaggataaaaaatgatgtggcaagtgaataaatgagaaaagagaaggaaaccatgtcttgcatgagacatagtttctacacaatatccaagacatcatgtaagataagtagcattaaatttaagtatggaatagtgatgtttgcattggaagagtagtgcttagtactggtttcttgatgatgtggtgtttatagaaaccatgtctagtgtcttgggttaggaatggccttattatctttctcttaaagagatagtacatgtatatttcattaataccttgaaaagtaatatcatgtacttttctacatgaagagtattgtacgtcgatccgtattaaaaaaa

SEQ ID NO: 11337 - DNA, 1501 bp, Oryza sativa
gttcttttacacatgttagaggtgagatcaaatgactaacaatacctccaatgcatttatcacttagttctactgaacgcgccccacgtgtttgtacttataaagaaagccccagtgaggcaatacaattttaattccaaattcaaacttgtgttgcccaattgtcaccattatattttaactgaacactgagttacggcataatcgtaaggtaaattacattatagtttaactaaataaacgagtttgggttgaggagtgcatggtcggtccgtgcccatccataaagaacacgatctagccaaacacggcgaagcctaaaagcaggtacaatagcaggctataagtaagccagctagggagaaaagcagcgggctacagatttgtaactagctgtagcacggactccaagacacgatgtgtatgataggtgggatcatgtattaatagtgtagtatgtaactattgtatgaatgaactactccctccatactcataaaggaagtcgtttaggacagcgacacggtctccaaaacacaattttgacttcttatttctataaaaatatttattaaaaagtgatatatgtatacttttatgaaagtatttttcaagacaaatctatttatataatttttacattttcaaactcaacaacttgagagttatttatgatttatattcccaagttttgacttaaacattgtcctaaacgacttcctttatgagtacgaagggaatattagattggctatagatgaattgtagctagtagttggctatactattaaacttgctctaagggtgcgtttgtttcagcagttgtgtggggattttcggtggctcgcgcaacgagataaatcattaatagtgcgtgattaattgagtattaattattaccacaaaacatattttatactagcaatttaggaagcatgctaacggaaatctagaaggttgtagtttggatcttaaggctaatgccctgtttagatgagattaactaattttagtctagtccctcccatccaatgatccaaacagcccctaaacttgaaccaaattcaaatctcacacagcctgccccacatcacacatcacagtggcgcaattcaaaacaaccaaccccgggtcccacatgtcacagacgcaccagacaaatcccccgtgtccgcgtagccgcggttcccccgcgccgctctaatcgccagcaccaccgcaccagccagtcagcccaccatttcaaacgccacactcactcacaccaacgcgcacaggcgcaagcccaaactccgatccgttcgtccgaatccccaatccaaaaaaatcaaaaatcccaacacaacaccaaaaaaaaaaaaatccccctcgaatctaacccaacccctcccctctcctcctcctcgattcaaacggtgcccaccctcgccgccggccgccgcgcgccgccgcagtagcccgacacgcatcgccgccgccgccgccgctggagcgttggcgg

SEQ ID NO: 11338 - DNA, 1501 bp, Oryza sativa
ggagtatcatggctaaagggagtgcctaggcccaaaaaataataatttcatttgaagctagtgcgctttgttggtcaatctgacgttgccgtaatgataaattttttaaccataagaaattgtctaacattataggttatcttcatgtgtttcaatttactccattcttgggtacgatgttttataggaataacatgatactatgcgcattggtgctacatgtttagaattggtagccaaggagcttttattccaatttggatggtacagtacctacagaatttcgtgctagaatctacgtaattttgaaaacgttatttcagttgacccttttattggcgggcgggagttggggggtttgtcccatcacatcttttttaagttcttctaagacttgttggatgtgtgtccatgagcagaggccggagatatagcccttttctattatgtaagaaaaaaaaccataatatcaaattgtagccaacattaaaaaatgggtccaggctagctatctcgttagctaaaagttgcagtcaactaaccaagtttagcaaggtgtggaggctagccatcccaagtccttcctcagtactccctccgtaaaaaaaacaaatttaaaactgaatatggtacttcttagtacaataaatctagacaaatatctatctagattcgttgtactaagatgtataaaatctagtgctagattgatttttttatcggacggaaagagtacaaatttgcaatctagtgtcaacgactgtaccatctctatgaatttgcagttttttacaacagctcaaatgaaatccaacagcttagggtattatttattaagtaggtgatagcctagtcggtgacctatttttccaacaacgctgttatagacaagagtattgtaaccgacaaccatgttgcataatattgtcagaccacacttttacaataatagatttgttatacatgagttcatggtacatgagttttgttatgtatgctaagaaaagttaacgagaaactatatacttccatagaaattggacttctgcaagactgcaacggattgtgctgaataactgaattctgagagatgggcttcggagtccgcaggtccatgttccaataaaccgagcccggtccggcccaacagtccattatcatctggcctgtcaaccctctgcaaccgggcctctcccgactcggaatctctcaaaactcggagtccgaatcgagcgaacataccttgcgatcgatcgagctcggatcgcaggtcaccccgcggccgagctccgattcggacctggctgacaaaacccagccgcatattactatataagcaccacgctgctcctccaatctctcaaccaaaccaaagcctgcagctgcagcgaacgagagcaccagcacgagagccaagcgtacgtgcagtgcagccaactgatcagactgagacagcgcgcgtacacggccgagctcctacaggctacagccatgagaagca

SEQ ID NO: 11339 - DNA, 1501 bp, Oryza sativa
ctacaaattatctagtcgatggtatagacaaattaaatattttttaaaaaaaacttaacaatattctatctgttttagaaaaaaaatattgaacttttgataagttcgactctggacatcgagaatgtctatattggactctaaaaatagttttgtctaagacaggggagtattatcatgataaaacaagtggtttaagaaattattttttaagaaagcatatttttttgaagatatctaaaccagtcataatctagatgctatatgttcagattttttaagtgttcgtactccataaatgttactattatcttgtggatgtttgcaacgtacggccttcctgatagggcaacaaactagggtcattatctatgagcagggatagatagactatacctgaagataatatggaaaagtcatatgatcagacgccgatattccggaccagttcttcaataaacacgcattgaacggtcaagcatagatcagtggcctgaatatctttaatttattttccatgaagtcattaagccattaacccagccagctgattacagtcgctgttaattttgtccaattccagcagcaggtagttattgattttgtaaccatcaactgaagactgcagggaacaaggcagctgaacattatgattgttgcagcggattgcattctgatagtaccattgaatcatagtactatcagatagactatcatctgattggtgcaagtaaaatcttgtcgctgtgtgtaaactacaaaatgattgatttattatattatggagtaataattctgtgaactcaattcgagtataacaaaattgcaatagctagatagagattggttgtcgcggcctgaatagtttgaaacctggatcaaccagttgactaagagccacttgcactcaataatagattaacgagaaggataatcatattttaggacctcgtattattataggccaagagatgcagaatgcaaggtcaggtacagaggattagcatcatttgcggtcagtttgacaggtttgtacgtattttagctccgtccatcccagacagatcactaaccatatccatcaaatcagatatatctgtcctactcaccctctaaaccaaggaactctctacactatggttaaatcacttaaatcgaactgttcagcgtaaaattcctgtaaaatatataatgtacaacaaagtgttaatctagctccagagatgtaggttttgtctgaacttcgttaataaaatcatgtgttcctatatcgtcatctgacgtgtctggggagcgatcgagaagtttaaccatcgttctgctatatcgtaacttttataacaatgagaatttggagtgagtgtatgtgttctgtactagcgtctacttcgaacggtactagattaatttattatgtgatggagggtacctccatatgatgttttgaaagaaaaaaatagagatctacctataaccattaatgcacaacaaggttgttttt

SEQ ID NO: 11340 - DNA, 1501 bp, Oryza sativa
tttagcactggaccaactcaccacatagccacacatgcataatgtccagaaacatgcccccttttaggaacacatgcatacatctcacccacatagccacacatgcatataaactcacccacatagccacacatgcatataaactcacccacgtagccacacatgcatataggcaaatatccagcaacacgccccctcttagcacacgtccaatgctggggctatatgtcatgccatgtgtctcacatagaagccacatgcgccatgcaccataacacactaacccgcgcaaccgcgagggtcggctctgataccatttgtaatagccctatctccagaaccgcatagcccagcccaaccgacaggctggtctacttacacataccactccacttacacattcgtcctcacttcgtgtaaaagggttaacctggaagtggcatagttagagggacaaggccttataagttgtttcaccttgctaaactagtaaggtggtaataaacatgcgtacacagcttttatgggccacgccgcatctaattgggttaggatgtcacggttgattggttggtctcctagcggttgtatcataatttctccataaattggtcatgtgctgtcattttttttctgtacgattgatttaagtttttgtgcatgtagttactcaaagtcataatgaacgtctgatccatctcttgcaaattacaagggcgttatgatcaacgcgataagttttcccccctgcagatatgcagaattcttatggtttaattgcacggtgatactgagataaataccatagcagacgtagttttgcacttttgctcatgtttatccatatagcttatcaaaaacttaataatactgaatttctgagtaaaacttttatatatatgccatgattaaaaattcaaaagttaatgtagtaaaataaactatgattaaaaatcataaaattaactcatgagatttaaaatttggcttataggtataggcacaattaaaatgatgctcattaaacccagtgtaacagtgcaatatggcaggatcagttatccatgaaggcttaatagttctttgagcactcttgccccagaaacaggagaccatctgttcgtggcatgtcattttactaagcaagtaaaacgagaatctgctaacaacttttcctctagcgtcgtctcctctcgggcggcacgggaggtgcccaggccgccgtcgcccgccctccctccctcctcctctgcctccgccgcccgaccggccgccagtaaagccgcgcagcggcaaggacagcggcggcggggcttcgcttcgtctcgccgcacaagggcagggggaggtctgccggcatcgggaggcagaaaccgcccagatctgcgtcggccagccggagttcgcggggagttaagccggcggtggggcagtgtgctcgggcgcggcctttggcggggatggcggcggagctttggaggcgctggcggcggtggaagag

SEQ ID NO: 11341 - DNA, 1501 bp, Oryza sativa
agatcttagctccttatgatactacatccaagctaatttttttataaccaaccagatattttatattgtagttgcttggtaaaacgcaatcagcattacacacagagctaggattggtaatagaagatagactttaatcccacaccaacactttcatctaaactcctccccttcctcaagactctaagtggcaaaacagtctgtatattattttcttggcatctcatacggaacaatttgttagtaaaactttctccacagaccgactgccactgcctgctttgatgcatcggaagccaaaccgctggaatttcacggtgattccacctattctgctaggtggagtgtacctacctccgctctccagctgttataagatttggttggtcgtctctttggtcaacccggctaataaagccctccagctgttgtttgtgtgagaacgtgggatgcatacaagatacggagtaattctttactcaaagttgaaaaaacctctccttttttctttgtttgaagaggtggaagtcaactttcttgcacatccatttgtggtttactcccatttccctctgtttgaatctggctctcctcctagtttctctctgaaagcagccttgcatttgatcagcaagaagaaagatcaagggcctcttcttctaggagtgagctgcagttctgatcttactactagtcaggtaaacaatatttcaataatcactagctggcagttgtcctattctgttttctgactgcatcattgaagaatgaagacaatatttactcttactcgtgtatccaatttttgccgttaaagttgcaaatttgtgtttgaggcccatatttcggtcttcttatacatggcctgatagagtttaagagtagagtagcccatattgactgcatctttgagcaataatttcttattttggttagttctaattattttcaatgtttattaggtgaatggattattgagtttcaagctgtaatggtcatttgaagaaaacagtatattttgaaaaaaagggaaataggtttgtacattgaccaacatggctacactaccaatagccaccggcattgggtgggtagtttgtcctatcatcaagcttatctttgagaaggtccaatcttatacatcaacccagtacaagtggcaatctgacttggaggatgatctaaaaaagatcgaatccactttgataaaaatccaattggtgctgggtgctgctgaaaggtcgcaaatgctagattgcaaccaagaagctctactttgccaaaatgaaagattctgcctatgatgccgacgacgtcatggatgaatttgattacctgattctgaaggcaaatgctcagcagaagagcaagctaagtagcttggcctccagttctcttgccatagtaaagcgtttggttggccaagacaagttcagatccaagttaaggagggtcctcaatagcctgattagagtaaaagaatgtgctgacatgctcatca

SEQ ID NO: 11342 - DNA, 1405 bp, Oryza sativa
tgggaaatgtgaggttgcagagcaccaatggcacgtggtgtcattgtgataggtgagaaacgatctgaacatgataagcgtgataggattacccagcaggaagaggtggctaaggtaaatgcaagagaaactaggtccgatgacagccagtctcaaaaatttactcaagatgaagatgtgaaggtaactagaaatccaaatcttgtacaatttgttggagggtaaactaacggaaggaaataaattattcttgttatgccttcaggacgtcaaactaatctcaacggttgtcaacaagaaaaggaaatcatccaatgggacccggtcgatggacaaaaacaacagcgaagataagcatggtgtgtagacgaaaacacaatcaatgaaagtgcatattttctgctgatctccttttcgtgaactaacaatctgctatcagatgatgctgaaggcgactcctcacaaactcagcctggtacccctcgccctgttttgaagaggatacgtaggggccctgctagaagttgtaagcagtcatgaagaacgaaaattgccaggtacctgttctttccctttttttcagctgtaacgaggcttgagcatttactctcttgttatgttggagtcaattctcagagtctcactcaccgtaatatgaaatcttgcctgttctctcttgctatctgcttcatgcctctgattagttcttttctctgcagctagcaatagattcctttgtttagatgccgatgcgtgatgcttctcttgccaaagcagctcttcccgtggtgtagttggttcccgatttgtctctgcttgcttaagcaaaactcaactcatcaatcgtagcggcttgtttatatatgaaaaaaaaactgcgacctcgtctgtaagtagtgtgcatcctcgctcatggaagttctatatataggctttagcttttaggtgctgaaatgtgtacagtagcctgtcagcaagctaggcgcgacagtttcgatagcatgattgttgtgtgatgatcatcaccagtatgactagaaaacttcttcactgcactagcgtgtgctttactgctactctcttcgtagtttttcgtcactgtgcctgtggtgagtgtgaaccccagtgccatttgcatgttcacccaatgattcattcactccaggcctcgcgaattgattcaagaatactatgcccatgacatgtcctaccacaaagcagtgttttccctgttatttattgtgtactctacatgcacttttttatgtagtttatgcacctctattatgtcaccaaccaaaaaaatggtactccgtactcaattgttttttcttcagatgatgctactccaacactggaccactgatagcacataactgctctgattagccaaacattttttttg

SEQ ID NO: 11343 - DNA, 1501 bp, Oryza sativa
atgataggaatgcacgtgtaaaacagagaattgaaaaacataggaatactatataaacatgcgttcggatagagcgtaggaaaaacataggaatttttaaagaacctacccactaactaaaatcatcatgtgtcagaggagtgaagcttgtgaagattagtttgttgattgcctcgttcccatgcacaggaaaaataaaaagaggttggagtggattgtttgttttcctgtggaatggatggccaaggaaattttccttcgaatttcctctgattttcctacaggggattcctttgatccgaatgctgctacagtacccgaatccataggaatgcagatcctatgtttttcctgagtttaccctccgatccgaataagccctaaggctagtaggcgagcggaagcggcgtccgccttcaatgctccttcgtatcgccagcacaaaacacgccccggttcgccgggcccaaaatcccacggcggcgcctcctcacccgctgcgcgctcgccgccgtggccgccgcctccgtttccgcctcgcctccgatccctcccggtaatgcccgccgccaccgccaagccctagcttccttccgctatcactcgcgcttcgtttttttttttggtggtgggggggttggttcgctaccaccgccgtggattccggtggttcgtgtgtgcgtgtgtgcatgcgctccgcggccggcgccggagtgctcgtgggtggttgttttttgcgagaaccggggcttgggggggtttggggttttgaggccaagtggggtttttggtggtggtttcacgactcgcttgcgtgcagtggtttggtacgcgatcggaggctcgattttttttttcattttctccctttagaaaaatgtgtctagttcaaacccctcaccgctctgatttttttctcctgttcttttttttgggggtaaaagttactgtgcgtggcctttgacgtttgggttttgaggtgaagtgggtagtggtggtgttcgtgacgtgctttgcggttgctcgcgtagtggttggtgcgtgatcgggagattcgggtgcccaaaattttctcttggttagaaatgtgtggaggtggtccattctctctccgctttcagttttatttctctctctgttttttttggtaatttactttgcaatcctattgatgcctttgatgcgcattaagaacttgttttctgagattttttttttgggtgctcatggtctttatagaagacggagtcttttgggatttttgtgggggttgaaggtggtgtcttttaccgagctcggtgtgtaaccaaagtattcactcctgcaataaatgcttaatgtttcggacaagatttggttaaacttttgaaactttgaccatgagtaacttctcaaatgcttagttttgtgtagatttgccttgaaaagttctatcatagcatcataagcttattctaatggtgaatgttttaaaagtttaatcaaatcttgtcctaaatgc

SEQ ID NO: 11344 - DNA, 1501 bp, Oryza sativa
atgtacacgctcgcatcaaggaaactactcgagtttcaatatcttctcaacaatttgatggattattgtcactgacatcatcaccaacacctctgcttcatcggccctgacgtctccgctgttgctaatggatgattatgtcttcgccgacttattatttcaccttcacagttgacctactacgcaaacgctgatgagcatctttgtcattatcatcggctgctacaccgctattgactggatcaccgacatcgtcatcttcatcaacatcctgtcaagcctcttcaacatagcccactctactaatattgatgggcaacttcgtcatcatatttgatcatctctattgttgccaatcgtcattaccatcggttgcatttgttgtcgtcgactatttcctgcattttcatgattggaggatttcgtcatcgtcgttgatgcgcgtctacatcttcatcgttggcttgttttcatcgccaccgactggtattctcgccttcacggatggcttattatgttgccactagtgggcatcttcatcttcttcaccagctgcctcgtatgtcaccgactgattatttcgctgccatggttacacaactttattgttgggtgccttcatcttcattgttggctgacctgactgctgccgactggtttcttcacctctacggctgtgcaacttcatcacttttgattggtatcactatcttcactaccaccaatatttttgccacctctgttgggtaatattatctttatattggtcgtcttgtctctatgccaactacgtcagctaccatcaatggacaattgtgactacgatagaaggacaagctatatgctcaggggcttactacctcaaacacaagtatcataccttcaatttggacttgttccggatacatgcaacatgaattcatgatcatgggtctattttctgtgctcaaggactagactatttattattccccgtaaaggttatcaactgaatacttgcaccagtcgggattcaattgttatatctattttggagtatcccataagggataatcactcagatcagaagctattcatatgagctacacttggtctatatcacccggaagatttattactcgggagcatgttatatgcgtcatcctttaaagggtgtcgaaggcatattttttggcctaggcctaatatgtctgcagcccacattttcaggtgtggtctgtcacgttcttttagggacttaggcactttttgcttaggccaaagtgcacgtgatcaagtgcccaataccttaaaatccttttataccgcagttacttaactttttaggagttggtacaatgcatcttaaaagctgtcaaacagtaaagctttatatagctgccccgctgacttttttatatagtcaaggcgctgtttgggtttatcaagcaattgattggatacaatatcgttgctttttgcgatgtaagtgtgcatttttattgaccaatattatggctta

SEQ ID NO: 11345 - DNA, 1501 bp, Oryza sativa
gtgtagaaatgagttttgagacgtttttattatatccgtgtcatcgttattagataatatataattatttatatagagaaagaagaaaataaacacactgatcctaatcgtcatcatcaaataccattataataatattataattatttggacaaaaaaataaatatttaatattcagtcttagattaaaaaagaagagaactgctacagaacgcatgtttgcagagttgcaatataaaaaaaactatctatttaccttcaagattgtcacgttaatgacttggttagtgcatgaactttgtaacctgcaggtgctgtgttcgagcctagatgaaagcattaatatcaaatatattaagatgtgcgtgcctatataaaagcgtctctatatttttgtagagatgcaatttacacgtctctagcaacgtcttaaataatataggtacgctttaaaaagcgtctccataattttaagacggtgcaaacagagacgatcctacgacgctttataaaagcgtctcagttatctgtgggagacgaaataaaacgtctctatcttacaaataagatgtctcctttgggttgttttgtgggttgttttgttgtagtggttctctacgcgtaggtgtcctccaatcacccggtcgaccgccctagctccggcgagctcgcaaaccctaaccggccgccattgctgacgtcagcatgacgtcatcatctcctttcccttttctttttctcgattttctaatagattaaaacttcagaaaatcataactaaataaccgtagatctgtttcaggtggttcaagtttctaaattcttctaaaatcaagatctacatgttaaaaatatccacatgtactgtttatgcttgtttttgtactgttttgttgatttttgtttaattgctttagtttccgacgttccggaggaaagcgtttctgttgaggaaggttccgaagcgtttgtggaagcccaaggcaagtcacacagatcccaaacaaccctttgagcatgttgatcccgtttaaagctattattttatttcaactatgcattgttttcgaatgtcatcgggtggtgaacctttcccagttaattaatggccgaagatgactttattttcctatgggttataatttgattagcatgaaccttatatattggattggttcagctaaatgctatatttaggtttgcttagccctgcatagaaacgttagctaactaaaaggggttaaatataaattatattacataattattattgttaataatggttatatttaatggtagctcacgatggtcaatcgtgtgatgttaattaattgataactaaaacctggataaggtgggttgtgagcatatggttttgatggttgtgctaatgacaattaaggaccggttcgcgagctactgttgtgaaacatttatcgtgccaaccacaagccagcgtgggcaatggctttatcttttgtgtagcatgattcattatagt

SEQ ID NO: 11346 - DNA, 1501 bp, Oryza sativa
ggcttgtcctacggtcaaggtcggctctgataccaacttgtcacacccagaaattctcgaaccagaatttctaagctgattgtgcattaaatccctgtccaggaccagccagggtacacaaacgacatttgttgacatacagacccacgtcttacaaaaatataaaagattacaaatgcagcgagaaagataaaagcgagctaaaccgggaagcttgacttcagcagcgggcgaccccactccacaggcaaaccttgacggcagcgacgaaaccaacctctctgaggcggctccatctgagaagaacttcaactctggtgtgggggaaaagagagcaagactgagtactacccactgtactcagcaagtcataccggaaaaggaggtatgatgcaggatataaccaaaggaagctaggggttcttttgcataaagcaggcatttcaaagcagtagttgaaagcagtaaaatagctgtagtaattaatcaattttaaccaatcactgtccaacgctacaccacgttgcaacaagcccaaccaaccacctgaactacaccagttcattacgctaaactaggggtgagactaatcacggtaaatctggttgatcacccataaccgcgggcacggctattcgaatagttttactctcgccagaggtgtacaactgtacccacaagacacgattccacacatgtcgccatgccccgaagtatcaccatgatactgcaaagggggaaatcgtgacaagatcctccacctaaccctcccctaaccatccacaccacgctaaggtttcacccccacccctcaaaaggcagtgggcggtcccctcttgcgccgcggtgaatccggcagctggacaaccgaacacctcggccgacccaactccatcacgcccaccctcaccaccggtgcctaggaaagggtcgagctatacttcagatcaagcagttacccactcccgcttgtggtcagcacggtaagtctcccagggtttcccgtgaaccggtccttaactgccatgggtgcgaccagcaaaaccatgcactcacagcccgccattcagaatattttaattaactgacacccttgcggtggcgccaatctaaagctatgccaatagtcagagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatatttgtaaattgggtacaatatgatcaaacgtattgcatgacttgccttgctctcgaactgatgagacctcagcaacgtcttcgagaaaccgcggatcgacgaaacggccgaaacctacgcgacaaacaaagcacacaagcaaaacatgctataagactactgaaacaggaaacaaa

SEQ ID NO: 11347 - DNA, 1501 bp, Oryza sativa
aagggtgtcagttaattaaaatattctgaatggcgggctgtgagtgcatggttttgctggtcgcacccatggcagttaaggaccggttcacgggaaaccctgggagacttaccgtgctgaccacaagcgggagtgggtaactgcttgatctgaagtatagctcgaccctttcctaggcaccggtggtgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttaggtggaggatcttgtcacgatttccccctttgcagtatcatggtgatacttcggggcatggcgacatgtgtggaatcgtgtcttgtgggtacagttgtacacctctggcgagagtaaaactattcgaatagccgtgcccgcggttatgggtgatcaaccagatttaccgtgattagtctcacccctagtttagcgtaatgaactggtgtagttcaggtggttggttgggcttgttgcaacgtggtgtagcgttggacagtgattggttaaaattgattaattactacagctattttactgctttcaactactgctttgaaatgcctgctttatgcaaaagaacccctagcttcctttggttatatcctgcatcatacctccttttccggtatgacttgctgagtacagtgggtagtactcagtcttgctctcttttcccccacaccagagttgaagttcttctcagatggagccgcctcagagaggttggtttcgtcgctgccgtcaaggtttgcctgtggagtggggtcgcccgctgctgaagtcaagcttcccggtttagctcgcttttatctttctcgctgcatttgtaatcttttatatttttgtaagacgtgggtctgtatgtcaacaaatgtcgtttgtgtaccctggctggtcctggacagggatttaatgcacaatcagcttagaaattctggttcgagaatttctgggtgtgacaagttggtatcagagccgaccttgaccgtaggacaagccaactggaaacctaagagccctctgaacccttttttttcatatgcatatgctcttttgcacttggatttgtttcaggaaaatttggggttttgcctctttggtttgtgggaaaaatcttggtcgttcattcggatcggatttttaaaattagctcagtgtagggttttagaaaaaaaaatctatttgggggttttaaaattagctcagtttaggtttgttgcttgtgggttagtcggcggtcgatatcatgtgtcagtggtatgactgcctcaattaggagttgcgtgcctctttttcagtgttttaatcaagattaagataattacacttaaattcataagcaagattagtttctaagccccctgtttttcttccttttctcatatttctccctatccccttcaga

SEQ ID NO: 11348 - DNA, 1501 bp, Oryza sativa
cctggtttggagatagaactgtgcagccgggatggttgttcagaatggttgggcctatgcaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcatcttgcaatcattcatcagaggaagagttctacagtgaagctgatggtgtggaggattaggtgtagccctggtcaagctgcctgtggagtggagccgtctgcgctgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatataagcatttggaattttggatagaaattccgggcgtgacagttttttagagcaggtacaatagcaggctataagccggctgtaaccatatatcgagaagaaaagagaagagagagaagaaagcgggctacagatttgtagccggttgcaacacggactccaagatattatgtgtgtatgagaggtgggaccgtgtattaatggtgcagtatatttttatagttaactattgatgaatgggctattagattggctatagatgttttggagccagtagttggctacactattgaccttgctcttaaagtaatccatttcctatcaacaagcgtgagacacgtgtcaaccaatttattaatcccgattattttgggacagaaccacccagtagtagtccgctagcgatggtttctagaataatgctctttcagtcccctcctttactcatttttgggagacggcggcgacagaccaaatcgggccgatgtagcaacccctgccgctccctgccgacggatccgtgtgaaagactgtcccaggtaattgttgcgctctctatcaacatttctgctattttaaatctcatttcttttttatcccaaagcgaagattggagacaatccccttcttcgttgctgacattactgtccctgccgccggccgccaccccgccagatcaggccggggcggcacggatctagcggtcgccgccgccgccaccggggcgactcccctggccaccggagcaggctggcgagaagccccgccgccgccatccttacggtctttgctggcgaccgctcaggcagcggcgaggtggaggaggaagaaggagcgggaaggggtggccggacttgtcgcctccggagccgtcccgggggtagggcgacgcaagagcgtgacggttgacgctgtgaggtcccttcagcggtgggaacttcatggctgcggatcaatggaggcggtggcgatgaccacggatcctgaggcggggccccca

SEQ ID NO: 11349 - DNA, 1501 bp, Oryza sativa
cggtgcggacgaatcgggcgaaggcgcggtggaaggcgcgctcgcggccgtggcggcggcgcttgctggaggcgccaatgccgtcggcgtgctggaggaggtcttgagcttgtagtcctgcttcttcttgccggggcagaaggggcagcggaaggtgccgtccgggttgcgcacgcggtggttgccggagcggaggaggccgtaggacctctcctcgtagtcgctctcggcctcggagtcgtcctcggagtcgccctcgtcggaggagtcctccgccgctgccgcggacgtcagcccggcggcttccgcggcggcctccgcctcggcctcctcgtaggggtcgatgtagtcgtccatgtagagatccattccgaggaggaggaggagatcgaagggcggccggcggcgaggcgcggcgcggcggcggtggcggaatcggcgagagaaggcaggggggttttgggggtgtacggtggaagggggagggaggtgagggggagtgagagttgagttggtgcggtcatgatgatgacgggtgggtcccacctgtcggtggtctgtagggcccacatgtcagggagctttgacctgacgagctgatgcttcgtactactccatgggggtttatgatggcctgtgcttattcagtgcgtttgtcgtttgttcttgtctgttgagcgttgcaacgtgtaggaaatgttctgccagcataaacgggagttcagaatccaagagcccactcgaaatcgcatggttggaaaaactgagaaataaaaaagaacgtaaaattagaatacaagtgtaaaatagagaattgtaaaacataggaatagtcgtctgattggattgtaagaaaaatagaaatcggttgagagattaatatagactaaaaaaatttctaagcagttagaactcttactaagtttcctccaaaatctacatgcaatgagccatttcatataaatttcataggatttggaaagctttaacctttgaatcaaatgatcacataggaaaaattccattaagatttgaatactatgaaatcatatataaatttttctgattcaaatggccctaaattgaaaattgcaaaaccatcatctcatctcagtttcagattcccctctaagctataaatacctcctcattcatcttaattttgagatttatccccaatcaattttgctcccgtgttttttctcctctttccacctgtgttatgttcttgatggacatggcccttgacacatcttcattcttagcggcacaatgtcataccaaaatcatctactgaatttgaatgtgccaaagaaaccagccgccaccgaatcccatgagccaagcacaacatctcatcttccggtatcccatagtggagacttacgatcgccgtggcccaacaacgtggtgagtgcaatgagtgaggatgcgctaatcgtgtcatctcaggcttgatgtgcggggaatttcttgtctatcagtattcaaatatgagtgt

SEQ ID NO: 11350 - DNA, 1021 bp, Oryza sativa
ggcgaattcgagctcggtacccagtttaattctctttcacatatcatctcatcattatcatggcaatgtggcgctcatgtctccacatgctgtatgtcaattaccttccctaagataattgcccaagcataaagcattttgacaaatatgaatatgcatggatcaaaattagcatgggctaagcatttgtcaaatattgactaaagacacacgatatcatggattacaaagactatatggatcatcaatatcaaaggtatggcatataacaaggtaggacattcacatataaatagcatgcaaactttatttaaatcaaaataagttcgcaataagtccaacatgctcaaagattagtgatgacttgccttgctcgcagatttgctgacccggatcttcgattaactcagcaactccttcggaatctaaatttacgtgcgaaagatttgatttgaattcaattagaattcaaataaaatcaccaaaaattcaaaaattacaaattaaatcgagaaagtggtaccaacagttagatcttgattttagataaatttaggttcaagtttcattcgaatccgagttaaaatgagtgagttatgcaagtttaaagattcaaatttgaattaattccaataattgtgaaatgttactattcataattgatttatttttattccagcattaaccgtatgtggtagtgactgacaggtgggtccattcttatttccttttctttatcttattctttcaaaggaaatgagatgtgctattgacaggtgggtccggcccctttttgactgtggttaagccggccatataatctccggtgggtcccgcctgtcattgtaacaaaatctataattaagtttacttagattttaataatagggaccccacatgtcattgagtgggttaatcaccattaggtggaggattactgtgcgcaaactagatgtgggccccacacggtttctctctctcgtccctttctttttcccgtcgtcttctacctctcgccagg

SEQ ID NO: 11351 - DNA, 1501 bp, Oryza sativa; identical to SEQ ID NO: 10026

SEQ ID NO: 11352 - DNA, 1501 bp, Oryza sativa
gggagggaaacaaaagaccaagttactacgactccaaacagtgggaaaggcagagcccactactctcccaaaaaaccctaaaattagcaatgccagctaacgaccatagatggccctctgagaggatggattgtaggacctccgagaccgaagatagtgtagagttgaaaaccttggagttccgttccttccacagttgccaggaggatcagagaatcgaagccgggatggagatgctcaggcaagcatgccctagacgaaggccaccagatacactcatatttgaatactgatagacaagaaattccccgcacatcaagcctgagatgacacgattagcgcatcctcactcattgcactcaccacgttgttgggccacggcgatcgtaagtctccactatgggataccggaagatgagatgttgtgcttggctcatgggattcggtggcggctggtttctttggcacattcaaattcagtagatgattttggtatgacattgtgccgctaagaatgaagatgtgtcaagggccatgtccatcaagaacataacacaggtggaaagaggagaaaaaacacgggagcaaaattgattggggataaatctcaaaattaagatgaatgaggaggtatttatagcttagaggggaatctgaaactgagatgagatgatggttttgcaattttcaatttagggccatttgaatcagaaaaatttatatatgatttcatagtattcaaatcttaatggaatttttcctatgtgatcatttgattcaaaggttaaagctttccaaatcctatgaaatttatatgaaatggctcattgcatgtagattttggaggaaacttagtaagagttctaactgcttagaaatttttttagtctatattaatctctcaaccgatttctatttttcttacaatccaatcagacgactattcctatgttttacaattctctattttacacttgtattctaattttacgttcttttttatttctcagtttttccaaccatgcgatttcgagtgggctcttggattctgaactcccgtttatgctggcagaacatttcctacacgttgcaacgctcaacagacaagaacaaacgacaaacgcactgaataagcacaggccatcataaacccccatggagtagtacgaagcatcagctcgtcaggtcaaagctccctgacatgtgggccctacagaccaccgacaggtgggacccacccgtcatcatcatgaccgcaccaactcaactctcactccccctcacctccctcccccttccaccgtacacccccaaaacccccctgccttctctcgccgattccgccaccgccgccgcgccgcgcctcgccgccggccgcccttcgatctcctcctcctcctcggaatggatctctacatggacgactacatcgacccctacgaggaggccgaggcggaggccgccgcggaagccgccgggctgacgtccgcggcagcggcgg

SEQ ID NO: 11353 - DNA, 1501 bp, Oryza sativa
atatatatatatatatatatatatatatatatatatataaaccatgcatatatatgtttcaatacatatatatgcatacatatatatatgtatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgctgcgataaattctttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatatagttgtatgtattaatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctttgtttcttgtggatattggtcgagcattgcgacgtttactttccgagggtcgatgaatccagtatcgaaaaccctccgccgtcgggccctttgaatctccattccacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaa

SEQ ID NO: 11354 - DNA, 319 bp, Oryza sativa
atcgattcctctcgtttggagttcgatctcttcaatccaatgctataaatagcatcccctagtcgtcctcttgcgtttgccccaagtcccgagctccctggtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgt

SEQ ID NO: 11355 - DNA, 1501 bp, Oryza sativa
atttaatgtgaagtggggtttgtaatatttatttgccttttatttctctgttttaattttctgatatatattccttttttgagatggcctccaatttacttgcttgatatagtagcaccacatagaaaactatctaaaacatatttccaccatggtctatgtttatgtcattgttggttgatttatcggctaagtccagtaagttagaaaagggtgatcccacagtttgattctaacaagaaaacaaataagagatagattggttttgtgatcggtaaaatcaattttgaatcctaattggagatatggctcccgtgccccaccagtaccatatataaagaaataaagcaaaggacagaggatgctcaatctctttgcgctaaaacctaaaaccctaaacgctgctgatcagctaaacactggaagtggttcgtgaggctgccttagggcagtgctagtggagacccagagaccgtggtgacctagcaaggtgccggcgactataagaagagagagcttgcgcaaccagaagaagaaaataagaaaagagaatcaaagaagttgacaccgattgcttctcaagcagatcagtaaattaaattttccaaattagaaaggtgattatgtataggctaaattaagatcctgtgactagaactccaaacaaacttatccagactgcatgtaatctctttgctgccaacaaacaagttctcctaattatatttatagtgaaatatttaatgaagccttaagcttagctgtggccaaaaaaaaacctacttaacctcagcaatccaactaagctggagatggcagctgcatcaactctagggagtagagatgcaagcgggcagtgggaaatacacaatggcaatcagatctgctatgctgcctctgagattacctgctatacacaatgcgggatgctcgttaagcatagcatcacccagcagagggatccgtggcttccgatgcctcccatgtaaaatcaaagatgtttttgattattattctgtgatgaacaattggcatctgacattattggttttgatatttggagattattggcgaagtggtttttggagataattggatttgcaagtgaacaagagctgctgctgagttttggtccggtcagactgggctgtggttgctggtcagaccgacggtgatcaagcagtcagaccggctcagcccgcggtctgaccggccgacactgtgtcggtttcaattttcggttgtttgtttggatatctgtgattgttttatatttatggcttctagatggatactatgcgtatgtaatactgttgtttgctactaatgagtcaagttggagatagcttagtctcggaatatagtttctttgtttgattcatgtgtaggtgacttgatgcctcgggagagtattgccggtgatggatcgggagtcaacttggggataaggagatgtccgtgacagtcagatatcatgcgggatacttaggctagagttcaa

SEQ ID NO: 11356 - DNA, 1292 bp, Oryza sativa
gactgtagacctggttaaaagaaaatgggcctgaaccgatgaacgtttggttcatttcaaaaactgtcaatgcaattagacataacatagagattactataaaaccagagggtttggtatgaaatgaaacctttgctagctacgaagtggggttagtcaaatttagagtaatttatttgccttctgctgcactgtttaattttaattttctattccgtttcttgagatggcctccaatttactcacttgatatagtagaaccacgtataaagcagtttgttaggttcaatagctttgtatcaaaactatctaaaagtttatgtcgttcccaaacagtggtttcttttgatgctaacaaccacacttgtactaagcatattaaaattttgttgaagccttcagctcagcagtggcggctaaaacaatccttaagctgagaagtccaactaagctgatcgacaatccagggcagtgggcacatgagagaaaacgccgcgccgagccaatgctagggcatctcctggggcattgcagcgtgtgcttgatcgcttgaacgctgcatcgcgtgttgcagcggagggcctctggtgcacgatgcttgagcacgagggtgatgcaccggcttcgtatgggaaaaacagtggcaatcggactcgctgcactgcctcggagattgctagttcgatggtcgttaagcatagaatcacccaacagaggaatccgaggcggctgaatggtttccagtgcctcccatacctacaagcgatctagtaggagactacatcgatttttgcctcccaaaaggacagcaccaggtttatgtgcactaacagctctaaaagtgtcatgcaatgcaaattcgagtgtttttatttatagatatcacttcatctcgagtgaataactattactagtatgtattccctccgtcccataatataagggattttatgtggatgtgacacatcctagtataatagatccggacatacgtactccctccgttccataatataaggaattttatgtggatgtgacaggtgtccagattcattatactaggatgtgtcacatccacccaaaatcttttctattatgggacggagggagtacctcagccctgagtggtcatcattacgattcgatatggtggagaaaaacggtcccatcgtttcgcttattcgtggaataagcaaaacaacatatttacaaatgaaaaataatttgtaaataaaacttttatatacgtattcttagtgatctaaaagcaaaggctgaaaaataaacttcga

SEQ ID NO: 11357 - DNA, 1501 bp, Oryza sativa
ttatccccaagttgactcccgatccatcaccggcaatactctcccgaggcatcaagtcacctacacatgaatcaaacaaagaaactatattccgagactaagctatctccaacttgactcattagtagcaaacaacagtattacatacgcatagtatccatctagaagccataaatataaaacaatcacagatatccaaacaaacaaccgaaaattgaaaccgacacagtgtcggccggtcagaccgcgggctgagccggtctgactgcttgatcaccgtcggtctgaccagcaaccacagcccagtctgaccggaccaaaactcagcagcagctcttgttcacttgcaaatccaattatctccaaaaaccacttcgccaataatctccaaatatcaaaaccaataatgtcagatgccaattgttcatcacagaataataatcaaaaacatctttgattttacatgggaggcatcggaagccacggatccctctgctgggtgatgctatgcttaacgagcatcccgcattgtgtatagcaggtaatctcagaggcagcatagcagatctgattgccattgtgtatttcccactgcccgcttgcatctctactccctagagttgatgcagctgccatctccagcttagttggattgctgaggttaagtaggtttttttttggccacagctaagcttaaggcttcattaaatatttcactataaatataattaggagaacttgtttgttggcagcaaagagattacatgcagtctggataagtttgtttggagttctagtcacaggatcttaatttagcctatacataatcacctttctaatttggaaaatttaatttactgatctgcttgagaagcaatcggtgtcaacttctttgattctcttttcttattttcttcttctggttgcgcaagctctctcttcttatagtcgccggcaccttgctaggtcaccacggtctctgggtctccactagcactgccctaaggcagcctcacgaaccacttccagtgtttagctgatcagcagcgtttagggttttaggttttagcgcaaagagattgagcatcctctgtcctttgctttatttctttatatatggtactggtggggcacgggagccatatctccaattaggattcaaaattgattttaccgatcacaaaaccaatctatctcttatttgttttcttgttagaatcaaactgtgggatcacccttttctaacttactggacttagccgataaatcaaccaacaatgacataaacatagaccatggtggaaatatgttttagatagttttctatgtggtgctactatatcaagcaagtaaattggaggccatctcaaaaaaggaatatatatcagaaaattaaaacagagaaataaaaggcaaataaatattacaaaccccacttcacattaaatatttcattccataccaaatcgcctgctttcatagtaatctccatgttgtgtcc

SEQ ID NO: 11358 - DNA, 1501 bp, Oryza sativa
cctgatgccctgccgcgcccagcgctgccctcgtagccaccgcgcccaaccggcgccgccctctgcccggagcgacgagacgctacgaactcaaccgttgcttccttcgtctgcaaggcctccgacctacgtctgttgtctgcaaagccgacgcccctgcctccatgtctcccgcctgcaaagtcggcctcgcagtgcgcctcgccaacccgaagccgccgccccctgccaaagccgacgcccgaagcgacaaggcgaggccgaccacccctggctccctctgactacccgtgcaccccctctgcaatccctgcgcaaagccgacgcctgctgcccgccatgttccctgcggaccacagcctgcgcgcgcaagagacgccgaatgcatcacaacaacctccgcatctgcctctcgctcctccctcgcctataaatcgagccatccttgatcgatctcaacttgcaatagacctaggtttcctaaggtttgggtaggacttccaatacctagtgtattgacccaccttttgttgttgtttttagactaggatgcaggatatgaggtgcctagtgacgattactttgcatcgggtaccagagtttccgagatggttctttctagggtgattcctagtcggttgcctgtgtggtttggtagatgggcataccgaagaacttatgtatatttatcttttccgctgcgtttaaactcttttatttggccagtcgacctaactattatgtaagaactttgcatcgctattggtatttcttacgactacagataaatccgcaagcgcacggaataccgctgtagcacttcaccttcgggtgacccccaaaaggatatcgaactcatggaacgtgtgtaatctacctaaggctaagactatccaaggacaacaactataggtagataggctaggctagagaggactttctatgtattttaattatgtaagctaagttaaaagataatttcctatctgttgcttcgggcaccgacccctgctggtctgccaatacggttccggctatagctttatgatgtatccgaacgtggaggattactagaacggaattcaaggctgtcaccacctgccacctacctctgacaaatctatgggatacacaataaacaaaggtaatctctaacctagacaccacgtctaagttattaattactactcttatacttacaggaacttccttctctatccagagtcctagtactagagcgcttagtataaatactaaacaatgaacccgtagagatggaaatctatcttactcagactaagtaattaaataacataagaaaagaacactgatgcttagtttatagaagaaggttctccgaacctggagcaaagtgtaccgacagctccagtactcctctagaattcctcctaggaagctacactcgtcgaggtagaagtcggatgaacgcgaaacttccgggaactcctccagagcttcccctcactctctataccttatt

SEQ ID NO: 11359 - DNA, 1501 bp, Oryza sativa
ctctacaagtttaaggactgcctatacacattactctatatttattttcacattctcttacaactacatcatgtcaaggctttagtaaaacaacaatgtgctactatagcctcaaaaatgtagtgttgtggttttcagtaacacaaattttaagtggtcatatagcccatgttactgatgtaatatcaccatagtcggatcctttttctttgtatgcaccgataaatctaggtcgataacctcattatcaaagcacctgttacccgttttgtaccaacttgcatgtcccattaggggcaactgtccaagtctacatattccttacgacactgtacacagtgatttacacacacgtgaattttttcaacacctagtgataatggacatatgtgtttcttagcttgacatgtgttggattacaagaaattaggcttaggaagcaaactctaagatccatcaaatcattgaaactaccatcggaccatccgtgcctacccttcaatctgagaagtttaaatgccaaacgcaacaccataaaattcttattacatcccttggattcatcgtaaaaaaagatccttcgctgacttctttagcaccttccaattgtctaatcctcgtgctgtaccgactagctagcacctctgattcagcgtgccgtagcgtatcctcctgatcaaaatcaacctcgaaattatcactaccaactcaattgtaaaattctctacctcagacatttgaaaacctcttcacttctgcattaccgtcaccttcaagagtgacaatttccttgtgataggtccaaaccttgtaattcttcataaaatccatgctccactaagtggcccaaaattttacctcaaagcatgtgccttagcctagtcaataaatttagatgcttccattatgtacgtcgagtgagtttttcatgtgtcgtacatcttttcttgatacatctataaataatcataccgggaataaaatttgttgacacgtgtttccaccacaacatgaaaatacacatatctcctcaagaatgatacattgaagtagtatgaactagtgcttacaataaaaatttgccaatataaacattctattttagctaaaatttgcaactacagctcataaaaaatcccctcctaaagctgcgaaaagttgtctgctacaatggcaagactatgaaacttctatcaggaacatgtataactgcgaaaatgaaaatctaaacaatatagaatgttgatagaaaatatttgagcaggatagaaaatatttgagcaagtaaaaaaaaatcaaaatggagagacaaaaaagtaagtcaatctgcacttttaaaaaaaactagagcgacaggcattggtatcggagtccaatcttatacatgacaactcaccaaaaaagatcaaacatgtagcatatgaaacaagacgcattatgtcagggttacggataaggtataccctctacccttggatatacgtcgtatactgatatgata

SEQ ID NO: 11360 - DNA, 1501 bp, Oryza sativa
agagaaaaatcagtttaaagtagtttttacacgtaaatcggacgctgacgtcagcgcccgatttttccccaaacatcggacgtccgagccagagttacctccttaattatttccattataataattgtggagattatgggtaccccatacccacacggcatggttatccgactagttataggggatagcttatatctatggaatatgtaacagatcataacttgggtattacgttttcttgtatattacggaacggcctaaagtactggtttgataatattgtaaagtagatttaggaaaccgataccgtattggttaaggtttctatcttgtaatcttgccccccgtcctatataaggtgggcaggaggccctctagagggcatatgacacacaaccagatcgtcagatccataatacactcggcggattcaaatccctaaacaggagtagggtattacttctcattgagagggcctgaacctgtctaaatcttttgtctccgcatccatccaattttaggtctagtgcgctacccttttttattattgccgaattcatgtttcgacagttggcgtgctaggttggggatgcatcgagttttccgtcgacgagtgcgatggaatcaattctaaaataggcgttgagattaatctcaacgaattcgatgactccaaacatcaaccggtttgtcgtttcaatatattattatcagattgatttctaatcatgaatcgatcttctgtgagatgctttgtttgcgtgcatgcactggcggctgatgagatccattgatcgcctccacatggacgtatcaccgatgactcggcgcctgaggagagctcctgcgtcccatcttgccctgcggcctccacgggcagatttatgcatggagtattgccagacgcacggacatgcaaattagcacgcgtgcatgttgcatgcatgcatcgatatatatgctgtgctataaatgccgctactgattaatctgactaatatattgagcttttattttgcatgcaaccatggtttggtctatcctccggactgctattgcctagatcactcggttgtctctgtacacgcgtacaggcagagcggtgcctatatgggactagaccaacaggctgatcagcgaattacacaccgatcaaactatttagggatcgggttagctgtttcaatctgcagattattaaaattaatctttgattttatttttttcccagattaatctattatctgcgtatactttttctgtcgtcggttcggccgagtccttttgaccatgcagttgatggctctacaagtcctatacagggacggctgctgaacagatggagaagccattgcaaccgagcacatgctttaatgtttatggtcatgcaagcctcttcgtcaagcacaaatcaaaccatgtgtttggatctattagttattatataaattattttctttttacaaatatctaaccacaggttgatgtgcaatttcttgtc

SEQ ID NO: 11361 - DNA, 1501 bp, Oryza sativa
tacaaaatatggattgtaatggaggctaacaaatagaaatatcttatcaagctcttacaagtatcttaccagcaatgctaaggacggtacaaccggtggctggctcgtgatccaactattgcaagggtcaaaactatactgataaaactatctcatactcgcagaaaactactagttcagagaacaactgctttttatgctcggtgcctttcttcatgcaaccaaccaaatcgaccatggaaaactcagtcatactccatccattgaccactgagagaaacctgtgagaaaatttcatccatgccacgacgagttcaattctttttggacattcatttttgttcagttctattctccaaaccattcgatgtcaaactggttctctatatatactagttatcgtgcacgtgcaaggcacgttttagtattatgtgtgtgtacagagagaacaatagtgacctagaaaggcagtacactccaacaaaatctcgagataaaaatagagtttcatacaccatagtaacatgtcaatttggatgattcctataaaatcctttcgggtgaatcacactaccttcgatacgcattacaaatttacaatagtgtgaactggcgtatcgaagctgctagttcatttgagacaatgattgaaaaaaaacacaaaagtgcgtacattatcaattataaggcatggtactgcgtcaacctggctcaatgaggcgccagcccattttccacgggcttttctcttttgcccctcccctctatcttctttgtcctgtaaacccaaacagctgcactcaatgctggcattgataagagttcatatccttgacaagctagaatagtagcaaaatatgtgcacaactatgtatgggtagttcatacaaaaattgcttaaaaacaaaaaaaaaaggaaagaataatgaggtagtttgaatctttcccttgatgaaaataaaaatgtgaatagaaggaaatcaacccttttcaggatgccatggagcagtttgttaccatattgtacagaaccaacaattaaactatccatttttttaagaactgacacataatgaagggagggaaaggaatataggttttgtatgtctaaaatgttgattgttccacgaaggctatatctatgctggtacaatcacgaaatatttttggatgtaagaatcctctacccaacacaaacatctatttgtatcaaaagattaggaaatggatacactgccttattacagtaataagatattttcccataagaaattggttggcagaaaaaagaaaccggagttaagaaataaagtgctcacatgggccagaaatcaccagataagagcgatatgacgctgaaacatacaactgggcagcacaaagacctactttggaatacaacctgccctgaaaatgcattccaccatgtaacatgagtactatcaataaagaataagggctccttgatattcaatagagaaagccaaatagaagtcacaaa

SEQ ID NO: 11362 - DNA, 1501 bp, Oryza sativa
gtactccatctctttgcagcgaccggcggcggctgcgcctggaggcggcgcgacggcggtgctcgcgcggctacgtgcaacgacggtggccacaacgcccggaggcagtggcgacggtggcagcggccgccgctgcgcccaatccctccctccccattcttctttgttcttcgtttcttctccaagcggcagctgcatccagaggtctaatcttctcccctaagtgtgttcagtatacttatcatgtgacataatatttattttgttctagtgatgtactatttatctttaattcatgtcaattttttggaaaaccgctaaatagcttagctgcagctatagccatctatagccggctatagccgatgaaaaccatagccgctaaaaggcttagccggagatttacttgaggtagagactaggatattacacttcttatctagtattctaaactggcagattgtcctgccagctgattggtcgagacggtgtctaatagtatacgacacgtggaaaaaatataacagcgtatggtcggatttcacggttggactttctcgattaatcgcgtatctgtgcacgtccgtctggccgaacgacttcgcgcgacggcgcaagcagcccactccgctcctgcgtgcagccgcgtgggccgaagcgcagagcaaacctcgccgcgccggtcgtgtgggcctgacacctagctggaccgtgcatgcatgatccccgaatttttttttatttttaattttttttattaaaagttttacaaaaataattttctattttgaaaattgacggaagtggtcgcctaccgccctctgggagggcgatttttaaaaatcgtcatcccagagggcggcgaaagtgacgtggcagacggccgttcgctctcgggcgacggccgccaacgaaatttgcaggcggcccccttgccgccctccgctagggcgattttgtactgtgcggggggccgcctgcaaatgggcggcgagggggcatggaattttgcaggcggcccccttgccgccctgggggagggcgattttttcctcccccctataaagcccagtcccccctctctgaaatttcattatattcactaaaaatccaaaaaaaacgaaagagagagagggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaatttagggcatagtacagaaatgcgaggttaacgcagttattgttttcatcaggcacaa

SEQ ID NO: 11363 - DNA, 1501 bp, Oryza sativa
ccccttttcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggccttttgcaacgtggtgtagcgttggacagtgattggttaatattgaataattactacagcagttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagctgtctcagagaggttggtttcctcgctgccgtcaaggtttgcctgtggagtggagtcgcccgctgctgaagtcaagcttcccggtttagctcgcttttatctttcccactgcatttgtaatcttttatatttttgtaagacgtgggtctgtatatcaacaattgtcgtttgtgtaccctggctggccctggacagggatttaatgcacattcagcttagaaattctggttcgagaatttctgggtgtgacaagttggtatcagagccgaccttgaccgtaggacaagccaactggaaacataagagccctctgaacccttttttttttcatatacatatgcccttttgcacttggaatttgtttcgggaaaattttggggtttgttctttcgatttgtgggaaaaatcttggtcgcttatttaattggatttctcgactagggacattctagggatttagtaaaagtttattcggaatttattcggcagtcggtcgggaattgtcgggtgatatgcattaggtcgtgcctatgttcggtggggtaagtttatgcgtatcagtatgactatgcatctatttcatgcattaagttattgtttagtcagttgcattagtgtcttttgtctcggttcgtgaaaaatgttgttctatgcataaaaatcatcatgctcggttatttatttgagtcttcttttgctttgtttaatttggatttgagcatgaattggttcctatcccttgtctactttagatgtcagtcctatccctcgattgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 11364 - DNA, 1501 bp, Oryza sativa
accggcatgaataattgtacaagcatatgtatggttaacatcgaaatcacacctagagtaataatatgaaaatgtggtcaaatttgagaaggtcccgggcttaccacgtgaggccggtcggaccgccaccatagggccggtctaattcatctgcggggggcggcctcactggcgacatgtgggcggtcgtaccagcagttcgacttgtcggatctcaggtttttttttcttgggtctgagatttttgagttctaattggtttcaacatctattggatgtggaaaagaccctgggaaacaagttcacctctcctataaatatagaggactaagcctgattgaaacaaccaccaatcaatcgttaaaatttattgtccaaaccctctgtattccatatcttcctcctccttgctacctatgccatgcaaagtatattctactccaatttcttaattgttcgtcgtctctcgtcggcgttacaggatgtcctaactggccagttgaacctaggacaaactagcacgcgttaaccctgatgggtccctcccgggtgttcgttcggtggcatatatctaccattccctgcggcggcgcatctccgggtgccgttgcgagttgcacataacatgacaacacgatttggcgtcaacataaatattaattgggcatgtttggcgagtggctcgataattgggcatgtttggcatcgagccgattttttttattcttgggaccacaaaggtgccggtttcaaaaccggcacctttgatttctctcatctgtatcactttctaggtgccagttggaaaaaaccggcacctatgttgggttcccaaccaacacctatctaggtttttttagtagtgctttatgctttaagattcaacatgagaaatatgcttttataatatatagttcacacataaatttcttgaatttaatagttaaagttaggaatacttgacttaattaggacaaagttgacaagtaatttgaaacgtaatgagtatttcttctggtgcattagtcaattatgtttcagtgttagtacgaaaaaagttggtacatatagcctttttcttttatatatatcttccaatcggtatagacaaatcttgccatgaaaccatatgggcagtaacacaactcatcacatatagcctttttttttatcatagaatttataagcacaatattcgcaggcggttatgaaccgttgaaagccactgtcagggattgttagttcaaaactacggccaataaattaaaagcgaacagttacagtagtcagttgcaccgcacatcagaaacctaactttagaaaagctatatatatccacaccatacattagatggtggccaaaatgagccatccatccctgcatgatccatgctattgttagtttttaccatgaaatcatcaatgcatgcggtaatacaaacccctagctagaacactcctggaccattaattaatcctctcatatcttagacatatgcta

SEQ ID NO: 11365 - DNA, 1501 bp, Oryza sativa
ttttaatcaattattcttgctaaaggcactttgagaagttgttttcagtttgacaaaaataataaagaaaacaacaagaagaaaagttgtttaaagttatttaagtaaagttgtgagctattatgtgatagtgcatcaaatatttgtaagatagatgtagccggttactctgaaaagtaaaattgaatgaatcaatgcccatctttcgttttttctgttctttaatttatattttttagcgcatataatcctttatgttgtcgattgcacaatataaaataatggaactttaccaatgccctgcaggtgaaaactttacattatagttcatcattctatctgacagctaataagacttttagagctccttcaattactactcaagcttccgtgtagccatgccaataggattagcaatgaagattcccacgcatgctcacacatatgcatgggaaaactcatgtggttccgaaactaatgttgcatcatatatctcaattaaatcaagttaactgtatactgagcttgatgttgcatatgcattgtcttgaacgatttgtctattgcggatttgcggtttgccatatatgaaatggttcttgaatgcatcagaagtctctgtcttttttttcctatgcattgttaggcatcgttcgtttaggggtgataggggagattggctctcgtttttcgcgcgcacgcttttcaaattactaaacggtgcgttttttgcaaaaaatttctatgggaaagttgttttaaaaaatcatattaatccatttttaaaatttaaaatagttaatactcaattaatcatgagctaatggctcacctcgttttgcgtatcttcccaatctcctcaatccccttagtctatggacagcgctacgctgcgcgcgtttattgctagtattattaaggggcgcggattggggcgatggcggcgcgggccacgtcacctctttttcctcccgccgtccgatcaggcgtgggcggctgggattgaggcgcgcggtgtaaattttgcgaaaatcctccggtttatgcgtaattcgatttaagtcccttcggaacagtagctatgaggtgctattttacgtataggcccttacaaaatcctcatattccacgataaggagagaaaaaatcgagaataaggactgtgctgtaaacagtgaaaaccgagggactttttcgcaaaatgtcgcccactaaccccaaaccctagccgccgcccgcatcctctcctccctcccgtctcaccctctccctctccctttccttctcccggcgccgccacctccgcctcacgccgtccccgtctcctcgcgccgccgcctcctcctccgccgccaccgtcgtcatgtcctcgtctccgtctccgcctccgcctcgcgccgccgcacgccgccaccgccgcgagaggagctatcggaagcgccgccccggaggaggaggaagagaggcgagagagcggaggacggagagggatccggcaaga

SEQ ID NO: 11366 - DNA, 1501 bp, Oryza sativa
cttgacttgaactgcagcgggaacaacactccacaggcatcctcgacggctcggacgaagcctactcctcggagaagccaccatctgacacctactcaaactctgggttttggggaaaaatagagcaagactgagtacaaccaccgtactcagcaaatcatatcggaacaagaggtatgatgcaggatattaccaaaggatagctagagaggttcttttgcataaagcgagcatttataaacagtagttgaaagcagtaaaacagatgtaataattaatcaatattaaccatccactgtccaacgctacaccacgttgcaacaggcccaaccatccacctgaactaatcaattccataagactaagctagggtgagactaatcacggtgaatttggttgaccgcccataaccgcgggcacggctattcgaatagttttactctgatcagaggtgtacaactgtacccacaagacacagccccacgacacgttcccgtgtgccaacatgccaccatgacatatcagatagaggccgtgacagaacttttcgcataaccccctctaaccaagcacaccacacctcaggtttcacccccactcctcgcaaggcaacgggcagtcccctctcgtgcctaggtgaatccggaagccgcataggccgtcgcagggcccatccaaactccatcactcccacccttgcctggatgcgtcagctagaggaaagctacactacacgcccagccgttgcccacgctggcttgtggcaagtacgaggaattcttccagggtttcccgcgaaccggtccttaagtgccatgggcgcgaccatcaaaaccatgcacccacatcccatcatatggtatattttaattgactaacaccagaacagtagctttaatccaacaccaacactagaacctgatgtctaagcattaatgtgatttcccccattgtgtgctagttgaactaagcaaggctaagcaatccctagtccaatccctagtcatgttatatcccaagctaacaaaggagcatggtaccaaaaatagcatggctgtaacagtaggtaaacatcccatagtaacattataaaacaatgcagtatttaagggaaaacggtagagcatttgcaatataggatcaatatgttcaagtgacaagtatgacttgccttgctctgctgctggaggaacctcggcgactatttcaaagtacaccggagcgtcgggagagccggaatctaagcgacatacaaagcaaacaatacaaacatgctataagactactgaaacagagaacaaaaccatttttaatggattctatgcatttttcttgatttactgagacttgaatgggcttaaacggagctcggatgaattagatatgaattttagaagattcactgtgtttttactctaaacagaaaaatccttaattgatttattgcgcaataattaaaatcccgagagagagagggcggcgccgacatgcgggccccaca

SEQ ID NO: 11367 - DNA, 1501 bp, Oryza sativa
agcattaaaacaaaagcatgaaacttggtgcgctttcaatgcgtggagttagcgcttcgtttcttgggttgcttatctcttgcagatgcgaagagctgcatgcatgctgcacacgggcagatcgaagcgttgcatacgtcgtcacctcgagaaaacagttaagcctccttggtattagggtttgaagcagttgcgccctatattaaggaatggagggagtatatcttaatattaacgaacctacaacagttacggatgtcttgctattgacggatacatcacctacacaagggatctaacccatctaacccactgggtttcgcaccttctagcgcattctagaagagatgaaaatctttgacctaactaattcctattgatttcatccgtgcataatatttacgggtaatgggagccgtgcataatatttacgagcactacgaattaaacctctagtgcttcttcatgtttgggcatttgaactactcgcggatatggtattataagaattttcatataaatttcacttgaagaaaacatctttccactccatatatttttcatattcatataatcatattgatgatttcatagggtatagtccggaatttcaaaccgtgtgcaaatccccgattcagcagttcaaaacttttggatttttttagaaataatattattttaataaagaatcgtgaaaatagaggtctctcaactaaaatcacgagtttattaccctgttgaacaaccaaagttcagcagagtacatatcgaacaattttaatacgattagtactgaatgtaccacatcagtttgttcgatatggttgttagtgtattttttaaaaaataaaaatatatgaaaagagaacatccatgcaggaggcaaggttgttcaataggtcctcccacccaacacccaactgcaatggcagactgtgcactgcaccatgagcttttaaattttattttttagcacgtaacacctacgaacaaccgtagtttgacaggtacttatcgaacaatatggttttagtcggtcgatctatatttttacaattttctattaaatagtattatttctaaaaaaattcaaaaatttcaaacctcgtataaataaatccatgctccatcaaaccaacaaactggagagagatttcatttctcacccgcgtccgcgtgtataagtgaaaatccatccgatttaaaagtccacggtggaccggttccaccaccaccaccctccttccttccttccttccccttctctctctctctctccccctccctccgatctcgccgcgtccgtgtcccctcgccgccgcagccagcgtcgagggctcggcgaccggaggaggagaggccggaacccgccgccgccgccgccgccttcgcctgtagcgagatcgctcgatccggttcgcctcccgcgcgccagtccgccagcccagttcgatccgttgagggggaggggacgctctagtgtggggattgggggaatcga

SEQ ID NO: 11368 - DNA, 656 bp, Oryza sativa
cgtggggtggtgcaggagagagggcgtggccggcgggattcaaaattgaatcccggccgtttcagagtgggcgcgggcgggagagagagagggagtgggcgcggggtcgcggggaaagcgggcgcgggtggagacgtgggcaacgtggcccgtaaagcgtgggcgcgagggggcggaagaggttgcgggatgcgcggcgtcgtctggaggttgggggaggactcaacaggtgggccccacctgtcgacaaccccgggagagaggagggggctcgggcggccggctaggccgtggccttcggccggcccagcggggagggggaggaggaagagaatgggccggcggcccattcgaaaaagaaaaaaggggaaaaaggaaaagaaaaaggaggaaatgaattttcttgagattaaatattgcttgtgcttatttttaattggtttaaattatttctagagctctaaaaattccactaaaaatcttgttaggatatttcgacatgtagaactcaagaaaaattccacatgccaattccgattattatttgcattaatttattagggtttctctcttgcttttacaccgatattttctctaggtgatttataaattcaatttaggcttgagaaagaacttcagggtgtgacattcagcca

SEQ ID NO: 11369 - DNA, 1501 bp, Oryza sativa; identical to SEQ ID NO: 8375

SEQ ID NO: 11370 - DNA, 1501 bp, Oryza sativa
ttaatagttcatttatacaatagttacttataattatatactacatcgttaatatatggtcccaattctcatacacacaaaatgttttggagtactatcctagcaacataaacttaataaattttatcatcttgtcataatgtaaaattaatgagtgaagtttttttttctaaattttatacaaagatatcaaatatttatgatagaagaaagtattgcattatttggatctagactgttttcatgtgttacaaccatgttattgtaatattggaatgtactgaaagaatcatgcgaggatactactagccccatcggtttggcttattagggaataaaattaatttataggtaaaacttttacacttttatttgtagcaaaattacattgaaaatattttaaaatcttgttaaaattcagttcaaaaatcaaattttagcttttgctttggtttattaggccaaccgatggggctcctccttcccaatataaatacacatgaaactggatgtgatattttatagtacaatgaatttggatagctgtatgtgtaggtgtaggttcgttgtaccatgaaatatcatattggtactaggtgcacttatattaggatgcacttatattaggatggagatatatattatcaaacattagtttaatattttccgcaagaaaaaccttagtttaatagtaaattaaacctaacggttatactcctacaagactgagcctaaaaagtcgtgtttacaactcaacgaagtttttgtctaacggtaactaaattattttgccgtaaattgcttcggatcttttatactcgctccgtttcgaaatgtttgacgctgttgactttttatcacatgtttgaccgttcgtcttattcaaaaaatttaagtaattattaattatttttctatcatttgattcattgttaaatatatttttatgtaggcatataattttacatatctcacaaacgtttttaataagacgaacggtcaaacatgtgctaaaaaatcaacggtgtcaaacatttcgaaacattcgaaacatagggagtatatattatattgcatttaagtaaatgaggtttaagaagataatcagagctgcaagaacacaaaataaaaagaatattttcctggtgccgcgtagccctactacctctattttaaaatatagctatttctagtatattatcttgtcccaaaataaagttatttctccacctaccttaccctctcaaccaatcgtaactatactcttttatctacttattttttttaaccaatcactcattttcttaaaacattcacacatattttcataatatccgtaccaatctaaaaaagtttatatatgttggcataaaaaaaagctaatatagtctaatacaacgaatctggacaatcttttagtagataaaaaaaagaaaagagcaaaaataaattcctttttttccccactccgtctgcacaggggcaggtctcctccacctcg

SEQ ID NO: 11371 - DNA, 1501 bp, Oryza sativa
ccgtcgtcggtctatcggtggcggcgctgctctggtaagtctcatcacaagcttcgttgtgcccaataatggccggtcgcatcaaaacctatatatgatcggagccaacgataataatatatattgccggcgtccctagcttgctgctgtttgtgttctcatcaatgaagatatatgtacccttttcttccatttggatcgatcgcatgttcgattctgttgttcgcttgctgcgtcgttgtcgtgtcttggagtatgtactagtactccttaattcttatagtagtacattaattgtgtgtgtatcactatcaaatacgtacgtttactgtttttatggctgtcatgttgttcgattattggccggtttaatcgacgagtgttttatactagtacattgtgcttaggccattcccaacgcaataaataggatggtgtccatagcattaaataagctgccacctagaatgaaaaatgatgtggcaagtgaataaatgaaaaaagagaagaaaaccatgtcttgcatgagacatggtttctacacaacatccaagacattatgttagacaagtatcattaaatttaagtatggaatagtagtgtttgcattggaagagtagtgtctagtgctagtttcttaatgatgtggagattatggaaactatgtctagtgtcttgggttgggaatggccttggtagcattaattttcagttcaattaattacatttcgtggagagttcggaagcatgaaactgtgactggtttcatgccgtggtgatggccgcagtgattaaagagaagggagctgcagtgggctacttaaccaggaccttccacagattgggcctcagatttactgagccgtgcactcggatcagagggtggagcccaagtaggcctacgatccaaatatctactgggctgattgggcccaggagcgtagctgggcttataaagtggtggtttgcttgcacgagtgctggatagtggataccaggtaactaaacgagagaatcaggatttctttggttccatgcttgagattaaatagcttcaaatagtttctaatcaagtagtctaatctgctattaatcaggtatgcttacaaaagctacgaatttacagatatataagaaacaaaaagtcactgcttttcgtaaagtatgttcacagtatcaataatgatatatagcctgtactgtacatagtatgggtaaacgactagtgaccatactcaaagcataatgcccacgtatacatcgaattatactcagaatggccactacacagcataattatacaacattatgacgaagaccaaggcgaacagtagtgcaagcaaatctctgctcagctgaacatgttagactaatgtaattaggccttgattgtggatgtaattgggcccgtgcggtgggcctgagtgccaccccagctgcccctatatgtaatcccttgacacttgtggaatacaatcaatcattcccacactttcacttg

SEQ ID NO: 11372 - DNA, 1501 bp, Oryza sativa
ttactaaagttttactttgaatcaccctttaacaaatatttttgctttggactaggtaaaactacctttattgtattttggactaatgtacaataatagtaaataatagtttacacgtaagttgggaagattgttgatatacggatgccgatgtgcttaaggtaattgatgtgctcgagaagtattttggtggcccaaagtataaacaatggcaaaatagcatcgtccaaagtgaaaaaaattaagagctaaagggtgctcaaaagtgaaattttagtaatcaaatatggccataaacgcaattcactcttacacaaatcttgtaaaattatggaagttcctttttaaaataaatttgaaaaatcaatattcatttaattagttgaattttcaaatttatggatcgagcttaagaggagttcaaaatattgaatccaaattcaatgcaggcaatctgcaaatttaccagagtgcccttcccctctcttctccgctttttcctgttcttttctagccggcactgtttatcggtcatcatgtgttcgacgccgacccaggccattcaagtttgcttcgagattaaggttcacttaaagataaaatctgtaattacatcctacatactgcatcaattaggctgatgtgatttgtctcatccttctcattgccacatatatatgatgtgttgtgcaacaccggttattgtcttttgcagacaccatgaacagcttcaactattgtcctcctttctattggatttgtcatgtgtagattcatcccggcatgaattgccttctgaagatcgtcctccatggaatgagaggtcaatgcgatgattggagtgcaaattccataccggctttcttccttgcggatgcgcattgttgcttcatagccatccatttcaggcatctgaaccaccaaatggatattggtaatgtccaattcttacgagaagcctttgcattatgtattatatctgtggggcgtttgcaaatttacccaccgttttgaattgttattgcaaaattcccactagaaaattgcaaaaatcataaaatgggaaaaacaataatactccaagttaagggaagcagttgaatgaaaagtgttgtgttggtagctagtgttgagttgtgatccaaattcatttgcacttaataaaggccagcttctgccgtagcggagcggaggcccgtcgccggaaggcttgggccgaagcgtagggttccaccatatatatacctcttgtaagccgccgtgcggtgatgtaacctcaccccagatatagtgaagatattttgttggctggcgcccgtggttttttctctcctgttttgggagggtttttcacgttaaatctcgtgtcttctgtgattgatctattgttctttatcgtttgttcgcttatcgtttcctaacaagtggtatcagagcttgttctcacattagggtttcgcgatggcgtcgatgaagtatgatgtaccgctgctagactaca

SEQ ID NO: 11373 - DNA, 1501 bp, Oryza sativa
gctgggagggaagggttcagatcccgtagctaggtctgaacacacccagattgtatcagggttcaccaattcgatttaaaattagattccaaatatagcaatatggcttttttttaccaaaatttgatgtttttttattaatttggtttaattttacaatttcaaatttgaattcttgaaaaactattctaaatttcactcaaaatctacttttgtcccaagttggaacatcgaaattgcgttgttttcaatccgttttggttgaaaacatagaccctggttagtaatgaccccgacaatcatttatcctggattcgcccctgtccacacctatctttgcaaatttaaaatttttcggggaggggctaaaatattgatctgaaatttcggtgattttgaaccaccccttaaaagaaattattttggcttttcacaattaatattgaacctttggctatgaattggtcgatctatgaagaaacaaacaatgatgaatatacatatatacgacgtgggtgcacgcccatgctgctctatcggtttgcagcgaaactgcatgcatcccgggcctgcggaagtgcagagcatgcagagaaaaaggaagaaatcgaatcgatcgagcaacctgcagctgcatagctgcatcatatcgatcgcgcagggacagggacagggcagcggccacactcgcacaacaggcagctaaccctaacatatactgtagtggggtagcacaaacaccatgcgcacaaggatttgttccaatcgtagcaagcactacttgcgcacaaggggcggcgcggtaattaattagggtatgtttggttcttgcctgatattaccccaactcaatttgtcattagggtggcatatgccacgtaaagttgttggccacagatatgataatgtttagcttaaaaaaaataagtgtatgacatgtagacccatcaagtaagaaagtgtgacttgctacaattgaaataaacaaataattaataaattgcggcggccctcctcaccccccacccccccccccccaattgatccggcgatcctccccgcaacggcggcaacgacgacaacgatcggctgtgatggcggtgggagcgagtcactaatagagaggactacttcaatggctagggttttagcctatttcttttttggatttgttttttttttgccgaaactattttctcgtgcggttggctaaggtgactgtcccgttcacatgcggttgcgctacctgcatgaaaaaataataattttcgcatacatctgggcgcagacgagccaaagacccgcatacgaaaatctcttttggctgtctagtaaaatccctttctagtagtgtgtgctaattaattaatacagagttgctgagagaattaatcgtctgtcttttctaatacaagcacctccccctcctaaggaaaatggagtccgatttcaacataattaagcacctaggctataagaatgcatgtttctcaaaagaaga

SEQ ID NO: 11374 - DNA, 1501 bp, Oryza sativa
tttgatattatagggcaatttctatataaaaaaatagtttgtgtgaaattaatctgatactgtaggaaggaggaaatagactgtttggcggacaatttgtttttttttccattttggagtcatccgtgatccaactctcgtgagttgatcaggtggagagcgtgaaatgatcaggttagttggttagttacctcgaggccacggatgatcttgctgacgacctgtggcacgtagtccctgacctccgtcatggcgcggccggcgaagagcggcgcgttgtagtcgttgccgccgaactcgcccaccacgaacagcgacttggacaggtagctcctgcaatctacacacacccgtgatccgatcgatccatcaattcgtccgttaattaattaattaattaattactccacatgcacatatatactggtagttgttggtgagacgactaatcaatgaattggatcattaattacagtggtagttactgtggtaaataataagatgttgaataattagttagttaccgttgccgcagacggaggggaggagctgacggaaccactggatctgggtgtcgagggggccattgttccaaatcttgtcgctgaggccgatggacttgaagaaggcggcgtccatggaggtggcgccgatgatcgccatgttcgcccccttcttgaagtcgccgccgcccttcgacgccggcggcagcggcagcccaaagtgctcagctgcatatatgcatgaaattcacatgtcattttctccactactagctcgatcgatcgatcgatcaggacgtcgtcctaccgaggaagtcgacgacgacgcggccgtcggagcagcggccggtggggcggccgaagaaggtcttgccgtaggggggctggccggtggtgagccacgacgggcagccgccgacgcagaggttgccggtgtcggagatggagtcgccgaagctgtagatagcattgtaccgctgcgccgccgccgcgtgcgcgaacaccaccaccaccatcgccgccgccagcagcagcagcgccgccattatcacgaacgtgtaaagctagcgtcgtcgcgaagaccgggagagggagactacgtgagatagctaggacgatggataggtagctcgtgtgggttgatgcgattttataggcttagcgctagttcgtctcgtctcggcagccgtcggttggtgggtcgctgtcgcggcgggctactgcgtttccatattcttctttgcttcactgatcaccactgcaaccacgacgtcgtcctctgcacactcacgtaagcgtgattctttatcgtcataaagctacggcagtaacatacagctttttctgttgagttttcggtgtttgtttattttctgttccttttgttttggatgtgatggatactgttattgttgttttcttttctgttccttttgttttcgatatgatgcatgggtgctgctgctttgcaaattacaatgcattcatcattgctaaaa

SEQ ID NO: 11375 - DNA, 1501 bp, Oryza sativa
gaccacaagaagtaaagctagtgggagtatcgctacaccgcttggtcgaaaaccaggtgtagccttacctcaaccatgagaagtaaagctagtgggagtatcgctacaccgctagtcgaaaaccaggtgtagccttaactcgaccactagaagtagaggtgcgagagatcgctacagcctactagtccgagaaccaggagtagcctcatgtctcggccgattgatgtcgaggtatgagagatcgctatggcctattggtccgagaaccaggagtagccttatctctcgaccgattgaagtcgtggagcgaggaccactacgctgctggtcgaagaccagctgtagtcgtacctcgaccatctgaagtcgtggtgcgaggaccactacgctgttggtcaaagaccagtcgtagtcgtacctcgaccatctgaagttaaggtggggcgctagagttggtttattacatgtgcatctcatctggccagcatgactcacatacccaacttgtagcatatccggatgtccgtccacaatcatgtcgggtgatcaagccgacatcgtttgcgagtaattatccgttaacaacccttttctcaaatagcccagtcatagccggtgctatgagataggtcgtcggtcttcgttggtaggttggctgcgacaaatctgcatttgtctagaacgttctcgataatggggagtgctcgaccacaacctaatcgagtgctcaattgttcctgaaaagtatttttctagaaggcaaggcatatagcagagaatatcgagtatgtactcaaaaaacttcatggatcttctagtattatcagaatataacgagcagatgtaaatatcaggcattatgtaaaccgtaaacaagcatgattcatacagaagagaacagagcgagtccccagcgttagaccgtagttggcctaacatcggaaacactcgcacaatagatattgtataaataacatgctctaggtaaacataataaattatagatctgacaatgctgtatgatctgaataggtacgataaattgcatataaaatattgcatacatttgtagatacatgtcagatgtatctacgaaattagtagattaatttaaaaaaccaatccaccaattaccttactgcgtactcgtttgatatcatatgatctgacgtcttttggtacgacgcgtatcttgaggcttggatgatctcgataaaccaaattgttgacaatgatggttccgatcttgtcgaggcacgtactctggttagattaaacttcccagatccaaagtagttgaagtagccctcgtcaaaaaatctatagtgacgatgacttggtgaagcttgacgaagatcccgatccgtcggagaacatacttcgttcgggtcatatcacccaacatacgaagtcgctgagtagtttattgttgaagaatccatctcttgaacccatctcgtcgaaatcctgaagcaccaaaatcccctacctggcacgccac

SEQ ID NO: 11376 - DNA, 938 bp, Oryza sativa
tatttggtgtaatattttatgatttttgtatgaataaagatatcttataattattgtatgactgtcattattgtaagaataattatttgtgtacggtttttttgactcatgtagatggatcggcaatggatgtaccgctgacccggggcggggttccctccaaagagtttattgacggcgtgcactatttttgagagaggccgaagctaacaggcaaaggggttttatttgttgtccatgcaataagtgtaagaatcagaaggagtattctgcatccaggactattcatttccacttgtttgagtcggggttcatgccaagctataattgttggacatcccaccgagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgggggaaaacaaattgtccgagacaacgtacgaggctaagaagatagtctgcccattaggactggaagttcataagaatcacgcatgtccgaacgattgtatcctatatcgcggtgaggagtatgagaacctagaagcatgccctgtttgcaaagcactacgatacaagattagacgggacaatccagaagaagttgacgggcagctaacaaagaagagaattcctgctaagg

SEQ ID NO: 11377 - DNA, 1501 bp, Oryza sativa
  unsure (1)..(1501): unsure at all n locations
tttgttttcttctgtgccattcggagggcagccattcgggctcaggggcgcggccggtgcagcggcgaggctaggtgcggccgtcgcggtgaaggagcagatcgcgcggccgtcatggtgaaggagcgcattgcacgggccttgcggctgtacaagaagncgcggcgcggtgncgncaacggtggcgggtgaatggtccaggtgtgggcgccggtgagggacggcgcccggcgcgtgctcgccacgcgggggcagccgttcgtcctggcgtcgcagtgccaccgcctgttccagtacaggaccgtctccctcacgcgcgtcttccccgtcggtggcgccgccgccgccgacaagcaggggcttcccgccagggcgttcgacacggggacgccggagtggacgcccaacgtgcagtgctacggcagcggcgagtacgcccgcattagctacgcgctcatctacgacatccagggcagcctcttcctccctatccttgaccccgacgacgcgagctcccccctcgccgtgcatgagctcgtcagcaccgtgctgcggctccgcggctccggagaggtcgccaacctctgcaacactcttgaggcaatctctctctcgctctctcgatctatctgcaactaagatcaagaaataattagctacagcaattagcaggagtgattagattagtgaactgattaacatttcttgtgttcactgagaggtgcagggattactcgccgtgaaccagatagtgaatccagatgagacccgggcggccatggccgaggtatcgtagctcctaaccatggtgtgtgtctgtgtgaagctcacaagctgccattggcacgcaaacatgggtgagatgcaggagcggcggaaacgacacggagaaggccgcgctgacgaccgccggcgcaccgttccacctcgccgccgccgccgccgggcaaaggaggtggtcgggcgccagttggaggggtggccggtggcgctgtccgctcggctcggcggagacggcggtgacgaggaaaggggagggcggcgtggcggcgcgggcgtccagcaactcggccacgctcggctgggtgttggctgggagtgacgcggacacggatgccgcggagataggggaatcgagagagaagagagagtgaaagggcaagagcgacatttttcctgctcgagcccacatgccagagctactaaacagttaaaaccaaacagaatagtgacggaatggtgtgaagggcgcgataaagttcgacgatggcataaagggaggttcgaactttttagtggcacagaggcaggcaccatcttttttaatggcacacagggaaaaacctcaacaatgtgtgtatgcgatgtttggatgcgccatactttaccacaattaaaataaaggcagttgtgatcggtacaaaagtgcggtgttgttaatgtaaattatatcgtgacacatgaagacacgagagatctacttagtttcagtgtagatcct

SEQ ID NO: 11378 - DNA, 1501 bp, Oryza sativa
tccctcttggagagttctctttaggaatgatctctcccttttagttcatagagtcaaaaattctgagagagatacattattacagtggttaaatttgttgtaattttttcccctttattaatataaaatcttaacggtgggggcttcccctaccgtagttctttcaaaaaaaaaaaaaagtcactgccaggctggttcggaaacgccatgttagctgagaattccgcagaaaaagaactttgcaagcttaattcgtgtcacaatggcatggtgtagtgcaggatttagacagctgcaaagataaatgtgttatgcagaaaaggaaaataatatcttgggaaaagtattcttagcaacagcactgtgtttcgcatatttatacgaacttaatttactatcttgtagctcggatcaaagatattacgaatacgaagtgacatgaatgtactagatttacctaataatagttctttcttagcgaagcatttgtgtaactgtactgactcgtgattgatatattattagcaaacaacatgtactccttacttttcatcaaaatctcagcacaaagcatatagaaatatactactattttcttctgtttataccctcaagataaatgaatggaatttcatctcagcaccagcacagcactatatggccattttcccatcatttgtcattgcagtttttctcccatattctaaacaggtcactctaaattcgatgacacactcatacgcttagaaggcatatatggccagctttgtggctcatgtcaaatccctactatcaacgtcgaagtactgtcaaagaacatctcgacccatccatgtcgtaggagcattagttttcccaatgcctttcacttccatttctaaattgttcatgtatggaaaaaaaaaactaaatcttcactggagcaatatatataggcacctgctgcagtaatattacaactaactctagcatacatcacttcacacacacatatatatatagcttaggacctgtttattcccaaaacaaaattttcacgctgttacattgaatgtttgtacacatgcatgcagtattaaatgtaggcaaaaaaaaaatcaattacacagattgcgtttaaattgcgagacaaatcttttaagcttattaaattgcgaccaactgtactatagcttattaatcaagctggctatgcagcaaaagttcgaagccgagaagatgattctgaaatcatcgttctctcgccaacgaatgatattttaggatacattaattacatcatcaagaactaatgaattaactagcaaagtgcttttgtgttacaacggaaaaaaatacttcctctatttcaacttactttgtcattctaattaattttgtcataagtccaattttagtaattttgattatatataatctgcatgttcttaaactatatgattttctataaatttgtattgctattagcttcagtacgaggaaatacaaatttctacgtacc

SEQ ID NO: 11379 - DNA, 1501 bp, Oryza sativa; identical to SEQ ID NO: 7471

SEQ ID NO: 11380 - DNA, 1501 bp, Oryza sativa; identical to SEQ ID NO: 7470

SEQ ID NO: 11381 - DNA, 1501 bp, Oryza sativa; identical to SEQ ID NO: 7469

SEQ ID NO: 11382 - DNA, 1501 bp, Oryza sativa
gtaattggttagcactaacatcaccctcttgactgccgacgtgagctcgaccaccgccaatggaggcgcaagtcagcaagtatcttccataccttgccgaacgtcggcaagctacttaaatccttctagacacctcatagatgctctaggaaccttccctgagccatgcctaactctcaccaccccgatcaccttttcagctcatccatgtcaccgccaccctagccgctaggttactcacacaccaaattaacccctccggcgccgctcgccgtcgccggggaaccctatctacctcccctcctcggccgcaacacctttccccctttattactgccataatccctaaccctagcgccgccggccgtaaatggggaacagttggaggttgaagaagagaagagagggagagactgatcggtgggacccacacacaataccatttaacatttaatttgattttcaaactttagaagcccatatattttaaaatatagattcatttccagtgaaacttgaaccaaaattcttctaaaatcattctctatcttttgagaccacttttgctatttttatattttattttatttttacctatttttggattttatttgaatcccttttgaatttgaattttacatgtttaacccttggtcttgaggaatcttatgacacattagataatatcagtcaatctcaggacatcgagcaaggcaagttactatacacattttgatcgtttaagcctatattttacaagttatttatttataacctttctactcaatactctactttcacatgcataattcaaccatagaaacccagataatttagtattgcttattttgcttacaatctggttaaaatgttttatacttagattgggacaggacatacgaattggatgatttccggatggctagtactgtctcgatcgatataagttgtcaccaggtacttatgtcaaacgaacgggtgcgaccgcagtttctagaatggggactgacctagtcattatgttaattagcaatgtggtacctctgtatagtggctcttattgttaagtccttgagcaggaggcaactgtcacaccctgaagttcttctcccaagccaaaattgaatttataattggtctcgagaaaataccggtgtaaaagcaagagtgaaaccctaaataaattaatgcaaataataatcggaattggcatgtggaatttttcttgagctctacatgtcgaaatgtgctaacaagatttttagtggaattttcatagctctagaaataattttaaccaatcaaaaatgagcacaagcaatatttaatcccaagaaaattcatttcctcctttttctttttctttttccccttattctttttcgaatgggccgccggcccattctcttcctcctccccctccccgctgggccgaccgaaggccacgacccagctgagccggccgcccgagcccctcctctctcccggggtcaccgacagg

SEQ ID NO: 11383 - DNA, 1501 bp, Oryza sativa
gtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagattctgtcttgatagctgcagcacctaaaccctgtctacatcatcggtaatgcattttgtatattgataactcaaaattttagggcacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctacgccgtcgctcgtagacaactccatcccgctcgccggcgtgcaccggcgatcaggagagcaggtctccggaacctctaccttcgatgtcctgcacggggagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttacta

SEQ ID NO: 11384 - DNA, 1501 bp, Oryza sativa
tctgaatgtaggagttctagtggtgccaagtttctctcctcggcagccttatgaggcttgcgaggttgcttcaattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggtttacagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctatctatagaagagacatgctgcatgttcttcagctagacgatctttcctgaagtaaacttcagatctaccgtgccaataccatgaacagaagcatatgacccattccccattaggacggtggaacctcgtgcgacctgataagaagaaaacaatgagatgtcagcacaaacatgtacattggccccagtataaacccaccaattagtagactaattaactgaaaaaatagtaggtaaattaccatacccgcttccatctccagtgttgccaatggtcacattagcagacttagaagtctgccctacaggtgccttcatccccttgcgttgtggacacttcctagccagatgaccaggttggccacacacaaagcaagtcctctcatcctgattaggattgttattgttcttcttctgcttcttgaagttggtggtctattgagctttgtatttccccttgctcttgttctgggccttgtgcacaacattggcactggactgcccaccatcgcccttagacgcagcatctttttcccgagctttctcctcaacatcaagagacgctatcaacccctcaacggagtattcctgtctcttgtgattgagtgcagtaccgaaacttctccaagatggaggtagtttcgcaataatgcacctggccacaaatttgtcgggtaagacacacttaaggagttcgagttccttagccatggtttgtatctcatgagcctgttcgactacagaacggttgtcagccatcttgtagtcttgaaactgctccatgatatacagatcattgccagcatcagtagcaccgaatttagtattcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagc

SEQ ID NO: 11385 - DNA, 1501 bp, Oryza sativa
gtctcagtaaatcaagaaaaatgcaaagaatccattaaaaatggttttgtttcctgtttctgtagtcttatagcatgttttgcttgcgtgctttgtttgtcgcgtagatttcggccttttcgtcgatccgcggtctctcgaagacgttgctgaggtctcatcagttcgagagcaaggcaagtcatgcaatacgtttgatcatattgtacccaatttacaaatatcccgcatttctatgtaatgttgcattcttttacaatgtaatgtgggatgggtcctattcctcagccacatattggttaccctatgccattaataacttgggtatcaaaatgactagatgttggcttaggaaatgcttagccatgcttagttcaactagtacacaaatggggatcacattattacatagactttgtcttttggcatagctttagattgttgccaccgcaatggtgttagttaattaaaatacactgaatggtgggctgtgggtgcatggttttactggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaaaagtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttaaatgctagctttatgcaaaagaacctctagcctcctttggttatatcctgcatcatacctcctcttccggtatgacttgctgagtacagtgggtagtactcagtcttgctctcttttcccccacaccagagtagaagttcttctcaattggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggataggggtttaatacacattcagcttagaaattctggttcgtgaatttctggg

SEQ ID NO: 11386 - DNA, 1501 bp, Oryza sativa
gttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatattaccaaatttggttgttaacacaaccaaacagaataattaatagcatcatccctctaaactctcaatctctcctaaaaactcccccaaccaaatgacccgagaggggttgctgaatttttttatatataatagtccctccgtcacagaatatagacagttttagagttggacacggttattaaaaaaatagatagcattaaatagaaagagattgtgattggttgagcagtggaggtaggtgggaaaagtgaagggttgtgattggttaggaaggaaatgctgatgaagaagttatattttgggacaaatcctaagagcatgtacaatagcaggctataagtcaactataaacatattttaaagagataaaggaagagagagaaaagtagcgggctacagatctgtagccagctgcagcacggactacaagacataatgtgtgtatgacaggtgggaccaggtattaatagtatagtaagcaactattgtatgaattggctgttacattggctatagatgattttgagctaacggtgggctatactattaaaattgctctaagtgctaaaaattgttatattttgggacgaggagtaattaactagcataatgcctgtgggttgcaacggtttctaaataatatttattgacataaattaaaatccaaaatcatatattatagttgggataaacgacgaaggaaatacaaacatacaaataacttttgtccggaacgataattcaatatcatgaaaattacataacttaatccctattttttcatttacctataaagaattcaatacaaagaaaaatataaattatgataatttttaatggatcaaatagtgctaaaactaatactgtgaaaaaacaacttaaattagttagaaattgaaaaaacttattttagcccacaaatgaaaaatccaatacattaattctaaaacggtgcatgtttcattgacataaattagaattttattgttctattcatagtcctatggtctgtgagtgttccatgagcatctttgggctagaccaagaaggaattgtgtcaaaaaaaaacattgttcattgccttccctagctgaagacgagaaacaaaagaggaggggaaatgggtgtcggtgctcctatgaccaaacagtggcgaggaagatggtaggatgtgtctcacgatgtgactcgtccatagatggtggtggtcggcaatgaagaaaaccaaaacagcaggaattgggcaagcaatgtcatggtcttggtagagggagaaacgataatgacgagctctggtggcgaacacgaccggataagtgcgtcaaaacacattcctgaacgagagg

SEQ ID NO: 11387 - DNA, 1501 bp, Oryza sativa
gaaactgttgttgctatgaaaatctcatatataaagaagttctcagctgtcgtcactggtggagaaatgatttttactcctggttggtaacctcctatagtcccggtttttcaaccgggagtaagatcgttaccaaccgggattaaagtttttttttctttttttgctattttgtatatctcacgcccattatcttaaatcattcaaagcaacgtatatagttcatcccaaatcattgacaacaacatagttcattctcaaaatcattcacaacaataatacagatcaaattacacattaaggaaaaaagaaaaaaaagaaaaaaaatcccgataggcgcgccgacctccaccggctgccgccacaccggcctccgtgccggccgccgccgcacgaggccgccttcgccgctgcgcgaggccaccgccgccgccacccggcctcctgagaatgggaaggagaggggagggggcggatccggaggaggaagaggaagatggggtgagtgaggagatgaggaagagataaaggtgagggatgaggagatagaacttatgtcgtgcgcctcctcctcctcgatctcgcgcgctcgcctcgtcttctctgcgcatgccgatctttttttctcgattagtaatatcaaccgggactaaaaataattaatagaggggtctgacatcacctgccgtttttttttgaaccgggggtaaaaatgatctttagtcccggttggtgttaccaaccaggacaggactaaagattaaaaagtagctctaaccaattgaactttagtccctatttttattgcaaccgggactattgtggaatttgttcgaccgatcaaagatggtttctccagtagtgcatattcttggtcgtttatctaccctcattttatattctgttgaagaaggattgcaacaatgctacagtgatgtaccgtcatagaccctggttataaattccataattctaagtccttaatgtttttgaatctgagcaaggggcatgctgacaaagcgtgtggaatagttggatgaaaaatgattgaggaattaatagctcaagtacatttgaactacttatgaaaaaatgggtaatggcttttcattcgtattttaccgtaaatggttatcggtaattcattagacacactttgattttccgactaaaaataaaagttacagctagcttacctgctgcccatatatgatcttctcagtttccctttttctatttccttgtttctttatctaataataagcatgtttatatctattaatacgtactttagctagctaggggacatttccctttatagcagcgccaatttttcaaatacctcgctatatgcatatagcagtagcaatgttgttaatcacaatcttgtttatttaagttcaaggaaaaaaatgtttgaaatggattgattccccaacattttagtcagacataactcatctaagcttttatttgtggaaatgatttttcttttgcttat

SEQ ID NO: 11388 - DNA, 1501 bp, Oryza sativa
aacattttcaataatgatactgtctctaaaatatatctttaacaaattttctattattacagtactttgtaaaataaatttatatgttgttctagtacctttcaactatatatttttcaaagttatttatagtaaagttataaaattttaacctcaactttgggtgtgtttagttcacgtaaaaattggaagtttgattgaaattgaaacgatgtgacggaaaaattaaaagtttatgtgtgtaggaaaattttgatggtcagaaaagttgaaagtttgaagaaaaagttaggaactaaaccaggcctttgtataaaacatcaagaattatagatttggagggagtactccatatccgttttatattgtgaaaaattttgggtttcatgctgtgaaacacttcaaaatgttgatgcatttcttttattgaacttggacaagaccaaaataacttatataatatactagaatagagtgaaaactgtttctacgcaaacattattaggtaccaagatgtgtacaatgtggaaagctatggtatgtattaataattcatccatttcatatgtaattatcgcttttccgtgattatctttcatgcaactttttttgttattatgtggaaagttagctttaagggcctgttcactttgatgtcattttcaaccttaccaaatttcggtaaagttaccaaaaagagtggctacatttagtttgttgttaaattttggtaactatgtaagaaatcctgcccaaattttggtaaggtattttttttattaaagtgaacaggccttaaaagaaaaaaggcttgcttatatcttggaacaaatttatactccagcaaagtcaaatacacatggatcgacctagctagccttttcatactgtgcactcaaaaccatacctttagtgtggagataacatagtatcccactacaattccactgctataaaacccctagtttattgaaataacaaaacaaagttctacaattagcaagccttaactagggaaggcaatgaaaacaaaaatcaaactacattagactaggtcaaaatgcacccacaaccacaacggttatgtgctcgagccagtatctcatactaccaatactacaccaacaccaacactacatactactactagcggcactgtacatacaaggggaataatacaagctaaaataaagctactccactcctagagaaggaggacctaaacgcaataaccaagtcaattaaacacggttggtacaaaaaggacacccgcccaatacaaaaacgccactacaaatgcaaccgcaaatgcacggccctttcccccaaaacccccactgcattcccccccaaacccacaaaccccgccgctggatcaacaccacctcaagctcgaagtgagccactgtcccaagcaaccttccttcttctccccacctcgttttctccaaatcgccattcacaacccatacacactctgtgcgcgtgtgtgtctctatga

SEQ ID NO: 11389 - DNA, 1501 bp, Oryza sativa
agatccatagtcttgaccatgaggcttgtgaggatgatactggaaagctgatgaatccaattcttcttcaaagtgttgacgcaactctccaatggccaccaaagctacttcttgacaagcatggcagtacgatcttcctccagcttcaaacttaaaagatggaagatcttcactatcactagccaatgtcacacgaacacgacatttctcctcgtcggggtcatggggaatctggcgatactcgggagcaacttcatagcctacttcaaaagccatcaacctcagctccctgacgagtcctaacacctcgatcaaatttcttggtgaacggggcggcatctaaagagacatagaagagaagaattaaagcatattttaagttagctaagtctagttggtgcagctaaccttaactgatttttgaccaaaaaggaagaaaatagaagaaaagacacatacaaagctattttataaaatatatttttagaatttaactttttaaacagaaacaaatatatttttttttgacaaataattaaaataaaactgaaataattatgatctattataagcacggtacagtgtcaccataggaaagatcagtagtactagtgctaacatgattaattcgataccataataaatgtacagtgccgaccaatcaataaaatttggtaaagagaaaaaaaaatatttcgagaagaacaactttttgcttttaaaagaaaagaatttgaatttcaataaattttgtgcataaccttgcatatgctgccaacttagttaatttaaaagagaaaagagaagagcagttctattttttttttccaaaatattttgaaggttacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaatgacaatattgataatagagtacaaataattattaaatattcgcaaaataaaattattacagaggtagatagttcctctcaaacaaaaacaacattctacgcagcggaaaacaaaactaaaacaaactacggaacagcgacggcaactccactccacaggcaacttaaccagaacaagcctattcctccagatcatcaccttcactgaagtactcctcctctgatgaatgaatattgcaagaatgagcatatgacatactcaacaagccacacagcaaatatgcaagtgcacaggatagcaaaggatggcataatatagctcatttgcagaaaacagcatttaacaaatatttaagagagaagtaaaacagttgaataattaatcaatattaaataaacaccatacaacacacccgtgttgcataggcccaaccacatttgatcaaccaaccccagttgaacaaattaaccctccataccaggaattaaccattccaaaccaggaaataaattaat

SEQ ID NO: 11390 - DNA, 1501 bp, Oryza sativa
tggttcattatggtgtgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagtttaatctattcgaatagccgtacccacggttatgggtgagttgagcaatgtttttcgtgattagtctcacacttctcattaatggtaataatgtagtaattaatttatttcctggtttggaatggttaattcctggtatggagggttaatttgttcaactggggttggttgatcaaatgtggttgggcctatgcaacacgggtgtgttgtatggtgtttatttaatattgattaattattcaactgttttacttctctcttaaatatttgttaaatgctgttttctgcaaatgagctatattatgccatcctttgctatcctgtgcacttgcatatttgctgtgtggcttgttgagtatgtcatatgctcattcttgcaatattcattcatcagaggaggagtacttcagtgaaggtgatgatctggaggaataggcttgttctggttaagttgcctgtggagtggagttgccgtcgctgttccgtagtttgttttagttttgttttccgctgcgtagaatgttgtttttgtttgagaggaactatctacctctgtaataattttattttgcgaatatttaataattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtaaccttcaaaatattttggaaaaaaaaaatagaactgctcttctcttttctcttttaaattaactaagttggcagcatatgcaaggttatgcacaaaatttattgaaattcaaattcttttcttttaaaagcaaaaagttgttcttctcgaaatatttttttttctctttaccaaattttattgattggtcggcactgtacatttattatggtatcgaattaatcatgttagcactagtactactgatctttcctatggtgacactgtaccgtgcttataatagatcataattatttcagttttattttaattatttgtcaaaaaaaaatatatttgtttctgtttaaaaagttaaattctaaaaatatattttataaaatagctttgtatgtgtcttttcttctattttcttcctttttggtcaaaaatcagttaaggttagctgcaccaactagacttagctaacttaaaatatgctttaattcttctcttctatgtctctttaga

SEQ ID NO: 11391 - DNA, 1501 bp, Oryza sativa
aagtaaccttcaaaatattttggaaaaaaaaaatagaactgctcttctcttttctcttttaaattaactaagttggcagcatatgcaaggttatgcacaaaatttattgaaattcaaattcttttcttttaaaagcaaaaagttgttcttctcgaaatatttttttttctctttaccaaattttattgattggtcggcactgtacatttattatggtatcgaattaatcatgttagcactagtactactgatctttcctatggtgacactgtaccgtgcttataatagatcataattatttcagttttattttaattatttgtcaaaaaaaaatatatttgtttctgtttaaaaagttaaattctaaaaatatattttataaaatagctttgtatgtgtcttttcttctattttcttcctttttggtcaaaaatcagttaaggttagctgcaccaactagacttagctaacttaaaatatgctttaattcttctcttctatgtctctttagatgccgccccgttcaccaagaaatttgatcgaggtgttaggactcgtcagggagctgaggttgatggcttttgaagtaggctatgaagttgctcccgagtatcgccagattccccatgaccccgacgaggagaaatgtcgtgttcgtgtgacattggctagtgatagtgaagatcttccatcttttaagtttgaagctggaggaagatcgtactgccatgcttgtcaagaagtagctttggtggccattggagagttgcgtcaacactttgaagaagaattggattcatcagctttccagtatcatcctcacaagcctcatggtcaagactatggatcttatacctgtcctgatggcgaagagagtgctactctgatgcatgtggtgcatatgcttagtgctatggatacagtaagtgtggagcgagacaaagcagctcatgacagggaaaattggaatcgaggcaagatttgcaagttgaagagcaaggtgcaccgtctacagaaggaattagctgaacttaagggagagatgccgccgccaacatccaagcttcgcctcactgcaagaaagagaacctgtccgccccctcgtctccagttagcttcgaagattcgcgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggtggaagtagtcgtctagttagatcgttgccttagatcgttgtgttagattgtttgcttaagtttgcttgtgagtgtgtgggttttagttgttgcttacatcatgggggggatgtaacagcatgagtctagttctttgcttgtcagagtggtgaggtagtgttaatgcaacttaaatgtaatcctacacagttaagagcaatatagaaatttaaattaattaaataactccgttc

SEQ ID NO: 11392 - DNA, 1501 bp, Oryza sativa
atggattctacacatttttcttgatttactgagacatgaatgggattaaacggagctcggatgaattagttatgatttttagaagattcactgtgtttattactataaaagaaaaaaccttaaatcatttattgcgcaatattaaccagggctggaggagggagacgggcccgactggtgggccccacctgtcggcgaccccgagagaggacgcagcggggcggcctggctgggcctcggcctgcggccggcccagcagggagggggagaaagaaaggagggaatgggccggcggcccattcgaaaaaaaaaggaaaaagagaggaaaaagaaaaagaaaaagaaaaaggattttccctggaattaaaaatattgcttgctcaattttaattggttaaaattatttctagagctctgaaaattccactaaaaatcctgttaatgaatttcgacatatagaactcaagaaaaattccacatgtcaaatccgattattatttgcattactttcttagggttttctcctgatttcacctgcattttcttggggtcatttataaattacaattttggcttggggggaaaacttcggggtgtgacagccacccgcgcccttaggtgcggctgacgcgtgggacccacggcgccggccggtgtgagcccgggtgcgcccggtccaccgtggaccgtggggctgccgcgtgggccccacccccgtggacccggtccgcgcgcccctcccctcggctgacgcaataaatccatttttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgttgacgctgcagcttcggatgatccgctcttcgtggaagttgaagccggcgtttgggaaagcgagcaaggcaagtcacatcatccttgaacatattgaatcccagtttataaaattatgttgctttaaattattgcattatcgctttatttaaattcccacgttatcactgttttatctagccatgcctatttacctttgttatgaccttattattattgttattgttattattaccttgttcaccctagattaaacaaaaccccaactagtggacactctactcatggtaccactagtatgattttaggtagatgcttcgctgtttaattaggtaacattaggtgattttacaactttagactttgggatattctcatcacctggacactatggaattgttggattattgtggaattggattcacacctccccctctgttcaaaatccccaaaatggttttaggctgggctcggggtgcatggttttgatagtagcacctcggccatataaggaccggt

SEQ ID NO: 11393 - DNA, 1501 bp, Oryza sativa
aaggaacgcccgttgggttaattccggtcgtgacaagttggtatcagagcccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccagcagcatcaaccgtcgtggtctggacctgactggctttgttttggagctgcggggcatgtgtgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgctgtcacgtcctgataaattcatcccgaaattaaaaatcattctctaaaaggaataatagaattaattaaaattcgaaaagaaattggcaaacactaaaatacgtacaagaaaaattcgaatgtggcccggagaatttttgttaaattctccttggtctaaaatgagccctcaaattttacttgaattttcagagcaccggaaataattattaagcaacaaaaacaattatcaaagtttaataaaaagaaaaacctaaaaataaccctccttcctcctttgggccaattttggcccaaagtcctccctttttcccctcggcccgcggccgaagtctccctctcctccctctccttctctccctcctcctcttgggcctcctcccctcccggcccagctccctcccctcccctctctctcccgggcctcctctccctcctctcctcctgggccgcctcggcttcgcccggcccaagccgagccgcgcctcccgcccgtgccgcgcgcgtgcgcgcgctgacgccgcgcgcccgaccgcatggggcccacgcgccaggccggtcgtccccttcctcccgcccggcccccttcctctctctccctcccgtgcgaaccctagcgccattcctccctcaaatccgcgcgattcaagcatgggattcccaaattgattagggggaattaatcccctttccctcctctctctttcccccttaatttccccttgaa

SEQ ID NO: 11394 - DNA, 1501 bp, Oryza sativa
atttagcaaacagtaagaattgtaaaacaatagagtaattaatcatcaatattaatcaacactgaacagcacacccatgctgcacaggcccaaccatcctgaacaaccatacccggctgcacagatctatctccaaaccaggaatataccattccaaaccaggagctaaattaattagcatcaattaccacattattattaatgaatagtgtgggactaatcacgaaagacattgttcgacccgcccataaccgcgggcacggctattcgaatagttttactctggccagaggtgtaccactatacccacaagacacaacccaccagcatgttaccgtgccaggccagacatgtcaccatgttgagtgattgtgacaagacccctcgcataactcaacccaaagcagtgcaccgttcctggatcgtagtcaccccctcaaaaaccagaggaatggactccccagtgacccccgtgggcttatctccgccacttctcagtctggtgctccgcagtgagccttgttatacaaagtgtccagccgttgcccattctagcttgtggtgggcacggttaatgtttcacaaccgaaactcgtgaaccggtccttaattgtcatgagcactaccatcaaaaccatgtgctcataacccaccattatcaagttttagttgacacattaattaatcaaccaatcacgattgaccatcgtgtgctatcattaagccataattaaataatagtgaagcattagttatcccaattgtgtgctaatgtttctaagcatggctaagcaattatgtctaacatctagctgaaccaatatataaagctcaactagtcaaattataaaaacccaaggtatcaaggaataaagtaatcaatgcaaactggccttaacaacggaataagttcacaccacccggtgatattcgaaaataaatgcacagttgaaataaatagagaatttaaatataggatcaacatgctcaaaggaattgtgtttgggatctgtgtgacttgccttgcaataatcggtcttcaattaatcttcttgaacactaccggcgctctcacaaaccttcgaaacgacggaaacgacaagctaacatgcaaaacaaggaaaacactaagaaactccaaataaacaataaatataaagtaaacaaacatgtagatcataattttagatgtattatgagacttgaacggcctcattctgacttcatatgaattaaatatgaattttacaagatttaatctaattaaagcccatttaaaaagaattgaataaatttaattctatttatggataattttaatatgtagatcattttatacaactttagagacttgaaccaactaaacccgagctaagatgaattagttatgaatttttaaagattaaaccggattaaaacatttatatggattttaattgaattatgacgcaataaagaattatttttgaaaaggaaaagaggattattgcgtcagcgggct

SEQ ID NO: 11395 - DNA, 647 bp, Oryza sativa
ttggtgtctagctcgtgcctcccgtcaagcgcctgtggtcgtcgccctagtcttcccctgtttcccgtttgtctttgtgtgtgctgggccttcgctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacatcgccgctgccgcgccactgtcgccgtcgcgtcgccgcgccgccgtcccatcgcctcacgccccgcgccgcgccgcattccgttgcgtcgccgctgccgcctatcgcgcgtcgccacgcgccgtcgccgacgcgtcccgtctcatgtcccgtgccgccacgcaccgtcaccgacgcgtcccatcgtcgctccgagccgcgcaccgccgctgccgcgccgtcgccgtcgccatcccgctgccgcgccgcgcgtgccgccgccgcctcgagccccacccctccgcgcgtcacgtcgtcatcatcagcgcgccgcgtgccgtcgccatcgccgtcccgtcgactccacagccgcgccgcgcgccgtcctatcgccgcgccgcactccatcgcgtcgccgtcgcccttgagccct

SEQ ID NO: 11396 - DNA, 190 bp, Oryza sativa
aaaaaatggatttattgcgtcagccgaggggaggggcgcgcggaccgggtccacgggggtggggcccacgcggcagccccacggtccacggtggaccgggcgcacccgggctcacaccgaccggcgctgtgggtcccacgcgtcagccgcacctaagggcgcgggcggctgacagccgggccccacgcgg

SEQ ID NO: 11397 - DNA, 1501 bp, Oryza sativa
tggaatagtaaagattttgagggttgtatacatccactatatattcttctattaaattcacagtttaggaggttttatagtttaacagcatacaaccctcaaaatatactaaataaattgccgaatatagaattatcttctatattctctggtttgatttcgatctcctatcacattttccaagtgggatagcaaccgcctgcccacatgtgtatgtaaaattaagaatttttgtaggcgagcatcacaaccgtgtgaaaaaaggattttcgcaagctagaaaggaatgcagctcctgtgcccggggttcgtcatcatcatgctccctatctagcaaccgctgccatcgtcatcatcgatgtcatccccggcctcccatcgttgccgctggcggatcggcccctcccatcgccgccgccggctgatcggtgcacaagggagcttgtaaaaaaggcggcaggatcccggccagccggatgcatgcacgaggagggtaggcgacaggatccgcacgggagggggagagcccacggcacctctcctatctccccaaaccttgtttcactctccggcggagagcgaggaggccaaggccatggtggaagcgaggaggtcggcgcttcagatccggtggcaccgtggtgaagctgcattcgatgacagcgtagtgaagcgtgcgacggcatggatcgggcggcgggggcaaatgagctcggtggaggggccttggtggtggagccctatggcgaggtaaggaagccagtggctgctgttgcctcatcgcttcagattgggcaatctcgctgctcgttcaaggaggcattggctcgacagtggcctcgggggatggtgtgttcttgctactagatggtggcggctcctccccgagctccacgggtatcacagattcaaaacttcttctgcctagatttttcttatttcaaagattgtagtgccggttctggtgtgggtgggcaactaggcaaaggtggcctcaaatttgtaccggttagaaaaccggcatctatataggaaggcctatagtcgtgtcacctactatgatatatacgtcgtgttctacgtgttgttgtatgcagggccggccctaggcctatgcagacgaggcaatcaccagggggccatgatggtgagtgggtccaacacctaatactagtagtctagtaactgcctatggcctacctagaagaagaaacgcgcgaaagacgagaggagttgcaacgtcgtcggcaactcggcagacggcatcgcatcacacagggtatagccgcacaggcgcacaacatcgtcgactcgtctgcaacacagcaactcggcatcgcatcgcacagcacaagtcaacacttagccgcctgcctgcatggcgtcagcccgccggctgccaatcggcagcagcctcccgcctggagccctggacgcaatcacgcaagacagcaactcggcaagagtgcaagactagccgtccaggcatccagctgaaaga

SEQ ID NO: 11398 - DNA, 1501 bp, Oryza sativa
tgcattattttctattttagaaacacatatgtaatggaaattaatattcagtgcgcttatcagtagtcccggttcttaaccctaaccgggtttaaaaagaatttggaaatagcgggaaaatatatttagtcccggttgatgagaacaaccggtaaagatatctttactcccggttgttctcattaactgggactaaagatctagaggtatatatattcccgatgtgcgccctcgtcttctctaccaacacttagaaatttttgccccgatcgatctctctcggcttctccttcgcagccactgcctagggcatccccgcaccgacgccgccgtcgtatctcgacgccgtcttgcgcgtgtcgtcatcgccgcctccgctgccgcctccgaccccgacctcgatgcggccggcaccggcgacaacgtcgccctggcagtgccgacgaagccgcgccacaataccgcggcgacacgacacgccgggacgccacgacgccgccgcggcacggcaccgccgcgccgccccgccgccgccgcacccaaagccgcggccgcgctgccccgccgctgctccgctgccgccccgtgaacgaacgaacgtgaacgagaacgtgaacgtgaacgaacgaacgaacgtgaacgtgaacgaatgaacgaacgtgaacgagaacgtgaacgaacgaaacgtacgtgaacgagaacgtgaacgaacgaacaaacgtgaatgaacgttaacgaacgtgaacgtgaacgaacgtgaacgaacgaacgttaatgaacgtgaacgtgaacgaacgtgaacgtgaacgaacgtgaacttaatgttgtatttgaacatacgtaaacgaacgaacgtgcgtgaacgaactttacttaacgtacgttaacgtggacgcacgtgaacgaacgaacgtaggtgaatgaaacgtgaacttaacgagaacgcgaacgtgaacgatcgtgaacgaaacgtgaacttaatgagaacgcgaacgagaaatacaatatatgttacttcgcgtttctcctaatacatctttttgtatgttgcagaaaagacgttgtcgtcgtcgtccctcaagccggagtggttgctagccctcgaaggaattcgcgcaggcaagtgatgtaaatatatgattgttagatttttaacgcaattaagactattagatttaatatacgacacttagacttagcattataattagagttttaatataatattttttgagttttaatataagattattagatttgtaattagacttagtatataattattgactagctagggtcctaatatacgtcacttagacttagcatagttgactattacagttttaatacaatattatttgagttttcgtatacgattattatagttttaatataagattattagatttgtgtttagacttagcatatatgattgttagcatataagattgttaaagcaaaaatgtctcatgacttaggaactatttcttgtatgaacaga

SEQ ID NO: 11399 - DNA, 1501 bp, Oryza sativa
ttcacgttcacgttcgttaacgttcattcacgtttgttcgttcgttcacgttctcgttcacgtacgtttcgttcgttcacgttctcgttcacgttcgttcattcgttcacgttcacgttcgttcgttcgttcacgttcacgttctcgttcacgttcgttcgttcacggggcggcagcggagcagcggcggggcagcgcggccgcggctttgggtgcggcggcggcggggcggcgcggcggtgccgtgccgcggcggcgtcgtggcgtcccggcgtgtcgtgtcgccgcggtattgtggcgcggcttcgtcggcactgccagggcgacgttgtcgccggtgccggccgcatcgaggtcggggtcggaggcggcagcggaggcggcgatgacgacacgcgcaagacggcgtcgagatacgacggcggcgtcggtgcggggatgccctaggcagtggctgcgaaggagaagccgagagagatcgatcggggcaaaaatttctaagtgttggtagagaagacgagggcgcacatcgggaatatatatacctctagatctttagtcccagttaatgagaacaaccgggagtaaagatatctttaccggttgttctcatcaaccgggactaaatatattttcccgctatttccaaattctttttaaacccggttagggttaagaaccgggactactgataagcgcactgaatattaatttccattacatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccata

SEQ ID NO: 11400 - DNA, 187 bp, Oryza sativa
tatatatatatatatatatatatatatatatatatatatatatgtgtgtgtgtgtgtgtgtgtgttgtgtatgtatatatacacacatatgcatttgcataacatatatatatataaatacatatatattaatcatgtatatatgtattgaaacatatatatgcatggtttatatatatataaacca

SEQ ID NO: 11401 - DNA, 1501 bp, Oryza sativa
attagaggaagggggcggctggccccgtgcgcgcctccccacgtggctgatcgcttatcagccgtccccttctctctccactagtatccctctaaatctacaatgcaggtactattaccgatggttctcaaactggtagtgctttatcggtctccaacaattcatcattatgcatcaaatatcatgttaaaagtcacaataaaaataaatggcacttatataacatttttaatgaaatgaatggtcgaatatcatattatctaataaaaaccggtgtcatattatttattgaacattatagttgtttagcaaacattgtgggattcgattgaagagctggtatagattcaatgccctctaatgcagcggcggattcagaaaattttatgagcctaggcaagtcaaatgatagatgataaaagcgcacaaatccgtataactctgtacaaaccatttctcattgatgtaaacaatttgacactacatagttattattttggagagaaactaatgcaaactacaaataatgatttgaacctcaattactaatttcataatttgcgtggttaatcttccctttattagaactaacagtgtattaacagtgtatgttcatgaggcggagcctgggcaatggcccaggctggccgggccttggctccgccattgctctaatggtttagaagttgtgaactatcctagatatcgacaatccttgaaataaaataagaatttatcaaccatcatatgtgaataaaataaacgggagaaaaagtactggctgcgtttcatcatctctatatgatctgtcgttactgtatgcaccgttgccatcatggaccaaccacttcctcataaccggatctggagaagaagcagtgtaggagaaaaggcaaaaaccataatggaggaggacggacatatacactagtacagatccttccatctgtgacggcccataacaagactggaatttgcgggccgtcacaaggaagtaatcttaattgggccgaagtttcgcccgattgagatatggtcgcacagtcatggtatataggcataaaactaaagcccgtcacggatgacacttatctatgacgggctatagttgaggcccgattgagataagtttggtgcccgtcacagatgacactctttttttaggccttttattaagactcgatagagattacttgtatgcccgtcacggttgattgttttagggccattacagatatttgttgcacagtataaataccccccactacctagtgtaattgtatcccactgttcactattttggtgggaggctgtagggggtgattttttgtccttttcccaaggaaaaccgaaattaaattcccaaaagtgataaaaatagatcaatcaagtgagtaatattaatcattaattgagcaatttcatcacgtcttacttttgcaatactgatcttataatatgtgcctctaatttgttttttttattttgtagcaattgattg

SEQ ID NO: 11402 - DNA, 1501 bp, Oryza sativa
cagagggagcaggaacttatggttcttaaacgttaatgattcattaattaccctataacagttcaccattatgcgtgatccattacagatagaagtacccaatcattaatcacacatcagtaactaaagatagaagaagcctttagatcagttcttggaggtctttctttaaaaaagacctttaccttcttctttttcgcctctcattagatgatagacaaattcttttagattagttaaccctgttgtagatattatttttggtttattaatataacttttactatggggacttttcctacggtgctcccaaaaatgcctttagtgctacatgggaagccacatcagtgcaggttccctaaattgaaattaaaaaaaaactttgggcatttatgagggagggccatcagtgctggtacatttaagaaccaacactaagggtatgtttggcacagctccagcttcagctccaccccttctgaagttggagctcaaccaaacagtttcagctccaccaaaattgggagtggagctgggtggagctctctcacaaaatgaactagagttgtggagctgggtttaggcagctccacaactccactccagacccaactcttagagctaaatttaggagttggagctgtaccaaacagaccctaaggtcagtctcccaacccatagtgtccataagtagtgtctatggtaccatgtcaataagacatcataatataaactacactctacaacccatagtttcttaaagtgggccattaataaatacatcatcgctcttctctaccaatcatatttatttttcatctattatgaagacactattatctcccaatgcaaaacttgacagtgtctagtgcatagcttctcgtgttgaagctgtgtcttgcatgagacccagtttcttcctctcttctctctcttaattaatatagtgccacataagctaaaaatcctacatagcaatgtatttaatgccatagacaccatcctaggtggagggttgggactgccctaatagattttacggagtacgaaccaaagaaagaaatgaagccgtctcgacgaattgagccaatgcttcaagtgcaacattaggggtgtgcatatcattgacatgtagtggatcactgtccggttttattggaacgatgtgattaaatacacatgcatgtaattaattcttggttttataactccgtctacacgtccattccttgttattataggaatggaaaaccggttgcactatatttactcctttatttgagttcctcactgttccagtaaaggtagcactagcgccgaagttcaaagatattgcaaacttatgctacctcctattacatttcctcaaatctcaataagtttctgaaaaattaaaaaaaaacactttcatttttattaaacagaatcctaacattacaacctgtagcaatacacaaggctgctggcacgcagggtctcgttactccatacgttgttaagt

SEQ ID NO: 11403 - DNA, 828 bp, Oryza sativa
ctattatgcttgtgccggtttttttaataaaccggcacttataagggataaaaatgccagctttcaattttagacacgttcaaagaatgagaaagatcataagtaaatcaggagctttaagttatccctatgatgatttctatactagtgtaacatgttaggaaacgataggcaaacaaacgataaagaacaatagatcaatcacagaagacacgagattttaacgtggaaaaccctcccaaagcaggagagaaaaaaaccacgggcgctagccagcaaaatatcttcactatatctagggtgaggttacatcgctgcacggcggcttacaagaggtatatatatggtggaaccctaaaagggatgacgatccgtaccgtgggggctctgcccccgcacccccgggcgtccccaggtgcacgggcctccgctccactacggcgaagcaggtctttatcaaatgtaaataaatttggattacaactcaacataacattcttacatgtagcatgaaaaatacacaagcatgcatatctttttaagataaaggatagaaatccgaacagctagcctctgtatctgcaagtaaacagaagcatccacatatatatgtgtcaagtccagaagctagagcttgacgtacaacaggcacgttgagacgacgtacatcacaggggttgatagataattaagtgcagttcttgcggcaggagtcgccgcagctcgtcaagcattcctgcctcagcgcctgaaggcagctctggcaagcctccggcgagcagccgtcgcactgcggggcgcacgccctggggatagtgtctgcgtaga

SEQ ID NO: 11404 - DNA, 331 bp, Oryza sativa
tatggccattttatttcatggcctgatagtttctgtggtaatccgtaatcgccaggggtggggcgtgtgttgagtgactttgttgtgtacattcattctgattttcatctatattgatatgttgcaggaaattactagagcacttgttgctgacggtgtgccaaaagatagaatcttaacaaacttctgactgcccctagcccactagaacacaattatcagccttctagatgttgtatccttattactcattacagtgattattctttacagcaagcgcgatggaaactcgcaacagagaaacagttttgtactacttacatataggggc

SEQ ID NO: 11405 - DNA, 1501 bp, Oryza sativa
taattaaataaatttacaagtaaaattctccattctccatggttaaataaaatgacatggttaaatttaattttattaaattctccataattagttacgctctttggaattttattggaattttcagagcttaattgctaattttattaatacaaacatcatttaacaattatttaattggaaaaagaaagaaaatacttttttataggtttgcttcgaaataaacatattcaatagaactataattgtaatgcttctgaaaaaatgagcactaaaaatgtacttattctctttttttcggctcgagggaccaacaatagacttatttccgacctatgccggtcggcccacggcctcttgcgcatgcgcgggcgcacttttcctcccccaggccgcaacctgggcttgggccggaaaagaggcctcactctcgatccctcttgggccgatttcggcccggacgacaccggccgtccgatctctagggttttgatcggacggccgagcgtcaatagtggggaaacaaaacccactccctctcagccgcggaaccctagcccatttccctccctgccatctcacttcaccggcctctcctccgcgcccccgagcggcggcggtgacgacggcgcccctcccccaccaccgatggcggcggcggcggcacccccaccacccacggcggtgtcggcggcatcctcccccaccaccggcggcggatctagcgggaggggaggcgccccgcgagcggcggcgacggcgacggcgcccctcctcccgcgagcggcggcggcagcaccctcccccaccaccagcggcggatctagcgggtggggaggcgccccgcgagcggcggcgacggcgcccctcctcccgcgagcggcggcggcggtggagtcctcccccaccaccgacggtggcggcggcgctctcccccaccaccggagagtgccctctgccgccgccgccggcggatctagcgggaggggaggcggcggcggcggtgctctcccctccaccggatccacagcgacggcgacggcggcggttcggcaacgacggcgacggcgacggcggcagcggcggcgacccccttcgatctaattttttgtttttatttggatatatgtgtgctggcggcgacccccttcgatctaattttttgtttttttgcaaagtgctataaggctgcatgtgattctttgttatgtgctatgattttttatactatgtatgtatatatgcacttgttctcctggtgatgctaaccgaataggacttggtataattcaaaccaagtcctattcgcccaaacagaaacaaagtcctaatcagctcaaacgaaaacagatgggagtttgtttcctatttttgtggaatcggacatattcttttaccgcgttgacgaatcggattcgttccggttttttttcacccggtttttttgacggacgatggaagcacctcttattttttaagtagtagtagatacgtatatgta

SEQ ID NO: 11406 - DNA, 1501 bp, Oryza sativa
acaaacaaacttacgagtgtattccaatgaaattttacaattcaaaatctatatctatatctatgcctaattaaaaaataagtaagacttccgaaacgtttttgtccgtcgttgtttttatatgtgtggtacgcgatttttcatttggccaagcagactctactacacgagatcgccatccgtatcctgtgcaaattccaatatatcccaatagaaacacataaattgaactttcagttgaattgaataaagatcaaagaaccatacgcatagatgggaatgccaacaaaattattttcaagtattttcttgcattcgctagcatttgatcctaacaattcaaatagaaaataggaaaaaaatcaggcaaccatttggaaactcaaagttgacgacaacaaagatgaggacgacggctcgtcctcccatctgcctccgcctcaacccaattcgcttttttttggcgagggggggggggggggggggcatgttgttctccccgatatcggtgctcatagaatcaactagccgcgcggaagcttcgctcgtggtgttgctcacgaagtcgaggggagaggaagaggaataatgtagggtcagggattcagcatggctatgtttatctaaatcacgacagaccatcaccgtttgatcgaatacggcgactctcagcgcacctacgccgacttgagccgtagcctaccacgtaggtctgtgcacttaacagtcgcggtgtgaaaaagatatatggcagggtcgtgcttctaattgtgggcttatttatgttttgcttattccccattgatttagatatttttttcaccaacaaaattagtgtaattagcacgatttgagccattaaaaattgctgaaatttgatatagtttttccttcttcatattaaattattcctacctaaatggagtcaacaaatagtataattatatatttgccacggtatagagttatttcttgaccatagttgtttgtaatttcatgtcattatttttatgactatattgaattatcatttatgtccagcagtatcccagctaatttccgtgaaactcaggaaccatgttggttttacctttttttttttaagaataattagagtacgtgtttgattttagaaatgatatcacatgttttccatgcgagagttgagagagagagagagagttatcagaatttgagtatatccatatgcaatagtgtttttttatccgttctatgagtatatcaatcatgcgctaatatctttctttctttgtgcgtgttaattttatcttcatcttcattaaaaaaacaccaacttactagttcatgtggggtattagaggtagggcccataactagagaaaattaatgcagtatataaaacatccataggaatctcaccaaagatatagcttgcaagtaagagcatcttcaacggagttgccaaaccactctccaagacaaaatttagcaaatgtggaagaaaaatgccctccaacag

SEQ ID NO: 11407 - DNA, 1501 bp, Oryza sativa
aaccatcttctgtgatactaccgtggtaactatttgatactgataaagacagggaaccgacaaacttaacctgaatttgctgcaaaaggcttcattgttcttgaaatttgcaaatgtttgctactgttatctgctatatactgtgtgttattcatccacatctcctgaacctgtacagggaaagaggattgagaatggcgtgtatttggggcctgttgggtccttaacctttgaggggaggctgtcatggaagaagaagatactcgcattcatcttcgagcgggttcgcataaaggtcggccctttcggccccctcgaaatcagcctcggaggtggcaatgatggtagggagccgagcacaaaggaccctttctttgtgtggttctatgttgatgaggaaatcgctgtggcacaaggcagaggagggggagtggcttactggtgcagatgtaagcgtgttccatgaactctgaagattcagttcagtcatcattccaggatgttcagttcagtttatgtatagataatttttcatcttctacatgtgtaaaaaaacgaagtattgaaaatgataccagttcgatgatgtctgcctgtacctgtaaattgtgttggtatagaatgccaaacgattgagcatagatgcaaagcatatggagtatattatgagataattgaccatcatccccttgtgattactgaacccggcggctttcacagattttcctggaagcatggaagtctaatgcctttctctggaaccatcgaagatcatgtgatggcagtgctgattgttgcataatactgtagtagtgaaatagtagtgagggctgctaccccacggtattccgttgctcctagcagtcacgggataactaaaatcccgagagatttaatacgcatcatcaatttcgtggggaggcccacgctatcctgcgattccaccttatccaatcctccctggtatcttggataaggtaccgaggtggtacctggtacactggtatcgaccgatacctggtacaccctggtatcgactgaaacccggtaccctgggtatcgagctgatacctaggtatcaggccttggtacctaggtatcaggtcttggtacctaggtatcgactgatacccctaggtatcgactgatacctggtaccctgggtatcgagctgatacctagttatcagggcttggtacctaggtatcaggctttggtacctgggtattgactgatacctggtaccctgggtatcgagctgatacctaggtatcaggccttggtacctgggtatcagcgtgatatcccaagagagaggaggaggaggaggagtcgcgggttagggaagtcgagcagcggggcggcggcggaggaagaggaagaggaggcgatagatctggtgcctaccttgtgccattccgtcgctcgtcgtcgtgcctcgctccaaaccgccgaacccgtggctccatcgacaccgcctagagcagctcctcgtcgctca

SEQ ID NO: 11408 - DNA, 1501 bp, Oryza sativa
aaaaggaaaaaaaaaagagatggggatctttgcaaagggatactcaccgacagatcaccaggggatttctcctgcggcgagggcgagggcgattgcgagggctccttctctaagtccggtgaggcggcggaggaagcggcgagcgagaggcggcggccgcgacggcggtggggggagccgcggatggcgaggtgctggggcggcggcttgcggagtggcgagaggacggggacgaaggtggaaggaggagggagcaaggaggcagacgacaacgccgccattggcgagagacggggagctcgcagtcgcaggtgtgtgtggctgcagtgctggggaaggaacgagaggccatggcgacgagcagacgtggacagggttagctcgcccagtggccaccacctgccacttggtcactctcattctgaaaccaggattagcatgttgaagacaagtcagtttagttatgcaaacaaattcatgaaatcattctagcaacttgatcggcactgggaaaaaaaccaggaatttatagaatttatatggtttctatgaaatttctactgtggttatatctaacacatggacaaattttactttgctccatagcaggttgaaaaattaaaatatcctcttcgttcaaaaaaaaaatcttaattgaagtgtagtggtagtttgtatgttagttcatttttcctcaacctgtataagataggatgtgcttattttaccctgacgataggatgttgctttcttgtttatataaggagttttttgatgataaaaaagatggcgtaaagtctataatctaataatctcataatttttcaaatgtatggaaataattgaacaacctgtgattgtgattatgtttaatttttattcatctacatattatgatgatatcttcactttttttaataagcaacatgattgctcatctttgtattaaaagaaataatttatgtgcaaaaccaaaaagaaatgggggagagggaataaaaaaaagaaagaaaagaaagactgcctatgatctaatctcacgatgactttaaaatgaccacgccatacagttattacagcgataaggtcgacatcggagaccaggatatatttgcatttgctttagagtttttaacgtatatgatgaattagtacctacgcaaattgtaataagtaccatccttcgttttacgttagcactctttcatccttactatcaaggtgaaggaaaccccaaacacaattatgatatgagctgatattgttattcatctcaacttttctttttgaatgcgcttataatttctttcctctagttatttatttattatagctagacaaaacaataaacacaatcagattacagcttccctgctgtttcgttttctaattctgggatgcaccttcttttctttctgaagaagaagaaaaaaaaagagaggagaaagaaaagaaaaaaaaaatttctccaaagaagaagagagcgtgtacaattcagtct

SEQ ID NO: 11409 - DNA, 1501 bp, Oryza sativa
tacagaacatgagagcccgagatctttcttccatcactttttatactgacccctgtatgttgtttcactttttttttcctgacctacctttttactagtggtctgagacacatacaaattttacaaataagcatgggctatgcttcactgcttgtgcattatgtatttctcaattttttttcttttgcacatggtggccatctgaagaggccaaattgtcctacctaactctactttagtgatcaatctaagatggcttaatttttcttcatattgtctttcttattgttgtacttgtagcacatatgccattaatatattatttgaaattgaattcagctgagaaatacaggatgcttaaagcgtttgtactgaatcaagcttttggacagttagagtgctttctccattaattatgaatggtgatcattagaacagctgccggcaatgatcgaaccttgatttttagacacagatatcgtagacaccattatgcagtagggataacgacgacactgatgaaaatataagcacgtgtagatttaatttattcaataaatcatgacattgaacatgtaaataaacataaccatatcatgtgatttaaacatataaactaaacagaagaacatgaacagattggctttgtagcacatggtgaatgcagaataggatcgacttgacggggagcagcccgcaccgcaagaacaacgcgaggtgcagggttttgttgtctacgtgtagcccttaaacatagaggaagatgagccgttgtggaagaccagtgaccagtcctgcaaagtgctttccgaaaaccttattagcatcttctcccgatgtaggacgtcgaaggcaaagtttctggagacctgctctcgtgatcgcgagtgcatgctgtctagctggatagagtggactacgagtgatggcacatttcggaggaggaggcaaaccctagattgttttcgtgtgtgatgctagaagaaggtggctcggtttatatagaaataatagaaaatgtgattcaagacgcctagacgttctccataacgtgtaaccgaactagagagatcgcatgtaacctaaccggactccacaccgctccacgcaccagatgacttggtgtgtttccaaaaatgagcaccaaattttgcaacaaaataaaactgtaaaaggaagctgcatttatgcaagcatgaggagccaatttttacaaaccattcacgcacaaattgcgtacgcatgccactccagcccgagccaagcgagcgaggcattcgcgcgtgtgtgtgttcctttttttggaacacaagcgaagcgtgtgcgcgtttgacttatgttcctactttctattgtacagtaaacatcacccctcgcatgattggggctgatatgcatttgatagctatgggctgtagtctatgtgaagttctcttagttcttgtgatctctaatttataattttagtcaaaatgtatgctaccaaaagtcgaatcagagc

SEQ ID NO: 11410 - DNA, 1501 bp, Oryza sativa
ataagacgaacggtcaaacatgtactagatagtcaacggtgtcaaacatttcgaaacggagggagtattagcgaatctggttgacaaaagctaccatgttatatatataacactggaatttattagcttctactttcagcataatgaataatgcagacctaccttcctgtctgtggcaccatagcatgtgttgaaggggaattaacaaaaatgttttatttctatgtttatgcggcacattttgaagcaaatgaatttgatatctacaacagtcatgtggaatgaaaaaggaattcagtcctgaaataatttggcccagtggtaataagagttttgcgagaaaaaaagtagtatagccttttccatcaggcactaccatcctagttgagttggtcaaccgcttcccagttcatccaccaatgacctcggccttttgaacattccatatactgtgaattcattcatctatattacacaccagttgctccatgaatgtccctgcaaatcattgcagttactgaaaacaagatattcggtccaatttgtcacaaagaaagaaaaagaagactgcattgaactgtctactcaaagtctcagactattgaaacttactatgcttgtcatagcaaattaaattacgttctgatccctgtataaattggttttaagtgactgtgttcaacagttatcaaaacttatttagtcttctagtgcttctaatatcttgccaaatgtttattctcttgatcattaataaccttcacagctagagttgtgagccaggattgaggcactctgctccacgctggttcgatacacctgaaatagatcaagttctgcatgagatataggtagaaaagaccgggttgtttaatttttggatagatatatatgtaagttcatatccaagatttagaactgaaccgttattattcatggaagaattaactgactgttttatagtaaaaactcttttccactgaatgtttaaatcaaggcacctgaataataggattgcttggaaatggttcagacttcagatgcatcgctagcattccagatgacttctattcctactgtaaacatcacctcttgaatgacagggggctcatgtactttgctagatggaggcaatttctgtctatgtgaagttctcagttctggtgtccaatttgtgatttctttctgaatgtatattggcaaaaacaatagccagagcaattatgagatctacaacactaattatgaacatggttttgatagcgaaatatctgaatttcaaatgtggttgcaaaggtatctgaattcctgttgcaaaagtatttcctatctgttgcacagattttgtgtggatttcttggagatactttctcaatgatgttaatttttcttaatactattgatttgggatgtagggttctctttgctcatattgctatacgaaagattgtagggtggggataaaagtttcctacatcggcgacaacaagcctagcgctga

SEQ ID NO: 11411 - DNA, 1501 bp, Oryza sativa
tcgatccattttctttgtttcttttttggcatagatcgaacacttggtggtgcgctcgtcggcgttcccggtgtccagagcgccaccatcgtcccactttgtcattcccgtcaactcgaatcatctccggctgtaccattgcgccactgacatcgcctaggtcccagcagaacgacgcccacatatgatgaagccaatacgccgccacgaacgctgttggtcgccgttgctctcctgctgcctctgcttctcttgccgccgagtcactgacatgtgggcccggctgtttagccacttcattaggtgctaaggactttaattagtagaaatttaaatcttgtaaggttctttttgtaaaattgctttgtttgccatgtgggtttatggacctaaatgcaattcacctaatgcccagggacctttttgtatagggtttagggcttaccctaaaacatgaaattactatttcatgcactcattacttgagattttgccgaagccaggagtttaatcatataaattagtttcattccaacttagttcccaactatagattagatagatggtttaattctatagcaaaacattagagttggcttatcctatagcttctacagtaatagttagccacaatcttgtgaataccctattattttatgtaaagaaatttccattggagccttaatcaaatgtatgcgatgaagattcagattgttgaacctgtatcaatctactgatccaggggttgatacagtttaaaaatgtcggttacccaatctttaattttaggacccgacaaggtgtgtgggtggggccccctgtgatttgccagcctagagcggccgtaccgctcgcgccccctccccccagagccggccctgactacatgggccttaaaaggccaaatggcatcttatgacgatttctgggcttgatggcgacgaaaatggacgccatagactctatgacgacagaaagatcgtcactagattaatgacaaaaagataagctttctttatagaacgccattagagtcgcatgataggtgacgaatcatattcgtcacacgaatgtcacagatttcattgcatgacttaaaattcaatttttatgacgtaaatgagcatcacctatcataagattcttggctatttgagaggcagtttgcagacatacagcacacagtttcataccgtgtgcgtgcctagttggcaactggatcctagtagatgcaaattttgaaacattcaacccaacccaatccttcttctcttaatcttctcttcctacacttgtgtttgtgtgtgtgtgtctaagaggctagtagtagagtagctagcctaaaattttttgcacgttgcagctactaactgtgctgctggcttgtcgtcctctgcttcaacattaaagagaaagctaatagatcggtgattcactttggtttctttgatgctatccagccacgtcaccatgtatgcgaattttgtggatggagtcagag

SEQ ID NO: 11412 - DNA, 1501 bp, Oryza sativa
ttcgtaaccgtgctcgtccagagacaagcatcgccaaggggtatggaacataggaggtcattgaattctgcgtagaatttatcgaagaccttcgcccaatcgggatacctgaatcacgccatgaagggagactacggggaaaggggactctcagaaggaaagcaataatgatggtagacaacaatttattccgtaaagcccatttcacggttctgcaacaatcttcattggtggctccctacatcaaggagcacttggctctagttcgcgccagaaacatcggtaaatccgatgcatggattacacggcatcacattgatactttccccgtgtggctgcgacaacatctcatgggtaacgagacgattaaccaacaactggccttcctggcgaggggaccatctggctcgatcgcaacattccaaggatatgagataaatgggtacacattctacacgagaaaccaagacataaagagcacgaaccagaacagtgctgttcgtatcgatgccatgggacacgatggtacaactgacacgtattacggtgccatcgaggacatatgggaacttgtctatggacctctcaaggttcctctgttccggtgccaatgagtttggctgattggtggaggcgtaacgattgatgacagtgggatgacaacggttgaccttaacaaggttcgatactcggacgaatcttttgtccttgccaatgatgtaacgcaagttttttatgtgaaggacatgtctagcaaaggaaagaagggcaaagggcctgatgagccgaagtgccacgtggttctcccaggcaaaagaaaaatcatcggagttgaggacaagactgatgaagattatgatcagtttgatgggcaaccccctttcacggtgacggttgaccctagcatcctcctatcaaacgaagacaccccttactcacgtagcgatcataaggaaggaacaatagtgaggaggaagtacgtgcggtcaaccgtcaccgccgatgtattgccgtaattgttgtgtacacgatgtaaaatattttggatgtattgaatatccatataaatcaattgttgtacggcatatgttaattatgtatgattattagaatttttaaaattttaaatcatgcatatgctagttatatatgataattagaattttaaaagttttaactcctgcatatgcttattatatatgattattagaatttttaagaattttaaatcattcatgtggtatttacatatgattattagaatttttaacaattttaaatcatgtatgtggtatttacatatgattattagaatttttaacaattttaaattttgcatatgctagttatatatgattattagaacttttaacatttttaaatcatgcatgtggtatttacatatgataattagaatttttaacaattttaaatcatgcatatgctaattatatatgattactagttacagttaatgtaagtgtatattaaatctcttgtc

SEQ ID NO: 11413 - DNA, 347 bp, Oryza sativa
aatctctctatagcatttgaaacaatcatcaattattttcagccaataaaaccccactctcctaagcaaccaatttatcttacgggcatattgatgaatttcacaaatcccttcatgtactactctcctagcaactttagattgatcattatctaagtaatactatatctatttttcggcgatataatatttgagcacttgccgccgaatcttccgatcaaccttaagtgtaggatctttcaaatatttaatcaaaggaattctccaagctatttctaactcatgagcacaaatgtccgaattcataattaatttggccttttaatcaattgtaacgtgcccccagc

SEQ ID NO: 11414 - DNA, 603 bp, Oryza sativa
caataacattcgagcccaatgcatatgggtctccatgctgctattaaggcccaactgagatatatatgggccaaaatatttaagacgtgtgcggtggattcgttatgggtcttgtaggtccaaatgtaaagacttttgtctttgtcctatccaataaaagatagttcagatggtacattaatacttgttttctcaaaacacaaaaaatgatacatactaaaacaattttttacccttgaacactagtgcaacaaatacaagttaggacatgttacctcttcaatttccatgtggaaagcaggacacaccataatttaattctagttatattgctagacatatgctctttaaagcaaaagtgaataagtgatcagtgatcagctaatataaattcaactggtaaataattaaacaacatggctataaatactgcaacatatcctatgcacacacttatccttgtgcactcatgcactcgatcactctagaccataggatctcaaagaggtcatctctactgctgaagagaagttgaaggatcaaagagtagatgcatgcttcagcttccatcaatcaatcactacaaccatcttcaccaacagg

SEQ ID NO: 11415 - DNA, 1501 bp, Oryza sativa
ggccgttcaagtctcataattcatctaaaatcatgatctacatgttcgtttactttttatgtactgtttatttggtttttattagtctttttcttcgttttgcgtgttagcttgtcatttccgtcattgcgaaggttcgtgagagcgtcggaagtggttcagaagattaattgaagactgattattgtaaggcaagtcacacatatcccaaacaaccctttgagcatgttgaacctgtttaaagctaatgttttatttcaacttatgcattattttcgaatgccatcgggtggtgagcctttcccaattaattatggtcgaagatgactttatttttctatgggtaataaattgattagcatggaccttatatattggattggttcagctaaatgctatatatataattgcttagccatgtttagaaacattagctcattaatggaatgaatcatactacattattatttatgattatatttaatggtagctcacgatggttaatcgtgttatgataatttaaacttgataatggtgggttgtgagcatatggttttgaagctcgtgctcatgacaattaaggaccggttcgcgagctactgttgtgagacattaaccgtgccaaccacaagccagcgtgggcaacggctttaccttttatatagcaaggttcattgcaggacattagaccgagaagcggcgagaagtccatgggggtcgctggggagtccatgcctctggttatatttatagagggggtgattatgatccaggattggtgcactatgatgagttgtgttgtgcgaggggtaccgtcacagttcttttccgaggtaccgtggtggtattgaggcgcatggtaacatatcgtggagctgtgtcttgtggatacagtggtacacctctggccagaacaaaactatttgaatagccgtgcccgcggtcatgggcgggttgagcaatatttttcgtgattagtgtcacacctctcaaataattattgatgctataactggtaataatttgcttagctccttgtgtacaggatggttgggcctgagcagcatgggtgtgatgttcatgttgaataacattgattaattactctactgtttttcaattctcaaatgtttgctaaatgctgcttttgcaaatgagcctatttatgccatcctttggtatccttgtgcacttgcatatttgctatgtggcttgcagagtatgtcatatgctcaccttgcaataatcaatcaacctcagctgaagaaaaaggatccagaaggagaagacgtttggcttataccccaattgagctgcctgtggtagtggagctgaagccatcgctagatcgtaattccgctgttgtttttcttttgttttgtaagtatgtaacgttattattatgatgaatttgtatattaaattgtcagtttgtgtaccttggctgattcctggacgaggattctatgcataaattagttcagaaattactagtgaattt

SEQ ID NO: 11416 - DNA, 1501 bp, Oryza sativa
  unsure (1)..(1501): unsure at all n locations
attgggaaaggttcaccacccgatgatattcgaaaataatacatagttgaaataaaaataatagctttaaacgggttcaacatgctcaaagggttgtttgggatctgtatgacttgccttgggcttccacaaatgtttcggaaccttcctcaacggaaacactctatccggaacgtcggaaactaaagcaattaaacaaaaattaacaaaacagtacaaaaacaagcataaacagtacatgtgaatatttttaacatgtagatctcaattttagaaaaatttagcaacttgaaccacctgaaacggatctacggttatttagttatgatttttcgaagatttaatctattagaaaaacgggaaaaagaaaaagatgatgatgtcatgatgacatcatcaatggtggccggaccgagatggtgacctcgccggagattggatggtcggctgcgaacatggaggacatgtacacgtagaggacgacgagacgaacccaacggtactcaccctcgagccaaacgacgaacgacgacggccggcgacgagatgaacggcggcggcggctccggtcggtggtggcgagtaggctccggtggtcggtggctacgggggacgggcggccgggcttcccctcaccttggcacacctattggcggcggcggcaaggggcggcgacgacgaaggcggcggcgcggcgctacccaagttggccggcggcggtggcgagctagccgncggtggcggcggagctacggagcacggaaaggcttggagacggggaaaacgaaagaccagcactaggggatcctatttatagccttgattgaagagatcggactcctcccgcaagaaatcgatccgggaatccaaaacttcggttttgaagataaactcgagaacgagtttgattcggataaaatactcaacgattagctccaattttttgggggtaaagatagagaaggatgaaaggatcaaaaccccttaaacaatcggactcggggaggccggatttgatgcggatttgaaggggaaagggggcggctcgggcggcatggctgggctcggccagccgactgctagaggttagggaagggtccgacatgtggggcccacatgtcggtctcccgagtggagggggtggctggcgggttgggttgggccggctcggtggctttgggccggctcgggcgcgcgggagagagagaagttgggccggaatcggcccaacgacttagggaagggatttttgaactttttaattaaaataatttgtgaaatgttgttccaattattaaaaatacttcccttgctcaaataattcccagaaaattctagaaaatagaggaacaactaaagtatttaataaaattttatctagctcatttttatgttgaaaattttcctagattattagagtttaacttgtaggcttttagaataatttctaaaaatgatttaaaatatgcatttttaatttaggcgatttttagggcgtgac

SEQ ID NO: 11417 - DNA, 1501 bp, Oryza sativa
agtatatcactacattagagagccttatctagaaaagaccatggaagaagagtgttaatccaaaactccatgcaagcaaaacaaacgaatgattaatgcgcttaattttaagggaagaacctgacgaatcgttgcaataaattttgagcgtacagagaattacatgtctcaaagtgagagccacgggccttcctcggaatatgcggatgaattttgcaggcaaaggatgtcatgtttttttttgcatgtattgccacatgtaagcttgttgacgtcacacagtaaattcttcgtcactactcactagcatgcaccgcaagtattgctatagtgttgctcgtggtggaccggtggtgatagtgtactcctattcctatatgcataaatatatttactaaatttgaattctcacggtcacaagtcaaaattacactcgtgagcacgctttcattaggaatttcgtaaggcttatggatttgtcattgagtccttttacgttagacatgtaaagtatcttaaatgacgatggatgttgctgcgcgcgtaaggttagcaagagtttgaagtttagtctttttttcttttaacgtttggctgtgatagatagtccgaatttctatctattattttaaaaaatatcttaaatgatacaacaagtcacaattaaaaagtaatacttacatggctttttttttaacgaaaacagggtaaaatactacctctaggtttttaatgtatcacgtcattgtcttttgaacatacatatgaaaaatataactcatgctaaaattatacacgtttaataataaaacaaataacatcaaaacaaatggtaattacataattttcttgataagatatacggagtatagtcaaagtcaatggcatcgtccaatgaaaactagaaagattatatatatagctcactaaagcatggagtataatttaacatacttgaacatttaagatctacaaaatacaacattcctaaaaaaatatttttactgcatttttataccacttattatatggtatataacaatttcatttttaaataaaatttctcacaaaactacacataatctaaccaaactattgtacgtaaaattataggtttaaggtgttgtataaaaaatacatatttaacagtaaatttatcataaaatacatatttaatatcaagtatcacaaaactagatatttaatattgaagtcatcacaaaacattagattctatagtttaaatccttatcactaccattttgttggagctacaaacattatagtgttgtgataaattggcactaaacctgtattttttttttataaaatttgctccttaatattattattttacacgccattttaaatctgtagtaaatatgtagttttgtgatactacattttaaatatatagttttgtaaaatctaccttttttaagattttaatttgtagtgcatatcaagtaaataatctgttacaaacatgacctagttgacg

SEQ ID NO: 11418 - DNA, 1501 bp, Oryza sativa
tgccagctaggtgcagacagaattcggtgccagacctgatgagcgaacacacagtcaaggaggatgtgattcgccattttgagttcttggacacaaaacggacaaggcgagtggttgtcaataccacgcttctccaggagatcgcctatccaacaacactgctggaacgcaagccagatgaaaaggttgtgtttagtagggcctttagcccacccaagcagatcggcacgcaaataaaggattgctacccaagaaagcaagcttggtaggccgagtgagccgagtaacgctggttgcttatccaacgccagacaggacggtcctccgtgcccggagagaactagacaagaagcatcgcatcccagaccatcaggtgttgggagaggacatacattgtgagagcgccgcggatgtcccttacccaagaattattgataagggtagaagcaactgaacgcaagggcacggtgaagtgaaggtcccgcactaaggaggccaccgagcgaccctcaatctacttatatgtccaaaagagagtcgacgcgccatcacctggcacgaagaaggtggacgccataaacatgtcggacgtgccgtcaactaggtcatgtttgtaacagattatttacttgatatgcactacaaattaaaatcttaaaaaaggtagattttacaaaactatatatttaaaatgtagtatcacaaaactacatatttactacagatttaaaatggcgtgtaaaataataatattaaggagcaaattttataaaaaaaaaatacaggtttagtgccaatttatcacaacactataatgtttgtagctccaacaaaatggtagtgataaggatttaaactatagaatctaatgttttgtgatgacttcaatattaaatatctagttttgtgatacttgatattaaatatgtattttatgataaatttactgttaaatatgtattttttatacaacaccttaaacctataattttacgtacaatagtttggttagattatgtgtagttttgtgagaaattttatttaaaaatgaaattgttatataccatataataagtggtataaaaatgcagtaaaaatatttttttaggaatgttgtattttgtagatcttaaatgttcaagtatgttaaattatactccatgctttagtgagctatatatataatctttctagttttcattggacgatgccattgactttgactatactccgtatatcttatcaagaaaattatgtaattaccatttgttttgatgttatttgttttattattaaacgtgtataattttagcatgagttatatttttcatatgtatgttcaaaagacaatgacgtgatacattaaaaacctagaggtagtattttaccctgttttcgttaaaaaaaaagccatgtaagtattactttttaattgtgacttgttgtatcatttaagatattttttaaaataatagatagaaattcggactatctatcacag

SEQ ID NO: 11419 - DNA, 1501 bp, Oryza sativa
atctgcttccactcgagaagcctagtctatgatgcccgcagacatcccgaatcacacaggttcgtttctgaccactcaggtcatccatctgccacataggctgattctggttacgattcccaatccacaataacttttcacaaagcacaggcaaacaaatctacacaacgggaaccacctcacatccgcccatgaccgtgggcacggctgttcgaatagttagttaacctctgcagaggggtacactttacccacaagacacgaacttactctagacactggctggtgtcagaggttcgtgacaaagcctttcccaagccgacccagggttacctcatgccacatagaaggatcaaatcctcacgtaactataggccattttaggcattcacaaattaattccagccaccttgatcggtaagtgagcaagcttattgtccttgccttaccaggaacccggtttgtccgaccccgccccggcgttcccaactattggcatgcgaggtttccctgaaccgactagttaattagccagggtgtcccattccaccttgtggttgcactttgattatgttcgatgagtttcccacaggaatcggtccttatatacaaatacgggacagtgccacataggcacaacccccgcatcgcgagttttcacaatttattttattttcgaacacaccgacaccacatgtcgggttttgaaggcttcacaaacccatttcccaagttttcgacaatcaacggtgtatgtgggatattaggtatacgcgctcagagagcacggataccgaagtaccacaagggtggagcgacaaggaatcagggtagtacagcctacaggaattagtgtgactactgggtaggtccgtcggtttggcacacaaaccgaggccaagcaagttaagtatgtgattctaataatgcgagttgcaaacaaaataataatgattttccaattataggagcaattgatcaaagggtgacttgccttgctcaaagtcttcacgaagcttcacgaatcttcgagaaaacccgcggttgacggaaatctggtaaccgcaactatacgcaaacaatcgaaaacctagacaaaagacaaagaaaaataccctatttagactaaataatagtgccattaaatagatctcaattttacggaattactagaagtggaacggggtcaatcggatgagcggttgagaagatatggattttctaaggaataaggaatttctgtctaaaggaaaaaggatttaataatttattaaaccctttttggaaagaaattgaaggagggatatgatttagacttcctcgggcggcttgggtacggcccgagaggagaggcacggcttggccgaactaatgggccggccggcccggagaggcggcccaagggggcgcggggagagtgagggagagagagggctggtgggccgagtccaccttccagggtcccgagtggggcccgcttgtcggtggcgcggctcaccgt

SEQ ID NO: 11420 - DNA, 745 bp, Oryza sativa
cacctctccaatcctacatgccaaatcatcaggttaaaccctatcgtccattcgcaaattaggtatatctccaccacatgatttctccacgtcaccacgtgaagactactctctaagcgtgaggactacgcatctccgcgcaacacgctactctccacctccacgcgactcactactatagatggccaaaaggcccacccggcccggcccggcccaggcacggcccaccagccatcgggccggcacggcccaatcggcacttcgtgccggaccgtgccagcccatgggctgcgcctcctgcccaggcacggcccacaagtagtcgggccatgccgggctggccgaaggtacgggtggcccatcgtgtcttttttttaaataagtctattttccctccctcttctttgggttgtgacctatatatagctaaaataagtctattgtccctccctctctttgggatgtgacctatatatagctaaaatagtctattttacgtccctatgctttcgaccgtggcatataatatgtttatttttactccctattgcttatgtatcgggcctagcctacggcccatcgtgccgtgccgtgccgagccggcccaacgtgccggtggaggggcctaggcacgacacgattgtcgggccgggccagcacgagctcgacccccgtcgggccaggccgtgcttgggccgagccaaaatactgtgtcgtgggccgggccgtcgggcctcgggccttt

SEQ ID NO: 11421 - DNA, 1501 bp, Oryza sativa
gaggatgagctgtcgcgcttacttcctgaggtttggtggaggttggtttttatgtagtagatttaagatgagaatgttgagctcggtgcaacactctgtcgttgagaacgaagatgtgtgcttggtgagacaccctaccactgagaaagaatatgtgttttgggacatgtacatgaggatatacgcttagttgtataacacatgtagaaagagaaaaaaaacacgtgagcaatgacaactggggtgaggtgggggggatatcaaacctaggtgaattagaagggggtatttgcaacaaaccgtcttatagggaagaatctcaaactcagattggcatttgaggtatcttttgcgattttctctaagaaaaacatgaaaatagatatgaaaattgatgcttatgcaccaaaattgtgatgaagcaacactcagaatatagaactaccattaattattgcaattatactttcttattttagccagtagtggagtggaatacattgagctatatcacaagcttttaaagtcaaattttggtaaggttatttagtggattcagttaagaaaagatgtcgatcaaccaatggaagtttatctagaaatgaccgagttcaaagaggaatcgtgaagaccacggcatagcagtttaattctatatattaactcgacaagattttgtaattttccttttatctttaggaaacttgtatcgagtccgatcaggactagtatcaatccgtgggtataaaaatgtacacccggggcccttgtaatctatctctcgatcaatacaacttttggcgcatcaccaccctctttttcgaggttttatggccagaggaacttggcacctggtgcagggctgcatcacttcgatctcccgcgaaagggtaagtcctaagttctaccaaccctggcagtggcaattgtatcggctatattggcattgttcaaggctacatcgtttcgatctcttggattgttatggttcagttggtatacttgcctacctgatatttcaattctatctttaattgcaaaattgtatttatagacaaattagtttagctgggactgtctcgattaggtctgatattatgtcttcgtcgatatatctctacaatcacaatgttgttttaaatagatttgttatatccatcatgttagcatagtctatgggcttatctagcttattgatcagatgcaatctagaactatctcggttaggtccgatctttgcattgttttatcggagtgctagcagataagttatctttgcatcagactttcagccgatgtatgcattaaccatcgagtctacatttaatattatgtatcaatatcagccgattggtttattgggcatctacttcatcatattatcaacggctgattgaattgtcagttcaagttcttccattgtctttatccaagtgtcagaatctacatcggatatataaccaattgttcaaaaccctatcgacatcggttagtaccgcta

SEQ ID NO: 11422 - DNA, 1501 bp, Oryza sativa
catcgcctgccgtgccttgtcgccctgctcggctcgcaccgtcgccattcgtcgccaagcaccagggaggccagtgcatgagtggacgtgtgacgaggagctccgggcacctcttcttccccttccctggccgctcccggagagcttgctcccgcgccgccgccgctcgtcacggcgccctgtcccgacgcggtagccctccgttcctcttcctcactcgccctcctcctcctttaactcgcgtggtagctcggttagccttccggtggttcgtaggcgccgccccaagccccgccgccgctcgccatggccttgccaccgtcggcgcccgctcccggaggccgcctctcgtcgccggacctccacggcgcctccccaccacatccgatcctagaaacgaaacccttgagccccggagatgctcccatccctttgaatggaaccctcgtcgtctcgtcgtcgtttccccctttgctcgccaccggttgccgccgccgcgattcgccgtcaccggctaccctccggcgaatctgagccgttggctcactctctcttgtcctccttgtcgttccaatgtgctccccgtcgccctcgccgttgcatggtgtccaggtgaaagtgccgtcgtccgccgtccatctcgccctccccttcttcctcctcccgccggcccgcgtggctgccacgtaggcgccacgtcagcgccacctcaactttgaccgagccgagccggtcagccgcctcctccctccaccaccctcgcgcgcgcggtccacggtgcgccaaccggctgcgtgtgggcccgccgcatccctggtccatccggtgcacgcacgtgaaccgcgctcacccgaaaccctagcaccaccctcatgcgccgctcccacggtgagccgcgccaccgacaagcgggccccactcgggaccctggaaggtggactcggcccaccagccctctctctccctcactctccccgcgcccccttgggccgcctctccgggccggccggcccattagttcggccaagccgtgcctctcctctcgggccgtacccaagccgcccgaggaagtctaaatcatatccctccttcaatttctttccaaaaagggtttaataaattattaaatcctttttcctttagacagaaattccttattccttagaaaatccatatcttctcaaccgctcatccgattgaccccgttccacttctagtaattccgtaaaattgagatctatttaatggcactattatttagtctaaatagggtatttttctttgtcttttgtctaggttttcgattgtttgcgtatagttgcggttaccagatttccgtcaaccgcgggttttctcgaagattcgtgaagcttcgtgaagactttgagcaaggcaagtcaccctttgatcaattgctcctataattggaaaatcattattattttgtttgcaactcgcattattagaatcacatacttaacttgcttggcctcggtttgtg

SEQ ID NO: 11423 - DNA, 1501 bp, Oryza sativa
tcgccccatctcctccccccttagacttgggtagtagcacgagtagactccccgtagctagccggcgccgccccgaccggtgccgtcgctcgccgcgtgctcgccgccatcgccgctcgagctccgtagcacccgcacgtcgccagcctcgctcggcgtagctccgcccaatccgacgctagcatcggattcccatagccgcgtggatgctctcaccgccgggaatcggtccctcatgacctcgtcgacgtttccctcttccctccccgccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcatggcagccacgtaggcgccacgtcggcgcccgctcagcctagaccgggtcgagccgaccccagccagtccctccccgtgcgcgcgttccaccgcgagccgtgaggctgcgcgtgggcccgccgcatccgcgtccaccgcgaaccgcgcgcgcacctcgtccctcccccgcccgcgcgcatgagccgcgtactccctccgcacggtgagccgagctgctgacaagcgggtcccacccgggaccgcgcatggtgagcccggtccaccggctctctctctcctccctccagcgcgcgcgcgtcttgggccgccttgggccaccttcttgggccggccggcccgttaagctcggccgagccgccctttctctcgggccgcgccctagccgcccgagggaagtctatattccctccctctccctttttcttttcttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcaccgtttgttgagttgtcccgttttgcgtgtagtttcggagtccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgctagtatcgacggtcgccttcaaacttaaaatctgagtaacaacttgggtaaaactggagttttacaaaagacttggaaaacccgacacctgggtcggtgcttgcgaac

SEQ ID NO: 11424 - DNA, 1415 bp, Oryza sativa
  unsure (1)..(1415): unsure at all n locations
agttgagactgttctgatgcttcgttgtgcatagaagaatgattgatgtatcaggagaagctacatacaagtttccatacaccagtttgagagtcaccataatacatcagcatggtacagttcagtccgttacactataatcatataaacttttcttttataatgtctgtcattctatagtattatcaattataattgtattatttctttggtactaagtcataacttttcttttataatgtctgtcattctatagtattatcaattataattgtattatttctttggtactaagtcatctactttgagaaagataaacttctatatcttaaatagaacagcaaaactcagtttagatcaaaatgaaaaattattgtggccctgtttggatattagctaaacaatgcaatgtgaactgaaagtagcattagctttatttttcaggcactggtacatctgttgaaatttgttaggccaagacttaaaggtagctgctaaatgtattaaaatattgtactttggaagtgataggtagagatctgagctttatttgtggctttaccttgttgcacgtaggaccttgaccagctaggcagctagacccatattcagaaaggtgcaatggagtggctgctaagctcatattggttttccttgcctaattctggtgatgagtgttgcaaaatactcctttacaaatgtgcctttcctggatgatgttgccaataacagtgaaaaatgtggttacatacatcataactctgtagatggctcttcacaaacagaacttttggctgtatggtcatggtctatattattctattaaggatatagtcaagattacgattatacatatggttagtaatcattggaactaaaggttttaatatgaaatgctttggttagtaaacatggtactaatggatgcttttattggagaatacttcaaataccaaacagtacgcgtataaacttctgccatttattggagaaaaatcttttacagaagatgctgctcatttctggttgcaactggtgaaccccaccccctctcttcagaggcacacaaagatttggtgtgctgggtagtgtcaggaggcatttctttatgaatatgatggagttgttcacctcttctctaggcggattatttgatccgtgcaagtttcttcatgctttgaaatccaggatggatggttgccaagttgggcggttgattggtagggaagagaatgacagggagctcatcttctacatgcttatggaactgcagatttgatggagaggatagcaacctagaatcatacacacacacacacacacacacacacatatatacccagacgcccagtggaatatgaagttgcaagcttttgtggcttgtaagtaccaagcatcaacaggaaccaaaccnc

SEQ ID NO: 11425 - DNA, 1501 bp, Oryza sativa
ggataattccgaccgaaactatctgaatccgaaaaatggtccggacggacggaacctatccgaaccaggttcatccctagctgcaacgcataatcaactgcttaagagacattgtctgacactagctagtacctgccgtgcataagtatacgcgcatatgctttatttcaataatgcttgctgagtactccctccgttttttcttcggggactatactttttatatggcgttattaaatttggtatttgtccatttgatatacaacgatgttgatatttagatatgatagtttgttatttgtcttattcaaataaaggattaagtccgatttacccctcaactaacgtgatacaaggatttaccccttgaactgtaatatcaaacatttgatgctcctaaaataattgattaagtttgtgaattatttttatttactgaagtaagtatataattaattatatattagtgaaagataaattcactacttcaattgtcaacccgttgtgcgatgattttgtcaaccccatgcaattatatcatagaggatttaactagaatattatgtgttagcttgtccttgattgctatctatcttatattcgaaggaagttatcgatctttttgtttgacctcgtcgttcaataaatatattggtttttaatagagatgttaatttgatccgttgtgcaaaatgcatggatgtgcaactagctagaggtaaaaaaaatatcagtgaaaaggaggaggaagaagaactacggtgacccatccggttattgctctgtacaagctagctactttttataaccatactctatacaatcttgtgtatggagctagctaaatactagataatttaaggccatttgtaggttgattgatccgccacgcaagctttgctacctaaccatttcaatgaaatagtaataattaaactcacatcttaactgcagagcacaaaaggtgtttgggagagacttagtttgacttgcattccctgactagctagctagctcgctcgctctggaaagcatgcttatgtccatcactacgctttttgtccagttaattgcccgttataagctcggattagaggaacgattccgaatagcacgtggtttagcgagccaaccaacgtcgcgggtcaaaccgcagagttgtacacacttgtgctgcaacaaacaaacgtacgcgcatattgcgcggtctcctgccaccaccttaccctttgccaacatgcatccgctccaagattaaaaaagcttgcgatccagaagctatctatcaaccgaacgctcccctgatctcatcttacctggaggctggagctcatcttcacctataaatactcgtgcacatcagcatcacttcatcacctcaaccatcgcaatccatcaagcaaatctcactagctagctagctatctcagctcactctctcagtagccactgatcagaagaagagcaagagaagccaattaagctagctagctaagctggt

SEQ ID NO: 11426 - DNA, 1501 bp, Oryza sativa
ataacaaaataacgttaaaagttttttttaagctcatgcagaacatctcattccatatgtatgtttactgaataagtacttctacggtggtctatactgatataattctacaaccggtattataattagtataaataatctaagtcattgatttatgagtttactaccaacagtaaaaaggtaatctacttctattacatgaggtggtagtttaaatagatataattcatttgataagaaaatatgagagttctagattaattctactatagtagggaccactgtcttaccatttccctaaattgcctatgatatgcctttgatggttgggcaaaccattttgttgttgtgactactgtgatgaactatatcatcccacacaaacatcattgatggttttctgaaagctagcctcatcattgtagcgcaacctttgagtgaggatataagagtaactatatggtggaaacactaacttagatgaaaaccggtgtaaactccaaacgaaaaatcatctaaattcactaaaagatgcctaaaggtagacaagaatatattacacgacaaatgtaaatatcttatccaaactcgctttcgtctgtgagatataaaaataaaaaaaatttgaaaaacgaagttaaatttggacatggattttttacatggttgtgtaacattaacttacctacatgtataatttattttgtgaatttagacgaaatttccattagggcttacacaaatgttcagcaaagttgagttttcactatatatttacccactgtatacctctgtcatgaaagcatgtgatttacaacaaaaggttattcaacacttttaaaatattttgattgcggtttcttttaaaaatttgaaaagaggagagatacagattgagacgcaaatcatatatttataaatttatcttaaaaaattatctgaaaataatatgttacaatgttcacggtccaataagaatttcttttttatgcatagaagtatacgcgtgtttatataagtgtttgcatatgtactatgttttaataataataataataataataataataataataatataaaatgttttcgtaagcttgaaagaaggcatttgggtgttatgcatgccggccggcccgtacgtacctgcacaatatattatgccaactactcacatcaagggtcaaagtggtgagttgtattcaaacaagcggtaatcccacgcgcattgttcgctcccctgcctgcctcccaacatgcgctccaaaaccttaaacaaattcgcactccagaagataaccagcgcgcgctgatctcgtcgtcttccttgcattggcgccgctcaactcatctccaactataaatacgcacacacaataacaccatctcacccatcggtcgagtctctcgcagctttaatctccttcaaagccaattcaattaatcagctcgatcatatcacattactgagagagggtgcaagctagctagcaacaagctg

SEQ ID NO: 11427 - DNA, 1501 bp, Oryza sativa
tagttttacctttgaactacccaatcgaattttcctagctcagctatatattgtggcctttgtggagaaaggtcaagcttcagagtttggacttaccaaatcagcaacgtacgtaccaaccgatttatagcttgttaattgcgttgaggaagccagtataatagtcactgacactttgacaacttcaattcaactcgatttcttttctattttctgatttttcaacgacaacgactccccctactttgcaatgatatatagcgtagttgattgaggggagttaaggtagactattcggcattgacttgtccttgatcggtagctagaatataattgggattagatatcggcgctttcacttatatgtatgtgcagatatttgatcaaaaccaaccccattgacaatgcatacgcaaaatgcagcatgctccaaaacttgtcatgtcaacgccgtcgactaagctagaagaaacttttatcaaggtatataaatgtgtatgacagcacacataatatcgagccgatccatattattggacagaaactgtccactagacctaaacaatcatggtaatgctttgtccatgctaattgctgtgcactagctgtgcgttggctttttttatgttaattattttcgtttgaaaaggctagttgcttgacttgctcgtacatatttttttcgtatataaatgtcaagttacattttacttagaaaataatttggattagatggaactagggttaaaccaagtttaagaaaattgtagagtaagcggtcggttgtatagtgcactaattaagtagctgtgagaatgagatcaactcagaatttcatggaaaatttttctacatcttgctaaatggcataggcccaaataccactctcttggatagttggattttctttcccattaactcgcactaagactcttccatataccactattcacacttttatcattccatgtggcatcacttttgcaatccaacccctccccccccaaaaaaaacaaaaattgatgtagaggatgaggcaaaaagaccaaaatatccttgagaccaattgtaattaaggtgcatggtggcgtctatgttgtttcctccctggcgatggcatcgttgccaccttctttgagccagtgcccagcagggaacaccaccgacttcaactacaatccctatttgacacacgccatcatggcttgaggcccacgtccacgggcgtaaatcattgatattattcagctaccactcaagcggaactcgctgactcgcgaaagtgtgaaatcattgtcatgattaatatttgtgatgagcaattggctttacaaaatgatttaatcaacgaattggtttgaaaagatgtgtggatgttggtgtgagtgcgtgtgactaatgtgggtcaggttgtaatatctgtgcccaggaacggttgttttgtctgattgtgtgcaggtgacttgaggtcagccttggtcaatggtgaggaccgggacta

SEQ ID NO: 11428 - DNA, 1501 bp, Oryza sativa
gcacaaaacaacactttcactttgcagaaaccatctttgtcggtccaccaaaaatagtcccgatggcaataaaaaccgggactaaaaatattcccggttcaaaaggttagagctacttttttatctttagtcccggtaactaaagattatttttagtcccggttaaaaaaacggcaggcggtgtcaaacccctcctttatctttagtcccggttggtaacatctatttatagtccgggttattaaacaaccgggaaaagagattggcatgcgcggagaggacgaggcgtgcgcgcaagatcaaggaggaggacacgcatggatcagttaataagttatatctccttctactcccttacctttatctcctcttcctctcctctcctcactcaccacatctcttcctcttcctcctctggatccgccccctcccctctcctccccacttctcaggcggcctcgggcggcggcggcctcgcgcggcggatccaggaggggaggcggccgggcggcggcagtggcctcgcgcggagggccccgcccgacggaggcaggcggtggagaccagtgcggctgcacatattttttttttcttttttccttctctgtgttgaatgtgtgattcgatctgtgttgagaatgaactatgttgttgtgaatgattttgagaatgaactatgttgttgtgaatgatttgggatgaactatgttgttgtgaatgatttcagacgatgggcgtgagctatataaaatagaaaaaaaaacttagtcccgattggtgttaccaaagatatcgatctttagtcccagattcgtagtcccggttagaaaatcaggactaaagagggttatcaaccaggagtacaaaccatttctacaccagtgtttataaattttcaaactttcaaaaccttcatatcaaacctatatttaaaatggtaaaatctgatatatcatctctcaaaaacgatcacgctcgcgttcgccaaaaaaaaacgatcacgctcacgaaaacaatcaacttggcaaattcaccttaacgaaatccttgtaaaaaaatattaataatgatgtcggtccaaccggagtgttttcgtaagcctgaaaggaagcatttgaatagtttccatgcatgtatcgcctacctgcccatttaatttgatcatttttgccaacgaacacatcacaggtcaaactgctgcgttgtagtacgctatctaacaaacagaaatccaacgcgcattccgcgttcgcctgcctcccaacatgcatgcattgctctccaaactaaacaaacttgcaatccagaagccaattaaccttctccatctataaatacgcgtacacaagaacaccacttcatcacctcctcacaaagctagctagctccattgttcgatctcatctcccttagctagctactcgatcttaacagtgagcttccattactgagaagctttgtgcattcttagctactaccatggctaggctggctgctctgc

SEQ ID NO: 11429 - DNA, 1501 bp, Oryza sativa
gaagctgtagtttttatgtgaaatcatcacccatttctccctttatgtttcatgttcttctctctctcctagtttcttcgtgtatgatagctttgttgtgacttttttattggtgtagttgtagaatccataaaataaactagtagtcagaagctgggaaactcagcttttttaaattcttaaaaactggttaccaaccaattacttttagaatcttaaattcttctaaacaggcccactgctatgttctagtgttttactgatcttcacctatatgagttgtgtcaaggtaacttggcggcttcagtgacagggccggcttccgtgctaatcaagtggttgcgtacccaggctcagtatatctgttgttgtagaacgaaaatacttgtaaaatgttgctggcgaagaaggaatactctttgttgttcaggcttgacgttgtcatttactcatccactacttgactcatggcgggagatttgaatagtgtaacattaatacaactgttgtactgtttgaatgatcagtaaccgaaaactttgacattgtgctaccgacaataaataagtgataaaacttaattatagtaaattcattgtattacatgagagatatgtagtggaaatttattcatcaaatttgagtacagttacaattatgaataggcggtttttatagacgatctaaggagatagttcgtgttgaatatatgtattctactagaataatggttggacataaaaccgtgataatgctattggatagagtccatgtgtaactcttgacctacgctggtattttagagcgcatgcatgttgtcagtgtgccaacaaaggatacatatgctttgactaaaaatgcatccataactgtgttcttcagtatggattggaaactaacccttcgtacacataaaatagagcgacagattgacacatggttaagtaacttcagataaaaagacctctagaaatgaattaatatgattgttttaaacaactttcctatataatttttgtttagggcatgtttagatcctctggcaaaatttttcaccatgtcacatcaaatgtttgaacacattcatagagtattaaatataaatgaaaaaaactaatcacacaaattgcgtataaattgcgagacgaatcttttaaacctaattgctacatgatttgacaatgtgttgttacagtaaacatttgctaatgtcggattaattaggattagtaaatttgtctcgtagtttacagacggaacctgtaatttgttttgttattagtctatatttaatacttcaaatgtgtatccgtatattcgatgtgacacgccaaaactttacacccatgcacctaaacacccccttagagcaagtttaatagtatagcccactactagctccaattcatctatagccaattcatacaatagttgcttactatactattaatacatggtcccacctgttatacacacattgcctcttggagtccgcggtgca

SEQ ID NO: 11430 - DNA, 1501 bp, Oryza sativa
gcaaatgtttactgtaacaacacattgtcaaatcatgtagcaattaggtttaaaagattcgtctcgcaatttatacgcaatttgtgtgattagtttttttcatttatatttaatactctatgaatgtgttcaaacatttgatgtgacatggtgaaaaattttgccagaggatctaaacatgccctaaacaaaaattatataggaaagttgtttaaaacaatcatattaattcatttctagaggtctttttatctgaagttacttaaccatgtgtcaatctgtcgctctattttatgtgtacgaagggttagtttccaatccatactgaagaacacagttatggatgcatttttagtcaaagcatatgtatcctttgttggcacactgacaacatgcatgcgctctaaaataccagcgtaggtcaagagttacacatggactctatccaatagcattatcacggttttatgtccaaccattattctagtagaatacatatattcaacacgaactatctccttagatcgtctataaaaaccgcctattcataattgtaactgtactcaaatttgatgaataaatttccactacatatctctcatgtaatacaatgaatttactataattaagttttatcacttatttattgtcggtagcacaatgtcaaagttttcggttactgatcattcaaacagtacaacagttgtattaatgttacactattcaaatctcccgccatgagtcaagtagtggatgagtaaatgacaacgtcaagcctgaacaacaaagagtattccttcttcgccagcaacattttacaagtattttcgttctacaacaacagatatactgagcctgggtacgcaaccacttgattagcacggaagccggccctgtcactgaagccgccaagttaccttgacacaactcatataggtgaagatcagtaaaacactagaacatagcagtgggcctgtttagaagaatttaagattctaaaagtaattggttggtaaccagtttttaagaatttaaaaaagctgagtttcccagcttctgactactagtttattttatggattctacaactacaccaataaaaaagtcacaacaaagctatcatacacgaagaaactaggagagagagaagaacatgaaacataaagggagaaatgggtgatgatttcacataaaaactacagcttctagaagttaaacggtttagtgagcatctaattatagaagaagctgcggtaactagaaactcccccggacagaccctgtgtctttgcgtagccgtgcccttatcgatttcttagtggggaagagttgatatgatccattcatcttccatcggacggcctacatcgactacagtacaggctcacctgtctccgactccgattccttctccgcggcggacagcgccggcgcaccaataaaaagaggccccacccggctggacgacgccttccggttttcccctcccccgcctgtctcc

SEQ ID NO: 11431 - DNA, 1501 bp, Oryza sativa
acgataatttttagcgtcagtactgactctgaggagtagcaaatctatctattatatctataaagtaatagaaaaagaagcttccacgttcgctctcacggcctagaaaatcccacgttaatcgaaagaaaaaaagaaaaatagaaggaggagtactttgcaaagaacacaaacttagaaacggacaaaaaaaattcgaatcggacaaaaaaatacttggaaacggacaaaaaataaaaacctaagagctgaaacggacaaaaaaaacttggaaacggacaaaaaaacaaagagtaaacggacaaaaataacttggaaacggacaagaaagatagaaaaaagtgaaaacggacaagaaaaatagaaattcccatgctaatcaagaaaaagagaaaaaaaataaccattgggtcatagtagattcagattataacagtttagatttaatatagggtgtctttagattccaaaaaatttggcgaaaaacatcacatcaaatgtttggacacatgtatggagcattaaatgtggacgaaaaaatcaattgcacagtttacatgtaaattgcgagatgaatcttttgagtctaattatgccatgatttgataatgtgatgctacagtaaacatttactaatgacggattaattaggcttaataaattcgcctcgtattttacaggcagattctgtagtttgttttgttattagactatgtttaatacttcaaatgtgtgtcagtatatccgatgtgacagggcaaaaattttcaccctggatctaaagatagcctaagaaaattagactccgtgtttgctgtcatggcctagaaattctcatattaatcggagtccatatagaaaaacaatttacatagataattaaaaaataataaatattagaagagaaggctaaagttcataatggtgtacaatttataattaattgaaatatgaaatcagataaaaagaataatagagtccatatataaatacaattttaaatagctgaaattcgaattaaaaaaaggaatattgaaagaaaaaactagaatccatattagtatacaatttagaactaactaaaatttgaaattaaaaaaagaaaatagaagtagacatatgagtctatatagaaatacaatttataactttaatttataaaaataaaaaataaaaaaatactgaaataagagtttacaatctatataaaaatacaatttagaaaaaaaaaagaaaatttggaatagaaaataaggaatattggtagctagctgcgcaatttgcgcgggccacaatactagttaattagtaagaggctaaaaattgacatgcactttgggcgattggattaggcttttgtgtccccctaaacttggtgaattgctcccgctgacaccgcgtcgtctcgtctcctcccatcctctccccgcctttgcgtcgcctttgccggtgtttgtggtcgatcggccggcgatggcggacaggccgccggcgatggccg

SEQ ID NO: 11432 - DNA, 1501 bp, Oryza sativa
gagaaataatattagcatataattaattaagtattataatataatttttttatgaataaatttgttggattttttaacaacttctttatagaaagttttcgcacgaaatataccggttagcagcttgaaaaacgtgctaacgaaaaacgaggagaatctaatcctgaaaagttaaaaccatcgcaccctaagtttagctttccatctattagattgaaacatacactattcactaaattattattaccgattatctatataactatatagataaattaaatattttaaaaaaaaaactccacaaagataacagtttttttaaaaaaagtagaatagtctccctcaattttttttaagaaaacttatttttaaagacagggtaaataatccgtgacaaatcgcaaatttgttccgcggcacaaggcgtcaaatcgatttttcctttccccgtcatcgtgccgaactgatgacccaagcaacctgatttctcgccgccgccgccgcgccgctgcgcgcgtggcggtcgggtcgtcgggaggggggtcgacgtcagtaggatgccgggcgccgggggactggagctggccggccggccggctggtgatggtggtggtagccgcccggcgaggcgcgtctgacatggctgggcaaggtgcgctacatccccaacagcaaggggcgcagcggtcgagggccggcaatggagcggccccgtggtggttgatccttctcgatcgcccacgccggaggtgagctcccggatgccctgcttggatgtacttgatgctgctcatgtctctctctttgttccaaatcatatatatacttgcccacttcagaaatcaaaagtgttcatcgctttacgcgctgagttccttaccatgtgaaattatcaaattgaacaagcaactctatggaatctaatccagtggccttgggatcaaaaccacatgaaaaatcagctgatctatatataggttatatatttcttccttcataagccaaaggtagcagaaacctgcacagctactgctggtattttgcaacgatagcagtgcttgcagaaaattatctacaagattactaaccttcaattttgcaattgttttgctatggaagtgaatttacaagggatttgcgtattcgattactttatgtgcaaataagaatttgaaataatttgtgtggttttcagaggagacctgcaatcataagtagcatcacaaagatacctcagaaaaaaaaatatgttgccccgaaagtgtagcgcgcaatgatagtataatatccatactaaatctatatacggagtattatgctaaaatggtaccaaccttgcaccagaacagtaattcacattgaatcatggcccgagctattttattttataaggatacatccactgtggggtacaatgtatagtgccgtaggtcagtagcaacctttggcatacagattccatttaagtttggtaacatgtaaatcatctaacttcatgcat

SEQ ID NO: 11433 - DNA, 1501 bp, Oryza sativa
gtaatgcagtgtccctttcagttcatcaagggacagaggatagcatacctgataccttcatttgctacttgatgttgattgtgccatgacgtcctactatctgcatggcgtcatgcatgacctcatcttctgtatctcctgtacgatttcaattgcatacatacaaactaaaaaaatgtctctactctgaaagtggccgcacaacccaaaaagaccaggtaaatgcatacgagaaatttgtaaagtaaataattctctgttccattatttttcttctagaaaaaaggcagcaggatctctgccccaatatttgagatagaaacagcatggattctaaactgagattaatacacaagtaggcactgtacggtgtacgattagaaaaaacagaatgcacaagagaacagagttcttccccagttctttaatgacataaaacacaaactatgaagctagaaggatgtgcaacaaggcaaaacctggttctggtgtttccatgtagttatcctcgatgtcactcttacagcttcatcttctgattgccatagcctcaaaggtcgtatctcctctttcacactatcgttaagaagtgatagaaaggaaattcagcatggtttctagaacaaaaggattagattcatgactacaaattaatacacaagtaggcactgtagcatgtacgataaaaaacagaatgcacaagaatagaaaacagagtccttctgggcaatatgccttttctctaaaaaaatatagtccttccccaatctgttagcgacaaaaggacacaaaatataaagctagaaggatacacaaaatattgtagaaatccgtcgtgtctcactctcacaattttaccttctttttttcataacctcaaaggttggatctctctatcacactattggtaagaacccctttcatgtagtttccctggtaaattgaactatgctgttgctctgacatgaagaagttaattttgaatgtgcttacaccgaagtctttttttttttcatttccactcagccaactactagaacaatgtagagagagagagagagagagagcaaaaaattagtttcgcaaggaccaccttcagggctagaaggctaggacagacacatgtaaggaccaacttttttcttatgtcatcttttgtataaatacaccataaaaactataaatggccgaggatatgcaaatactccccagttccttgaaaaaaccatatctctactactataaaagcattgccatcctcctccctccccatcacattgcgtgcacaaccagcaatcctcgagaaaaccagaaaaaaaaaatcaaatggttggttaaaaaaaacccagaaaaggcggttagttaaaaaaacaaccggttggatcctatctcagtcatgcagctcattctcatatgggcctgttacaatgcacgggcatggtactagtgactataaatattgcaccaccttcctttcctctcctctccataatccaccacc

SEQ ID NO: 11434 - DNA, 1501 bp, Oryza sativa
tgatgcttgaggcttgcattgcaacagatcagggaagggagcaacatcagctcagcttaagcatcgatgaaattatacatgagtgcaaaacattcttctttgctggtcatgaaaccacgtcacttcttcttacctggacagtgtttttgctcagtgtgtatccagaatggcaggcaagactccggttggaagctttgagggaatgtggaaaagaaaatccaaatggtgacaaccttagcaaactgaaagaggcaagaaaactagtacctatgttgccttttataatctattttgatatcttttttttcttgtgatatgtaactccatgtgtatcattctaataataatggttcatgtatggctaactacaacataacatatatatatatatatatattgcagatgtcaatggtattccttgagaccctaaggctctatggtcctgctcttttccttcaaagaaaacctctaacagatattacagtaggagaaacaaaaatacccaaagaccatgcaattatcataccttcagcaattatgcaccgggacaaggagatttggggtgacgatacagatgaattcaatccattaagatttcagaacggggtcacaagagcagccaaagttccacatgccctactggcattctcaatagggccaaggtcttgcatcggtcagaattttgcgatgttggaagccaagtcagttatggctatgatcctaaaaaagttctcattcacactttcccctaactatgttcatgcacctgtagacctgttaactcttcagcctaagtttggtcttcctgttgttctaaggctactggatgcatgaagttagatgatttacatgttaccaaacttaaatggaatctgtatgccaaaggttgctactgacctacggcactatacattgtaccccacagtggatgtatccttataaaataaaatagctcgggccatgattcaatgtgaattactgttctggtgcaaggttggtaccattttagcataatactccgtatatagatttagtatggatattatactatcattgcgcgctacactttcggggcaacatatttttttttctgaggtatctttgtgatgctacttatgattgcaggtctcctctgaaaaccacacaaattatttcaaattcttatttgcacataaagtaatcgaatacgcaaatcccttgtaaattcacttccatagcaaaacaattgcaaaattgaaggttagtaatcttgtagataattttctgcaagcactgctatcgttgcaaaataccagcagtagctgtgcaggtttctgctacctttggcttatgaaggaagaaatatataacctatatatagatcagctgatttttcatgtggttttgatcccaaggccactggattagattccatagagttgcttgttcaatttgataatttcacatggtaaggaactcagcgcgtaaagcgatgaacacttttgatttctgaagtgggcaa

SEQ ID NO: 11435 - DNA, 1501 bp, Oryza sativa
caccggttttcaaagatgggggatgtgttatacccgattttgcggttggaggaggcgattcgatcaaggataaaagatgagggatgcgaaatagacttattcctctcaagaaacaagggcattttgactccaagggtcatatccatagtgtgatttatggatgggtgaatcgtggatgcaaagttctatgagtaaataaacatgagttatgtttgtccacaaacttaaaaaaaatacatattataccccccataaactagttaaatgtattagcatcaatccaatatttgatgtggcatgtcatagagatgctcacatgatacctttgctaacatgttagggcatgactatagtattgattttgtatagtcggacagtaaaggatgctcatcaagatataataaggaagtaggagacaatggtttatacagatataaggattgatcagtacaaggatgctcgcgaaggtgagctatgaagtaggaggtaatggtttttatacaaatcgagcctcctaatgggtaatagcaatctatcgtgtttatatgtattgatctactataaatactcaatagtataaggtgaagaccctaatctagtatagtctaagtcaacgggactcctagcaatgactcttagcaatgtggaaatgactcggtatttctcctagtgtcaacttgggatgacttatctgtttcatcattcgaaagattttcccctctctttctaggaggtgatgtcttacatactctctaggtgtcactttatccaagtagaactcaagagacgtgttatgttagaaaatgccttctagttgattgtattagcattttagcaaaacatggtatgtgcaagagcatgcggcagagttatgtggaaatgtggtgagttaaaaaaaataaataataacaaacaatttccaaaaaaaatggtgagagagaaaaggggttggatatgttggagctaccaggctgtgtggttgtgcctggatcaaaaggtggagtttgtcactggagccccgtaacccaaccaagtttacaaaaacttgaacaaaaatttcaaacttttaaatatttccactacctaccacagttgtcggtgacatgagaccgggagtatcatgactagaggcttgggcagccgcggtcacccacgtggcctgacccccttggggggggtcgggcccgagggtgacgtggccaccccttcctccgtctccccgaggggtcgggccgctcccgtttcgaccccgagggctggggcgccccgaccctctgtggttctggcgccacgtgtatgggttaggtgaacacagcggggctcacctaaccgcatttattacagtttggacgagcgcgccacgccgcatttaatgcagcgcagcgcgctcgcttatccggtccgtgaccggtcgcagtgtgtgaccggtcacagaccggtcagatcgcgggttaggtggcaacaggcggcctgtcacacgcctcgccccgtcccgtcggaa

SEQ ID NO: 11436 - DNA, 795 bp, Oryza sativa
tatatgtgtcgatgtggttacccacatagaagacgccagtgctatttgtgatcttccatttcactctttcctatatatagatgcagtcgtccgtcatagttacgctagaagccattgttgctactatgtaaccttaccattctttcttgcatatgtgcacgtatctcccccacccccatcatataccatagatctgtagttaccatgggctaccagagtcactttttaagtctatgatcgttaatattgttgtagaggcttcaatagagagaaagaacacttgtagatgaaagttctcaggtattctcaagaaaacaatctctatactttcttgctcgaggtaaaaggtatttactttcaacgcggatttgataggttcgatgatgataagcataacaaaggaaatggtctttgcagaggcctcatcaaggggaggggcatctatccttcttatcaaaatcgttagatatggtaagcaaatcctcaattaatttcctcttttttcttttggtagaaaaaaattccaattgtctcaacatgatttatataggttggatatgctacaatgctgatttactgttgttttttgccttttttgttgtctttgctattcttcttttatgagctatatataaatctatggtaaatctaatctaaatcttatcattgaatagaaatacctataatgtttacgttggctacgcaacttcgagcattcaaacattcccaattaccatcgcctccctaaacagcaatggtaattggggatgttcggttgctcgaggttgcgcagca

SEQ ID NO: 11437 - DNA, 1044 bp, Oryza sativa
aacccggggaactggatggactcgaggaaagcgctggccctcttgtggaggcggagtacccggatgccctccatgtagtgctccgggttgtcgagcgacgccagcgcgtcgaatcctagctgcccgtcgaggtcgtcggcgctgcaaaatctccacccaacaattacaaacaccgagcgggcggcgccggcgagaggggggagggggaggcgcgcgcacgcacccggtggggtcgacgacggtggcgaggaagttggagatgacggcggggaggagatccggctgcgggttggcgatgtcctccgcgcggaggttggcggtgggggcgaggccgtaggtgtgcagcgcctccgcgatctgctccggcgtcaacggagggaaggagaagttggacgccatcttcttcttcgccgccgccgctctctcgccgccgacgcctttcccccaaatgagaggaatttcgaaggcaaaaaaaaaaaaaagaagaaatgggaggtatttgcccggtttcccgcttcgttttcccgctttgcggaagcggaaaactcgggagcagatgcggcgcttggggagagttctgggcccaaagcccatactcgtgtctaatcttctcgataaaattcggcccagcccaagatgaggcagccagtttccactttccagcccgtgggcatcgcgtcgattggaccagcccaccgaagcaaaattttaggaaattttctggaattttcaggtaaggatgttcgaatctgtccattttagcctgtccacagtgctttgcttctttccacctgtcctgatataattaaaggctagaacattgactaaatggacaagcatgatgggtcctttttggaacaaaaatttccaagaacactttgtattataccccacctattataaagtgactttgtattatatccacctattacaaagtggagttgtcatgtcaacaagcccctgattcattttttgtacagaattacttaaatatattggtcacgtcataacaaagtaacaacagaaacatggaatttatgcaga

SEQ ID NO: 11438 - DNA, 1501 bp, Oryza sativa
gcaagtgaaactacatagggttgatggattgatgaggtgggcttttacggtccagcaaatgatgtctctaggtactggtactatgaggtaccaaacaaaatctaatcgtcgattatgtaagggtacgataggaaaaagaaggaaatggacttgtgacctgccaaatgtcctcacgtgcaaatcgtgatcccatcaaaggcccactatacttacatgccttcatgcgcgacagtttgtatttattgttaaaggcggctagcgatccaacgggggatgcgctgacgcccatgaccctgactgtggttgcggtggagccgatgccctcccttcccccaccaccccccccccctaaaaaaaaaaaatcttgcatcacctgatcatcacctctaggctttagccttttgtttgattttggatgagaggaagattgaagtccggaatcacatcaccatggagagagagagcacgaagaactccttatatcgcgctctcgaggatgataacgggagcacaggcagtagggaaaaataatgtggcaagacggcagaaaaaaataagtggcatgcgagaatcaaactcacaaccaacgcaagaaggatgagccagcctagccatgtgaaaacccaattttgcccttcaactctttcaatgcatgcggatgaaggggaggtaccacagaggagatttctgtacctagcagtaccaagtattgacagccgttggatctatctatatggatggttctgattgcaggtaccaaaaggtaagaagaaatttggatggacggtaaaaaagctctttcttttgtcaccaagatcgaccgacagcatgcgagctctatagtgtgctgcaaggaatctcttcatcggtggtagttttattgttctccccattcgttctctttcctgaattatcttcgtttggaataggaatacaatgatctgaaatattttaaagcctgccgagtcaaactactgttacgtactactctaactcttggtgctacatcacttgtgcacatttccttctagaaaaaatagaatgaattgacataagggtcaggatcgactgtatatcaaattactgcattgtttggaacgctatcgatagcagccagtacagtcagagtatatatatatacatcagcatcacttggcctgttcaatgccaaagctagaacgttgttggcctcttcttgcctgcatcgtcatctcaaaagaatatttacatatggtcaaaaatttttatatcaaaattacttcatgtaagttcaactgtaactatcacatcttccaattcggtcataaggcaggctgctgcatggaaagattcttcacttggacacgatcaatgccagcattttaattacaacgtttgttgctggcctatcgatgcctcaccctctataagtagccgttcagagcagcacagtttcagtcagcaagaagagaaattgtgaagaacacttaaggagagacaactaattaatatatcaagatgg

SEQ ID NO: 11439 - DNA, 1501 bp, Oryza sativa
cgatgatgcaagctgaaccagtgataaatagctggccatatttgaatgttttctgggagaatagtatacacgtaccaatcatcaatcaatctcatggtatgtttgtccttgtgactgtgagctactactacatgtttcacgtacgtgagaattttcccttgtaattacttatgtatttgaagaagaaataaaaagaaaataagggacagcctatttattagttaggacactggtatcaaatcaatcagcagaaattaaaaacaagaccacttgaattaatggaatcaatcgtacgtggaaggggtacgttgtacactgtatacacatggcccctcctaccaaccgatcgagacataccttgtttatcgtgagtatatatgtttattcaactaataaacgatacattttttaaatacgtacttttctttataaaaattgtcttaaaagatcaaataatttttttttagtttttcatacttaatacaaaactaattttgtgctaatgactcgtcttgtttcagttgtcgccgaaaagctaagctaaagaagcagtttcatactaagccagacttggttcttatttgataaaagagcaatggtacttctcaaggaaattcatacttctagatatttttttttaaaaaagaaacccctcctactttcagtatttgcctatagaataattaaacacatacatgaatcatatttagtgcggtggtggagtcgtggtcttatgagcgcatgacttcatctatcagatttaaatcttggtttctgtagttaccacatgtaaatgtatgcttttaataaaatgttggttagctaggtaacggtagtctaatagattaagaccctgtttagatgggattaaaacttttaagtccctatcacatcggatgtttggacactaattataaatattaaacatagactattaataaaacccatctataatcttgaactaattcgcgagacaaatctattgagcctaattaatccatgattagcctatgtgatgctacagtaaacattctctaattatggattaattaggcttaaaaaatttgtttcgcaaattagctttcatctatgtaattagttttgtaagtaatctatatttaatactctaaattagtgtctaaatatagagactaaagttaagtccctggatccaaattaacaccacctaactgtttgctaccatctctcgagcttatttaaggggtgtgtactcgtaggtatctgcttgagtcatgacatatgtgtgtgtatgtatctctaagcagtcagggaaaaaaaatacacatgtggatcacgcaagcatgagtacatcattctgacttggcaacatgaaatcatgctgatgcttgctcagctagcctgcctgtgcaactgtctataaataccatgcgagatgcagcaaatagtagacactcaccagatagttgcagaacaataataaaattaggttggcaacaattaataggaaagagctttttgt

SEQ ID NO: 11440 - DNA, 1501 bp, Oryza sativa
ttgctatattatggggcggaggaaataccactcagtgtcatatgtttccccttgtggctgtgagcttttacgtgtttcacgtgagaatgtgcccttgtatttgaagaagaaataaaaagaaaatgaggaaataatcctatttagttaggacatattgtatcaaatcaattaagcagaaattaaacagacgacccactaatgcgtggaatcaatcgtacgtggtagtgttagttactaactgatcgagttaaggctgtctaaactgcttcgcaaattgcaatgactactaccttgtttatgacaagcatattttcctatctactacgatattattttattttaaaatactttctatatgaaagttatcttaaaaagtcaaataaatttatttttttcagttttcaatacttaattaagactcaactagctataagcaactggctcgttttgcttcggttgccgctgataagctaagccaaagaagcagtttttcatatatactaagccaggctcggtcgttcttatttgacaaaagaacaattaatggtacttcccaagaaaatttgcacttctagacatttacttggaaaataagaaaccctcccaacttccttacatacgcatgcatgatttcatctattagatgttttttttagggaattcatctattagatgtgtgttcggaggagagggttaggaacttttctcctgtgcacgtaaaaaaggggtggctcagagctaactagctaattaagtattcgctaaaaaaaactttaaaaaataattaatatgatattttcaaaacaacttttgtataggtttttttttttaaaaaaaaccctcaccatttagcagtttgggaaacacgcgtgcgaagaattaaatgagggactagaagttgaaaatgtgtagttgagaacacactataaaagattaagggtgtgtttggttgtcagccattctttacccctaacaaagattaattaggtcaagtcgaggcatccacaaaagtgtggtggacaaattgctagcaataaagtgtggaaaagttagcaagaaaattgagtatatgatgtgtgggacatgtgattaaaagaaaatgtggcaaggtataattgtcagagtgaaccaaacacatggctaacaaattgtgacggttaaatgtgtggtgtgataaagtgtggttatgaaccgaacacctggcctatccgttggccaccatctcaccgagttttaggggtctgtactctcgctggtatctgcttgcatcatgacatactctaggcaatcatggaaggatgacacacacgtggatcatgcaagcatatgcttacatcattttgacgtgtgccaacatgaagtcatgctgatgcatgcttgctcagcctgtgcaaaaccgtctataaataccacgcgaggcagcagacgtagccactcaccagctagtcgcagagaaatataattaggttacattggcaacaatagaagagagaattttaat

SEQ ID NO: 11441 - DNA, 1501 bp, Oryza sativa
gtatcaaatccttcttgtggttttggaacagggaaagtaaaaaaaaaaggaatgttcctatgtgctaagggtttaattataggccagtagaaaatgcatgtccttgcatctatctgcaaaattattggtttgtttatttgaaaatcctaattaattcttatcatcaataaggccttaaaattaccagatgacacatcatagccgttcttccgtagaaggtaaaatcgaagagaaactaggtgtaaatctttatcgttgtagtcggtgttgtaaacagtgcagagaagctcatctatctcggccttgtagtaactatccaatccaagtcgttgcagcgtgatcacaagatccaatatctctggtacttcatttgagccctttactacctttctaacttcttcttttagcacttcagccctttctttcatgtaagcatgctgcaaattaaggaatacacgtctgtcaacgatgcaacagagaattctccgtgtataaatataaatatcagtaatgttaccgacagatggcacagatacacaattaatctccaatatatacactcatccgctaataatttactatggtaatataattagtaaaaacgcagtgtaaatgtaatactaatgctgaagtgtttcaaaatattattctatcttatttcttatgcccaatataaaaatatccatgaacactggagaaattagtttattattagagtttataacgttcagctatcacatagtgtaaaatgtctcacttattaatttcctatctacacagagccagagaatatatataattaaacaagtataattaccttaggtgcagtaggtggctggtaactgatgaagaaatcgccccagaggctggggtggaagccggtaggagcctttcgctcatcgtcttcattggagaaattagctgcaggtgtcgatgacatcttctgatctcttaacaaaaagctctttcctattaattgttgccaacctaattttattattgttctgcaactatctggtgagtgtctactatttgctgcatctcgcatggtatttatagacagttgcacaggcaggctagctgagcaagcatcagcatgatttcatgttgccaagtcagaatgatgtactcatgcttgcgtgatccacatgtgtattttttttccctgactgcttagagatacatacacacacatatgtcatgactcaagcagatacctacgagtacacaccccttaaataagctcgagagatggtagcaaacagttaggtggtgttaatttggatccagggacttaactttagtctctatatttagacactaatttagagtattaaatatagattacttacaaaactaattacatagatgaaagctaatttgcgaaacaaattttttaagcctaattaatccataattagagaatgtttactgtagcatcacataggctaatcatggattaattaggctcaatagatttgtctcgcgaattagttcaaga

SEQ ID NO: 11442 - DNA, 1501 bp, Oryza sativa
aactaggtgtaaatctttatcgttgtagtcggtgttgtaaacaatgcagagaaggtcgtttatctcagtctcgtagtaactatccaatccaagccgttgcagcgtgatcacaagatccaatatctctggtacttcactcgagccctttactaccttcctaacttcttctttcacaacttgaacccgttctttcatgtaagcatgctgtaaattaaggaagacacatgtttcaaccattcaaaagcataccatgtatacatataataaataatcagttacctatagaaggcacaaatacacaattaatctccaatatgcactcatgcatccactaatagttttcgatggtaattaataatatagttagtacaaaacatggtataaatgtaatactaatgtgaacatatatatttctcaagataaagtctacattattcgttatgtccaacaaaaaaaattccacgaaaactaagggaccgttagttatttagttatagtttatttataaagttgaactaccacatagtgtagaaatgtcacttactaatttcctatcaactgagaatcagatagtatatatatatatactactccttccatattttaatgtatgatgccgttgactttttaatcaacgtttgactattcatcttattcaaaaaatttatgtaattatcatttattttattgtggcttaatttattatcaaatattctttaagtataacataaatatttttatatttgcacaaaaaatttgaataagatgaatggtcaaacgttgtttgaaaagtcaaaggtgtcatacattaaaatacggagagagtatataataagaaagtaattgccttaggcgcagtaggtggctggtaactgaggaagaaattgccccagaggggtggaagcttgtaggagcccttcgctgtggctgctcatcgccttcattggagaaagctgcaggtggcgacgacatctcttagcaaattaaaattctctcttctattgttgccaatgtaacctaattatatttctctgcgactagctggtgagtggctacgtctgctgcctcgcgtggtatttatagacggttttgcacaggctgagcaagcatgcatcagcatgacttcatgttggcacacgtcaaaatgatgtaagcatatgcttgcatgatccacgtgtgtgtcatccttccatgattgcctagagtatgtcatgatgcaagcagataccagcgagagtacagacccctaaaactcggtgagatggtggccaacggataggccaggtgttcggttcataaccacactttatcacaccacacatttaaccgtcacaatttgttagccatgtgtttggttcactctgacaattataccttgccacattttcttttaatcacatgtcccacacatcatatactcaattttcttgctaacttttccacactttattgctagcaatttgtccaccacacttttgtggatgcctcgacttgacctaat

SEQ ID NO: 11443 - DNA, 1501 bp, Oryza sativa
aaaaagattcagtttgttgaaatgtctcaattcgagtggcccattctgaaaccagttccatattggcttggactagttcagcatgtcaaatctcgacagttgtcacctcataactgaattctgaaatggaatttagaaccatggagtaaagaaacagaacaattacgccactgttaaattcacatggaatctattatattattaaaacagctttgaaaaaagacaccatgatcgctgtgggggctagaaattcccacattaatcagagaaaaagaaaaaaaagaaaaaagagagtccaagtagaagtctaatttaaaaatagctgaaattcgaaattaaaaataagcaatattgaaagaagtttccatataagagcccaatacgagattaatcaaaattcgaaataaaaataaaataaaatccaaaattagaaaaggaaaggagagtccaagtagaaaaataatttaaaaatagctaaaattcggaattagaaataagcaatattgaaagaagttttcatataagaacccaatacgagattaatcaaaattcgaaataaaaataaaataaaatctaaaattagaaaaggaaaggagagtccaagtataaatacaatttaaaaatagctaaaattcggaattaaaaataaggaatattaaaagaagaatccaagtaagaacccaatacgagattaattaaaattctgaaaaaaaataaaataatatccaaaattagaaaaattaaaagaaagttcaagtatgaatacaattttgaaacaattgaaattgaaaatgaaaaaataaaaacattaaaagaacacaatatggtagtaactaaattttttttaaaaataaattctgaaattagaaaaaggaaaataagatttcaattaggaataaaatttataaataactaaaatttgtgataaaaataaagattattgaaagaaaaaacaatctaaagcacatgacgacatgacgagataaattaagtaatatgcctataaaggagtagagtggtgacagttgatacgatatataaaaattattaataaaataccaaatagaatcctaacgacgattaaaaggaaggacgtcaggcaggccataaagcaaacaagtagggcggttgccgggacttctagaaagtaaaaaaaaaaaaccattgataatcatattcgatttttaaaatctcaatgacaataaaaaggagaagcagggggcagggtgtataagagtatagctgcagagccaccgacggttgacgggacttctagaaaataaaaaatgaattccaacaatagttatgtttgatttttagaatcataatgataataaagagtagccgccggacgggctgtaaaagggcatagtggcatcgtttgatggaacttctaaaaattataaaaaaaatgaacctccacgtcgaatttttaaaggtttggaacttccaaaaagtaaaaaaaaaccaatgataatcatgttcgattttaaaatcacaa

SEQ ID NO: 11444 - DNA, 1501 bp, Oryza sativa
accaaacatgctttgtgtaatggcatagcctaatcaccattgccgagaaactataaatacgttcccgtcaccactgcatagaggctactagcgtaaggtaccataaaatgaccctaattcaaggggcttcagttaacagtggagattgtctgcagtactgcacctgcagtagtagccgctgacatatgggatcgggtccacctgtcagccactgctaatacaaatgcagtactgcagaggatccatgtccttaagttatggtggaggtgagaagggttcgtctagtgttgcctcgagatacctgatccaaaaattatcagaggtgatgtattccaaatataatccaacatatctgcatattgtacttgactttaaaaaataaagaggaaaaagtggcaagtgacacacttccatcaattaatgatggctaacatgagttgctcacattgtgtcaactgtgtgtgcatgcattgaaatttcttcactttatttgtagtgatgcagtgcgagcatttgtagatggagcagggtgaacattttgatatataataatctgacaagttatatgaagttaactgtagtatggtttacattacccttttcaaggtgaaaaccagtcctgtcgctttgccaaaaactgaaaacttttggtcaattctactatatgaaaaaccagctaaaaccgcttagttttccacaaacttgtccccaacggcttcatcaaaaccgataagttgccatcactagaaatgttcttttaaaaaaaaacttggatcattcatattattgcatacgtacacatgtagtttatgccattttcatatgttatcatagttttaatactttaaacttacaattgtatatatactataaatatagcgctacattaaacataaagatattggcagaggttatgagcacaacaccgttgaatttttcattccgacgatcaattgtaggaccaaagttagttgagtggaatgatttgatttttcgactagctaacataaccctgttaaatgacaaaaaaaaattgctttatttggtcgctacataaaaatggccaatttttggtcaaatccatgtataatgcgatcatcaattccaatgtaaagatccacaagaggatcttatgagaggtaaaggtaccacaaaaaatcaaagtatttatgtgtttcttaaaaaaaagtaatcataacgaaagataacctcgtaaagagaaaatggaggggaaacaagcaatattatttttgtaatatacaagagaccatccaacacttttttttctttgactgtcatgttgcacgttttgtttggcgatgtatcttctttgccttcaatatcccccttccccacaatgcaaaagatatttttggtaactgcctaagggagtgcctagaccccaaaaaaatgattttatttggagctagtgctatatgttggtcaatctggcgttgctgtaatgatatagtttttaaccataataaaatgcctaacatca

SEQ ID NO: 11445 - DNA, 1501 bp, Oryza sativa
gtgttgtgctcataacctctgccaatatctttatgtttaatgtagcgctatatttatagtatatatacaattgtaagtttaaagtattaaaactatgataacatatgaaaatggcataaactacatgtgtacgtatgcaataatatgaatgatccaagtttttttttaaaagaacatttctagtgatggcaacttatcggttttgatgaagccgttggggacaagtttgtggaaaactaagcggttttagctggtttttcatatagtagaattgaccaaaagttttcagtttttggcaaagcgacaggactggttttcaccttgaaaagggtaatgtaaaccatactacagttaacttcatataacttgtcagattattatatatcaaaatgttcaccctgctccatctacaaatgctcgcactgcatcactacaaataaagtgaagaaatttcaatgcatgcacacacagttgacacaatgtgagcaactcatgttagccatcattaattgatggaagtgtgtcacttgccactttttcctctttattttttaaagtcaagtacaatatgcagatatgttggattatatttggaatacatcacctctgataatttttggatcaggtatctcgaggcaacactagacgaacccttctcacctccaccataacttaaggacatggatcctctgcagtactgcatttgtattagcagtggctgacaggtggacccgatcccatatgtcagcggctactactgcaggtgcagtactgcagacaatctccactgttaactgaagccccttgaattagggtcattttatggtaccttacgctagtagcctctatgcagtggtgacgggaacgtatttatagtttctcggcaatggtgattaggctatgccattacacaaagcatgtttggtaaatacgtacaaagaggatgtataacatatgtagaacataaatgttgcattttgggacctgaaaacataaattacacattggacctgcaagcctagttacactagatgagacgcaatacaaacatatacatgagttcatgtcactatattatcatataggtaatcgcactttgtcttgtagaggtgaaacggtagctctgctgctatatgtattagccttttcagctttaattatgttatgacccattgacgacgagagtactgaatttaatctcagtgggctggttgtggaggctgacacaaagagatctagatcatccctcgttttccaaatgctagctagctaggaaaataagagctcatttgtgtgatgtgtctacagaaacttgtgtttcctctttctggttttactattaggatgttacatgcctatgctttagctataactatatatcctaacctataacgctatctgctatcaaagaccacagttttagtggtgcgataagtatttatcctaatggcctcgcaactgaaaccggtacatttgtgcagacggtctataacccgttttc

SEQ ID NO: 11446 - DNA, 1501 bp, Oryza sativa
tcaccgacagatcaaatctcctacttgggcatatatatatggggcaattgcgttttggaccctattttgaggactaactgctaatttagccttgcttttttgagtttgatcatttggccctcttttttacaaacgaagatgagacttggccctatttcgtgaagtcaacgtgacggtgttaactcaaaacaaaaattccatttatacccttgtgacacagatttatgtctaccaaaaacaaaaaaaaaaagaacatgtcgacacctcaccactgacgacgaactcccaagcccattcgtgtggagcagccgccaccgccggtgctccctctctccctgcagaaccgccgcctccccaccgaagtccactaccgccgcgccgccttcgctgacccaccgaagcgcgcgtctcggtgccgctagatccaccgtgcacgtgcctcggcgcgaccggatccgtcacctcatcgccgaacctccgccggatccaccctgtcggcgtcgcccctcctcatcgtcgagccgccaccgccactcctccgcctcgtcgagccgccgccgaccctcctccttgtcaagccaccaccgctcctcctcttcgtcgagccgccaccatccctcccatgccaccgccgccgcagccactcctccgccttgtcgagccgccgccgaccgtcctcttcatctagccaccaccgcgcggcagctgttgcacaaggagggcggcgggaggaagttcctcttaggccgccgccgtcgctccctccctccacaagccggcgtcgctgctccctccctcagcgagccagcaccgcgcggatccctccctccccgcctcgcggccgccgctcacggccgctccctccctccacccgtcgctgccgccgccgcaagcactcggcgagagagagagacgggatacgagggagagaagggaatatatatggatagggtttggtcgagggtattttagtcattatgaaaagtaattatatttttttcttttttgaatgaaaacttaacagtgctaaaaaaaacagagccaaacggagcgttcgtgttaaaaaagtagggtcaaataaacaaactagaaaaagtagggtcatattggtagttaggcttcaaaatagggtcaaataagcaattgtccctatatatagatccacaagtcttgagcaaaaggacaagcaaaaatgatcatgctgaagagtttcatagcttgcagtacatgagaacacagcttagtcaggtcactcaaaattatgtcttcttcttaacaaaaatttctactgttcaatctatcttccaacaataactagaaaaaaaatggtgtcttggttgaacacagctctgccatagcctgctgtatgggtctcagatgttaattgaaccagtgaacctcgccccagggccggtcctgaactttcgcgggcctagggtgagataaaatcggatggcctatatacctaaatgagtttctttattgcacttccaaaagtaat

SEQ ID NO: 11447 - DNA, 460 bp, Oryza sativa
  unsure (1)..(460): unsure at all n locations
cgcgattgtacgttnnnnnnnnnnnnnnnnnnnnnnnnnnnnnnnnnnnnnnnnnnnnnnnnnnnnnnnnnnnnnnnnnnnntgaatctttatctttatctttatatactactttaaaaatccgtagtggtgatgttaaagccagcgtaaacataaccgcgcctccccctctcacgcgcccacaccgacgcatcgctccgctgcccctcccgccacaagccgcccacaccgccgcccatccacgatccttaatcaccgtatggttccgccccgatccaagcccccaccaacgctgctgcactacggtgctcactgatgacgacctcctccacctcagcttccccaccaccctcgtctccaggcgctggctccgtcactcctccaacctggctttcctctgctgtttccgcgcccgcaacccaccccgcctcctcggcttctaccacacggcacgccagga

SEQ ID NO: 11448 - DNA, 1501 bp, Oryza sativa
gggaaaaaggtttagttactacataaataacgaaatagcgattataccctttcgtattttcttttttcaataataccctccatatttctactactttccttttccaataatacccatgttattgctaattgggttagtataagagatagtacaaatgatctaatcagacgaaatcgacagttcattttgcttaatttctactaccagaaaagagtagtagagagcacagtgataggctccaaattaatcttataatcaagaaacacttacacatgggagttccaatcaaaaaggatgactcgaagcatggcgtaccgtagaatattacgaaattcacatgaaaattccaaaacaaagtcacacacttcactaaaaacctgtgtacacacacaccatacaaagcttgcaatggcatcacaagctataggtacaacccaacacgtgcgaacgcccaaacagtagtactattctcttcgaggacgctatacactgcagtgcacgtcatttattccgcagattaaaacgatagatactactacacacatgacgacgtgttgccccggctgtcaattatataagcttattaatttagtgctggccgggcagcttctccttgatcttgtccatgaatcccttcttctcgccggcgttgccgtactccgcaccgtgcacgccggtgccggcgccggtcatcccggcgtggccctgctgcccgtacgcgccgccagtgttccccatcatctgctgctgctggtggttgttgcccttgttgccgccgggcagcttctccttgatcttctccttgattcccttcttcctcctccctcccatcccgtcgtcctcagacgactgcacaaacgcacacgagtacaactcaaattaaataaaggaattcagaagcgaggcgattaattagatttatgaatggacgacagtgaacgtaccgagctggagcttgagctgccggagcggtggaggatgccgccggtcttgtggtcctccctcgccggctggaactggccgccggcgccggcgccggcatgacctcccatccccatcgctccgtggcctccgccgggcgcggtggcgccgccgccgtactggccggcgccgaccgggttgccgtacacgtcgacgcggtcggcgccgtagccgtgctgcccctggtagttgtccatcctctcaagcaaattaaaagctaataactctccgcttaattagctctggctagatccctgaactcgtgtacccaagtgttccagctagtgttgttgctatcagtaagatgacttgtgtcaaagccgtcgatcgatgcagcaaagcagctggccggggtgccctgccatttataccgcggcgagactgtgggttgtgtacgtgtgatctctctactggagttaaaaaaaaatggaagcttaatttggtcatcaggaaggaggccgtggaagatgggggtacgtgtgacgcatgggtgagccgggaggcggagctggcaatatcg

SEQ ID NO: 11449 - DNA, 1501 bp, Oryza sativa
caaataacacaagcacaaagtcacacttcaataaaaccttagtgtgtacacacaccatattacatttcaagggtaaaaccgacacggacgcgagaacacaacagacaatgtgtcatccgtcccaaggcagaagacaccatcactcgcatttcacgctagtttattcaacaacatataaaactgcacgtacatcacgacatatttggtgacgacccggtcgagcttatttagtgctggccgggaagcttttccttgatcttgtccatgaagcccttcttctcgccggtgttgccgtactccgcaccgtgcacgccggtgccggtgccggcgccggtcatcccggcgtgcccctgctgcccgtacgcgccgccggtgttccccatcatctgctgctgctgctggttgttgcccttgttgccgccggggagcttctccttgatcttctccttgattcccttcttcctcctccctcccatcccgtcgtcctcagacgactgcacaaacgcacacgagtacaactcaaattaaataaaggaattcagaagcgaggcgattaattagatttatgaatggacgacagtgaacgtaccgagctggagcttgagctgccggagcggtggaggatgccgccggtcttgtgctcctccttcaccggctggaactgcccgccggcgccggcgtgatgccctcccattcccatcacgccatggcctccgccgggagcggtggcgccgccgccgtactggccggcgaccgggttgccgtacacgtcgacgcggtcggcgccgtagccgtgctgcccctggtagttctccatcttctcaaacacgcgtctgatctctcacccaagtgttgctattctatcagtgaaaaatcttgtgtcttgtgatcgatgcaggggaacagaagggtagcgtacgtgccatttatactgatcttggaggttggagaagtacataaaaaaaccgaagtgtaggtcaggaagggtacggaagaggggggtacgtgtacgtgcatggggtgagccaggaggcggagctggtgcgtagaagggaataaaggcggagcaaggacgtgtgcgtgtagcgcgccgggtcggtgacgccatgcggccaccggccgccacgtatgtgtttacctcgggctctatctagaattagaaaacggcacatgctcccacagttcaccttttgtaacccttattttggcttaaaatatattgtcaccggtatgaaatcaataattacggggaatataaagttatgtctataactcttataaatttctatttgtaaattatatttggatgtgtactgatccatggttaaaatcttcaaattttaaccttatcaaaatcaaaagaacatcttataaagcgtttatattctgcccctacctaacccaccatggtaacaaatctgtatttaattagtttcttacatacggtactcccaaatcgattacattacttcgactctctagaacagtgatcataataata

SEQ ID NO: 11450 - DNA, 1501 bp, Oryza sativa
taagaaacattttcacatcttccatatatcccgaatccgtagctagacaaatccactaaaaaggtgcgtactatgcaaatgtgcagttgacagggtggtgctccgattccatgggttgatccccaagtgccagaggcccagagctattgacattcagtaagaaaaagagctaattgcgttccccaagaatggacatttggaagatatatgtaagacgtggaaatgtttccacatcttccatacatcttacatcgttccacactattgtgatttctgaaagacatttcagttaacagtacttcataatcttaagagttaagagctccattatggtgctctttactggtagtattctgctagtagtataaacaatctaagctatcgatttagaagcaggttataaacgtattttatctctctataccaggggcatttcatcattgacatatttcttccaaaatatctgattagatctatacggtgcctaaagagatttcatttgttgggacctcccaccgatgtatcagccatcactgtagtgtgcaaaaatatggcttgtgatgaagaaaacaaaacatatggatataagaatgaagccctcctcctctctcataacccacttaattaaggagatcctttgtttctcaatgctctgttcccgtttcagtttgagacattctgaatgcaccccaagtgtgcgccgccctgctgaaacaagctgtcatcttgccgttgcggcgtcgtctttttgattcatctgatcgggaacgagacatgcctcgccccacttgtgaattttgaaccggagggacaaatattttgattctccatatacccttctctattggactattgcacccttgctagtttctactaccactaatgaaggtgatagtataaatagagctagttcatcggatagaaaaaggtctacgatatagattaatatctactaatagcacaatagccaagcccccttcttaaacactcggtaaatacccaaatacattttacacttcaatccatttcagtatttcaatctatttcaggccccttttgattcaaaggaaattcgtaggaatcttagaggatttcatttctataggaatttctcctatatagccctttgaatcaaagtaatgaatcctatggaatcctataaaattcctatggaatacctaatgccatgcatgtttttagaggaaaattaacattaggttctacttcatggaaacttttctttgagtctttatctctcctctaaatcctatctttttcctacggtccaatcaaacgctcattcctgtgtttttcaatcatctattttacacaattacacttacaaccgtatcaaaatcctatgtttttcttattcctgcgtttactcaatcctgcaattcaaagaagccctcagtcttctagcagtgggccctcagtcttctagcagtgggattgggtgctcatggagcttgtattcacggacactcaacatccttcaaag

SEQ ID NO: 11451 - DNA, 1501 bp, Oryza sativa
tctttgtttgagtttatcctagaaaattagaaggaaaagagaggcagaggccggtacgtatgtgtgttcaattcttcatcgcacggggattgatgtgcctgataggatggggtactttgggttactttgagtttctatttaaatagatttaatctaatagtataaaattataggaccatttatttaactgaaaatcaatgattatatcaataacctttttgcttcttgtaacttataggacttgctctaatttattagtgtgccaaatgacggcttaagagcgtttaaataaagtttaataaactttgtataataaatataatatatgattgttaatagacttaacgttttgttttttctaatattttttctatagaaaattatttaaaaaattcatactgatctatttttatatgttaactaatacataattaattatatgctaatctatctcatcgatttacgtgccatgtgccagaagatatacgtttctaacttatggtctgtttagttcgcgaaatgaaaattttttagctatcacatcggatgtttgatcggatgtcagaagagattttcggacacgaataaaaaatcgcctgaaaaccacgggacgaatctttttagcctaattaattcgtcattagtacatgtgggttactgtagcacttatagctaatcatgaacgaattaggctcaaaagattcttctcgcgatttctcttctaactgtgcaattagtttttttaatttaagtatgtatttaatgttctatgtattaaagatttgtgcaatggttttgagaaaaaaattttgggaactttaaacctggcctcagtcatacctcaaaacacatccttgtcgacgagtcgtcgtccttccccgatgcggcgatagtccaccgggcatccgtgaactccgtatcatcacgatcgctcgttcccccaccggccacaacagatatcgaacacgtgcatgtcttcttatccatctctatccatctgcatggatatgatggtatgcatgcagcacgcgcggtcatctcccccacacagataacaaagtgtccagaagaacccaacggaaacacagtacgtggcagcaggttgccgcgtggcaccaccgacacaacgcgctactgcaggcagctcgtacacgtccctcctccgcctttattccctcgatattgccagctccgcctcccggctcacccatgcgtcacacgtacccccatcttccacggcctccttcctgatgaccaaattaagcttccatttttttttaactccagtagagagatcacacgtacacaacccacagtctcgccgcggtataaatggcagggcaccccggccagctgctttgctgcatcgatcgacggctttgacacaagtcatcttactgatagcaacaacactagctggaacacttgggtacacgagttcagggatctagccagagctaattaagcggagagttattagcttttaatttgcttgagagga

SEQ ID NO: 11452 - DNA, 1501 bp, Oryza sativa
aaacttctacaatttccagttgtgctagattattaagaaacactaattttacatccttcatgaacaccaatccgtacatgagagaaaactacgctaatgcatttaatcattccaaattttcaatcaagcaattagaatcgaattgcatattttcaaaaaacataccttcttgctggcctgcagctgctactgctccctgtagacctgctcactcctgcggcgctgctgctgctcggctgctcctgctcacgcgcagcgagctcccgcgccgccgccggactcctgctgcactgctgctccggctcacgtgctcccgcggcgccacgctgccaccggcctgctgctcgcggctcgcgcggccgctctgacgctccgttgtccgcctgcctgtcggctgccgcctcgcggccttgcgccaacgcgccgtcgcccgctgtaggggggactcaactccgaggagcagcagggcccttatagtgcgccgccaccgtttcagaagcaacagcagcagccgccgccggccgttgccatagcagatgagagcgacgattcgacttcaaggtgcgggcctgcggcttggactcggcgcgataggcgtcggctcggctccaacgaaatcgcgatagaccggcttgcgcgggcggcagctggacacgcgtcaccagctcgcgcggtgccgcacgagaggcttggtacggcactgccgcatagatttttttccggcataatgtggtgtcctaatttttataatcaccatcaaagcttgtagtagtaggctggaaacacctatagtatgggtgtcattactttaataattattattatgatcactgttctagagagtcgaagtaatgtaatcgatttgggagtaccgtatgtaagaaactaattaaatacagatttgttaccatggtgggttaggtaggggcagaatataaacgctttataagatgttcttttgattttgataaggttaaaatttgaagattttaaccatggatcagtacacatccaaatataatttacaaatagaaatttataagagttatagacataactttatattccccgtaattattgatttcataccggtgacaatatattttaagccaaaataagggttacaaaaggtgaactgtgggagcatgtgccgttttctaattctagatagagcccgaggtaaacacatacgtggcggccggtggccgcatggcgtcaccgacccggcgcgctacacgcacacgtccttgctccgcctttattcccttctacgcaccagctccgcctcctggctcaccccatgcacgtacacgtacccccctcttccgtacccttcctgacctacacttcggtttttttatgtacttctccaacctccaagatcagtataaatggcacgtacgctacccttctgttcccctgcatcgatcacaagacacaagatttttcactgatagaatagcaacacttgggtgagagatcagacgcgtgtttgagaaga

SEQ ID NO: 11453 - DNA, 1501 bp, Oryza sativa
tataactagtcggataaccatgccgtgtgggtatggggtacccataatctccacagtaacccctgagatcttcacagtcgaaaagataatcttctctcgaaccagattactccaaagccaagtgcttcaatcatctttgccatggtctcctgagtacttttaccaaatatgaagattgtagagggctgaaaaataaaaccaggtgcatcgaatagatgcacctaataggtgtagcccccgactatgtggttagttgaacaaactaagcatatagtcaaggaataaataatccaaccaactgagtggtttttaataattatagtcaaccaagtgacatgatattaatatatagcatatgcggtgtgaatccccgaataacatgatccaggtgatataccgactgatttgtaaaatatgatgcgtgcaacctaaagttgtctacatctaggggtgaaaacggtaacggtaattaccggccgaccggtgttcctttttgactttctaccggccgagccatatggaaatggtaatcgaccgaaacagaaatggaaatggtaaaaaatatggaaatgaaaacggaaatggttttactgttataccgatcgtttccgtatttaccgtattcttgcggaaattaccgtttcttataatatggtaattaccgtattctaaatatgtcgatatttatagggcatgtctatacttgacccacagcttatagattgagtgactcttcaataaaatctctaacttttgtacatggctaaaatgaagttaatttataatttatatagtataagcttgaatttatgtatatatataatatacttatgtaaagttaaatatatgtttttatagtttaatgtttccgtatttgttaccggtttccgatctgtaccgatatgtttccgtccgtattgttccgttttcggtttttcgatatttctgatatcgtttttggtttcgactttaccgtttccgatttcgtttccgagaaaaatatggttacggaaatggttgaggctgttttccgatcgtttccgaccgttttcatccctaactacatcattgaaaattcacatagtaaaacagctataaagaagcttaaatgctgttaataaagaaatttccaaagtattgggcatacgccatgcgcacactgctttaacagatgtgcttaagtccctaaaagacacatggtttcaacacacccggaaatatatggcatatgtggtataaaatccgagtaaataaactcataaaggatttaccaatcacctggaaaataaccaagatatataatcagcctaagccataatattgggcaataaaaatgcacacttacgtggcaaaaagcaatgatattgtatctaatcaattgcttaaaaaacccaaacagtgccttgactatataaaaaagtcagcggggcagctatgaaaaacttcactattgggcaccttttaaaatgcattgtaccaactcctaaaaaattgagtaact

SEQ ID NO: 11454 - DNA, 1501 bp, Oryza sativa
tctaactaattcaaatgcgacatagtttatctggcacgccatgccacacatagtgtttataactgattcatataaaccatattccattcaattaaaagtttataacaaaaatatgtacaagaatgtgacatacatccatttatatcctcattaatgtggagattatgggtatcccatacccacacggcatggttatccgactagttataggggataacttatatctatggaatatgtaacagatcatgacttgggtattacgtttccttgtatattacggaacggcctaaagtcctggtttgataagattgtaaagtagatttaggaaaccgataccgtattggttaaggtttctatcttataatcctgcccccatcctgtataaggtgggcaggaggccctctagggggcatgagacaacctgattgtcagatcaatacacacccggcggattcaaatccccaaacaggagtagggtattacctctcattgagagggcctgaacctgtctaaatccttgtctctgcatccatccacttttaggtctcgtgcgctaccccttgtctctgccaaattcatgtttcgacagttggcgcaccaggtaggggttgcgtcaaattacccgtcgaaaagtgcgatggaatcaactccatgagtcgccggcttcgtcttcgcttcgggattgtcgcttcctcgtcgccgacgacttcaacaagctctcgttctctgacttggattcaaaccagtcaggagagattcaatctaactaagaaggagatgccacttttaggagttatctccctgacgaggcctcatcagttccgcccgaccggagaacgccgccgccgccgacacgcgaagagggagatcgtgtgctgcatgtgcctacaacggtgtcagcggtggcctcgcatcgcgctcgcgatagtgctcgtggtgacctcacgctggtgtcgcaaggcagcaagaccgatctctccctgatggtgtcctcggatactccaatctatcatcattagattgatttctaatcagattaatttgctctgttgtgctttctctgtttttgcatgtactggtgacgagacgggcagcatccaactgaggtcatctttgccatgtattaatccatgcgtgtgttgctggattaatgccggccaaatctccagtcagtcatgctattggcaaacgaaccaacatgcatactgcatatatgcaccgacatgtgcattatacctaattgctaattagatttatttataattgcaacttaactgaagcttgtgttggctattttgtttgcatgtttggagattccacacgcctgggggctgcgggccagcaccgcctttgcgtgcctaacgcggcccgactgctcctagggcacgcacgacctggatgcgatgccgcacgtcgggggcttcggtcttcgcccggccaacacagccagactacgccgcttccgccgtgggctcggggctttcgcctttgtgcgccgccg

SEQ ID NO: 11455 - DNA, 1501 bp, Oryza sativa
tggagcgacttcatttttattatcttcagcaccggcaaactctattgccgctacttcacaagttttgctacttcaccaaccacgacgtctacaagagcttcgacatctcagcatgcgtcaccaaatatgatgccgtgttattttactacaacaagtggtgttccaatcttcaatatttctactcggatatcttcaacatgcatcttcactcaagcaatgactactcgacgacaagaagctatagcttttgactctatgttcagttgtttcccaactaaccaaagagtcgggggctacacaaatacacggctcaaaattcgataggttttatgtcaagatgaagaaatcaacaaatcagccaatgagttctatggaatctacttcgggagtcatcggtttcatcttcgcttcagagcagacgttctacttcagcaactcttattatttcaccggcaatttttggtttctacacgccgctacaatctactccaaatttctcaattgtcaagtttgagatttaatctacatgttcgggagttggacaattatcaaccaatcagctcagttttaacgagttggacaacagcatatactttcctctaagtgaagcatctgcaacagctatagcaccaagttctactgccatcttcataaatcaagcggcattgcatcaatctttgtcatagacatgctcatgtcaagaaaactattcgagcttcgccatcttctcaacaatttgaaggattattgtcactgacatcatcaccaacacctctacttcatcggccctgacatctccgccgttgctaagggcagctgtttcgtctgtctccgactgattatttcgtcaccaaggctacaaaactctatcgctattgctgggtgccttcatcttcactgctagttgatctgactgctgcctactggtttcttcgcttccatgccgattgcatcagctataaccgatgaacaatttcaattactccaaaaagataagctatatgctcaggggcttacgagctcaagcacaagaatcataccttcaagttggattttgttctagatacaggcaacatgcactcgtattcctgagattatttcctatgctcgaagactggaccaatcattattccccgtaagggctgtcaaccgaatacttgcgccagtcgggattcaatttttatatctattttggagtatcccataagggataatcactcatatcagaagcaattcatatgagctacacttggtctatattacccggaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgtgtgattatgtgcccaataccttaaaatccttttatactgcagttactcaattttttaggagttggtacaatg

SEQ ID NO: 11456 - DNA, 1501 bp, Oryza sativa
aaaatatatacagtatggtgatgacgtagattaattcctattggacgctgtgacagttgagaagtatgcatgtaaagagaattgaactggaaattagaagttagaatcaaaccttaacaatggagaaaacaacaattagcattcggctgacgttgtgtgcttttccggcgctcaccggccgcacgtcaacctcgccttagtgattgtgtgctgctagatccgataacgttgatatattcgcctttgccgcggccgagcgagcagaacataattggcgtacgatgtgcttgtatgtactgtttcctcctgcctttctccgtcgtttgccgctgccggccggcacgatggccatgccgtgccctcccgtatcttccactgcatctgatcagatcgatctcagtaaatatggatggactcatcggtttagaaaaagaaacaaatacccacgttcgaaagaaaaagaaaaaagaatgcgtgcgtgaatggatcatatcgatggtgcgtgcgtgaatggatcatatcgatgggcttgacaatataggttacatggggctttaaaagacccaccgcgtggaacttggattagattgtaatcaacggttgacatattatggtttgtttaatcaatggcttgatcttcctgattaacgtgagagctccaaaaaagtgcccgattagtttaggtatagatagatagatagatataagggcaagttgtttgtgtagtttacaaatactaaagacaatatctttgaacaaaataaatctatatatatccccttacacccacacccacccccacccccaagcctctctcaggtggtgtttggatccagggcttaactttagtctctgtatttagacactaatttggagtattaaatatagaccacttacaaaactaattacataaatgaaagctaattcgtgagacaatttttttaagcctaattaatccataattagagaatgtttactgtagcatcatataggctaattatggattaattaggctcaattgattcgtctcgtgaattagtccaaaattatgaatgtgttttattaatagtctacgtttaatatttataattagtgtccaagcatctaatatgataggacttaaaagttttagtcccatctaaacaagatcagtcagttgagctgttgtgttcttgctgtagctctatccaaagtgttaacaaaagtccatagattttctctgggcatgagatgcattgggaacctccaattgttctttacagcttgtgcacggtaagggaagagggttatacatacatatactttcatgcattatgatggcatgtagttagatgcaacagaattagaaaatatttacctgttcctttttgccattttactcccttatctctatgtgaattttctaaattaaagtaattagcgtttcttccgtgcatactgttttgctttttctttcagcaagttgctgaatgtgcaaccgtgccagagctgttccccgtag

SEQ ID NO: 11457 - DNA, 405 bp, Oryza sativa
cgccaccgctccaccgacgccactgccgcgacgccacgccgccgccgcgcccccacgccgctgggccggaccacggcgccggaccgcgccccgacaccgccgcgagacgccaccgccgcgccgccatgccaccggtccgccgacgccactgccgcgcgccccgacatcgccgaacgtgaacgaacgtgattgaaacatgaccaaacgcgaacgaacgtgaacgaacgcttaacgaacgtgaacgaacgcgaacgaacgtgaacgaacgtgaacgaaacgttaacgaacgcgaacgaacgtgaacggaacgcttacgaacgtgaatgcacttgtactaaaagtgtgagaacgaacgcgagcgaaacgtgtacgaacgagataattaaacgattattaaacttagca

SEQ ID NO: 11458 - DNA, 1501 bp, Oryza sativa
caaacatactcttgtatattgtgctcttcattgcacattagcaattagtgaatctgaaacctcaattgtagatctaatggctagattaatttgaggtgatgtggcacactgtgggatgagagaattagagttagtggggatgaactatataagtatatagcattaactcaccataagtaaaactgttatttaattcaccataagtatatagcattaattcaccatgagtatctaagcaaacaaattacttatgctgatatgacaaatatcatacgcttattttctatcatatgataattttaaggtttgcaatgtatattttcccttgaaactcctccctagtattcacaactacgaaaatgatttcaggacccatctcaaattggccggggaccttactaggaatcagtgtgttgggggaagtggaggagtgccctcgcctcctcattttttttttacatctaataacctaatctcttctttctataaagctaatacggtaatacccactaaacaattaaagcttaacatgtaagcataatatttattagcactcctgaaacatacataccacatcaacccattaataacacaaagctcaacatgcaagcatataataattattatatctacgatttatttcattctaaaactaaacgtacatatgctaaatcatcattctcaaatcacttttataatatttcaattcaaataatttcatcatttctccattatctatttatctaacatacttcccgtagaaagcacgtcacttcatctagttagataattaacctaataacagtgtattaaactctctccaacccttagttctctcctatgtctaaatcgcgattcccccactgtcggcaatgctatcgctgtcggttttattagctgacactcactacgccagatcctcacacctctgacgggatacctgtgacgggcaaacgaattggtcagtattgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggcttttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcaga

SEQ ID NO: 11459 - DNA, 1501 bp, Oryza sativa
tcacaacataaactcaagctttccacacatcccaaattcgcgagccctatccgctgtcgctgagctgccaccactgagcctcgtccaccgccggcttcgtgccctttggcagatttagactggagtggaggagagggagatagttgaggcgaagcagagggatttaaggacgactgattataaagcggtgatacggttttttttactggtggacctctttaggctccgcctgcaaaaaatatattttcagatgcgggtctagaacaataggaactctagttattttaacatttatggttcgcctgaaaaaaatcaaacctaagtgctttgaaaattcgttttatagtagtgtttttgaatgttttggattaaaaatattggtattttgaaaaaaaaatttctagaatagaaagtttcgataaatcttatgcactatcagaatgtatatttattaaaaaagatatggcataactaacatacaagattgatcccatcttccaatagacattatgcgctgcacgcagctaggacggcagcgaaggaggggtttgggcctttgggggtggggcggtaagccgtaccaggatcttccagatgacgacccacggctcggcggcagtgctgatcatgccgccgcacggagttgtcgcggctccgtacggcggcggtgagcactgagcagtgtgtcctttgctttttctggtgccggcaggattttcaatgggcctgcctttgctcttgggcttaacgtttgccaccacaagggcccatttacaggagtaatttggacaattgagatgacaacggatttggatctcaattgaatttctctaatctactgatttatcttcccatttcttctaccctatatctaccctataattcaccaactcactcttacacctatctaccctataattcaccaactcacttttatacctatctatctaccctataatttactaactcacttttacacctacattactcattcatcgaatccgacaatccgtactcatccatgtggaatccatccgatgatccacagtgctcattcggccccacccccaccaccacccccacccccacgcctcccggttccccgatccacgcacgcccgactcggcgactcgcacccccacctcaaaacctagctcctcctctctctcgcatcaacacaagcgccaccatcactatgccgatggaaggggagtcccgtgcgcccgaccaatgcttcgcatcctggtgagagaaaaagaggtaacctttctattccacgaccacggcgaaagtttggatcttgattcgaaaaaataggacacttttctctcccttgtttctgagctacaagaaatcctgttccgattacaaaattttcatcttttctgagaaccgtgagatactgattcttggagatgttcaatagtaaattagtccatagattatactctagactaaaattaggtttaggagaccctccccggattgatggatcaattga

SEQ ID NO: 11460 - DNA, 1501 bp, Oryza sativa
gccttgtggtaactaattgtgtattgttcacctttctccaccagttttattatgtgccgcacaggcaggtcatcaccttcaataatttccttgtagtacttgttcgtgacatatgccgcggtcaggttgcgatgcgactccctagtgttccgaatcagacaggagtgttcctgcagtttggacacaatccagtaagactcgtactttggcacgtgaccatgaagacggaaggtgcaaccttccatctcacagacgaccgtgtactcagtcttgttagacttcacaaccctgaactgcctttgcatctggaatgaccatgacttcactgtgtcttgcaacctagttttgtcacggaacattgcacccagattgatttggccatccccgtagaaccatattgaatcatgacaagagctttctgcaatataaccagggtcttcaaggttccacgaagcaggcataggtagttcatcaacttcttgttcatcttcatcatcattctcttcagcagtgaggttttcctcatcttcgactgcatgtcggtccaccctctcaatttcttcaactatagcaggtatgtcctccccttcatcggcttcaccagtaggatggcggttgaccacttcatctccttgtatggatagattttgaatgtcaggaccaacatcgccaccacgatggggagctacaacttcatcttcttcgtgtgaactagaccccaacacctcacggttgctggattgccctgcagcgctctccgtagggactcttccttgacatgctagcaccagcatgacatattcatatccccgtctcctacagccagcgagccaatcctgccaggccttactccgtgtcacattttttaactcctatcttatgttgttagccgatcggctccacataaccctcacgttaacactatatatacccggatctaaagaaaatgtgcatgttaaccagtaccaaacttcgggcatagtaagggtgtcaggatttggatggtatagcgtgcattgcctaaagttgctcagatcgagaccactttcattttcataatttcaccttcaccgaaatacactctaaatgccgacattcctaccattgcagtcaacacggactactccgtaaggaagtcttacagaacaaacgtgtcctattcacgacaaaaattagtttacacgcatactgtttttttgataaaaaaatctttatcaataactaattatttatatttccatattatttataaaaaattcatgtacttgtaataaaaaaatttataaataaataattatgtaaacataaattatttacttatgaatacatgacaacgcaatttattatttataattttactacaactttgaccaaaaaaataaacacatgacaataaaattaatacatattaattaattaaaacacgtaattaaacataactatggcaattaatttaagtaaaagagtatgtaatacttaaaacaatacaaccaaaccatat

SEQ ID NO: 11461 - DNA, 1501 bp, Oryza sativa
ggcatgccatgaagcccttcggccggacctgccgaaactatagtaccaccaaggattcaagccaaagacgtcaaggccattcaggcgaagccctatggcggaagccataagcgaagatggcgaaggctggaaagccgcgtcggtattccgaaagtaaaggcatctcgggcgaaggcatcttgggcgaactacaaagacttcgccatgacgagttcggcatcaaggaggcccaacaggccgcccccggccttttaggcccatttgccatagaccaggcccagcctatcagcccattaaaggcccatatgtgcaaatgacactgcatacccatgtaaatgtccctttcaaaagggcaaccatgtaaaatcccttgcaaccctaaaccctaggaggtgcaagcttgtgctaaggctataaatagacttctagggccatgtaatgggggatccccaaaaaaatatttcacgaatcaatacaattgcttttacattccaactactgttgagagaaccacgcctttcgacgtggcatagttgtccattcgacaacatatactataataaattggtagttatgattaatttgattatgtaagtaatcaagtgaagttgaacttagttctattaattttttatgttatgattaatttatagataattttgtactaactgatagttacaaatattttgtatttaagtaaagttacggtccgttagataatttatagttaaagttgtaatatattatatgtactcatccaaatttgcaatagtagtattgttttagaggtcatatctaaataggtacaaacagtccgtagcaaagaacatgatgcggctcaatgagtgtcattgtcctagataaagaatagaaagagctagccaaaatgatttttaacttagcttccgtcaatgtttcttcggtgcaagtagtcatttgttgtattaaaattaattgatatgtataattaatttgttagttaaacatatggattatgcagtgaaataaactttgaggcagcaattgttatacgagcaagatggttaaaaaggagtaggcggaatctgataaacgcaggtaaatattttgtcatatttatgtacgatatggtttggttgtattgttttaagtattacatactcttttacttaaattaattgccatagttatgtttaattacgtgttttaattaattaatatgtattaattttattgtcatgtgtttatttttttggtcaaagttgtagtaaaattataaataataaattgcgttgtcatgtattcataagtaaataatttatgtttacataattatttatttataaatttttttattacaagtacatgaattttttataaataatatggaaatataaataattagttattgataaagatttttttatcaaaaaaacagtatgcgtgtaaactaatttttgtcgtgaataggacacgtttgttctgtaagacttccttacggagtagtccgtgttgactgcaa

SEQ ID NO: 11462 - DNA, 1501 bp, Oryza sativa
gggcagtgtcctagtgctaaaaccacacataagcagagtcctgtagcaaaatttgccatgagtaaaacattaagttatatatgatgaaaaaacataatttaaatatttaaatattttgtgaaacagaaacacgggttgatacatgtcactatcacaaataaaacaacaagtgttagcagattgaaacatatatttttccatcaaaatatgcaataccttattgttaatgtgtaattacaatgaatacaacagtacgaccggaacacagattggaaaagtagtttaaaaaaacaaattattttgaacattgctaaaatgcatgcaagcatggagtggagagagaggagggagaatagtggctggtagttccataaattttgtgaaatacactgaagatacatattaaaacatattactattgtgtatgaaacattacgttttaactgtttgaaacatacacactgataaaatttcaaatcacgaaaaaaaataaaatttcaaaaaaaaaaccaaaccctaaccccctccgccacccgctctttcgctagcgccggccgagcaccccgccgctactcccgccattgctatcgctggcgccagatccgccacgacgcatagggggagcggccgccgctggatccgtcactctcgccgcccgccgtcgctgaggtcacagcctcatcgaagggcgacggatccgcccccctccccaccgccccgccgagagcggcgccgccggatccgccgcccaccatcaccgcccatcgacgcgaagccacagccgcacccgagggtggcgccgccggatcctccgtcgcaccctcgccgtccgcccgctgccacacagaacggttggcttccttgttggtgtcgccacctgctgctgcccacacggattcggaggaggagagaattaagagaggggagaatatcaggagagggagagagatgggtgaaaatttttgaagtggttaggagggaaagagagagaaggatagaaaaaaaagggagtatttttacatgcgaaccacttattcgtccgcacgcgaaaatagagttttgcatgtggctacttaggaccgcatgtgaaaataggcttattttttttatatacggtttgttaagagatccgccttaaaaatagatttttgcatgcactcttcttaacaagccggatgtgaaaatgtgggttgatttttacagacgcagacttacatgccgtttgtcatatccagacaaaaaaaaaacgttttctctagcagctagtgtcactcctctttctctttgctccactgctgcagctgaatatatcgcttcgcctttacggtcgagccgtcttcggtgtcttccttttgtttgttttcttttttttttcttgaaaagctgaatgacacgaatgattttgtgatcattgtttgaggtactaatgcaaataaagttgaaaattaaatttaaaatagtttttaaattaagaactcagatataccaagttttgtcgaaa

SEQ ID NO: 11463 - DNA, 1501 bp, Oryza sativa
ctaggtcgtccgggaaaaggaaggggagggcccaagcttctccgaccagtggccgggaaggatgttctttatgtttgttcggtctattattttagtgtttttgaatgtttgttcagcttgtttatgtgttcttgggtgtatatgattttttgataccgattaatatattaatgaattctggtcagggtgaaggggagctgctcgagcattggctcgattttttttattcttagaccacctcaaatgtgtcgttcactgggtgccgtttagaaaatttggcattcatggatgtttcccaacaggtatctatagttgttcctgtagcagtgggtacctgtgtgtagtaccgtgtaacatgcatagtgattgctactagagagaattaagagatggtacctgtctatactacatgtagcgtgggacactgttgttctcattttcacggacctatgcttgaaaccaaggtatcatgtcctaaacctatgtgtactatatatatcggcacaatgatcccgcggctctatgcgtttccaatgagattcgcctcggcgatgttaaatttcgagcaaaataaggtccgaggtgtttctgatgacaatagcacttcaggtcacacgttggctgagtactatacctcagttttcgcgagcactctttctaatcaaaagctgctaaacttaattaataatgggcagcatttattaaaataaatgtaaaatttattttccaaattaataatatataatacttaatttatcatgagtcaattagccgttgaaaagtgtgcctggttaataagctcatccatgaactgagtctaatgggaccttagggcatggttctttttcaaggaatagaaaaatagattaacgtgacatgttacgtggagagtgcatttcaaactcttgagggaaaatcctattgttgtttccatgtcacttaaatacttatgaacaaaattgaaaagatgtattaacatataatatataacttcataaatatgcaacttaaaatttaacgtctctatatatcgcaatgaaaaaacaagtatgacatgtacaagttgaatgttgcatgtttgtggagtgatatatcatatgttaatatatcttcttaaacatttttttaatttctttcataacaactatttgagtgacacgaaaaaaaaagagacatcctctcgaatacattcccatgtaatgtgatcttgtaagtggtgtgattttcgacaaaacttggtatatctgagttcttaatttaaaaactattttaaatttaattttcaactttatttgcattagtacctcaaacaatgatcacaaaatcattcgtgtcattcagcttttcaagaaaaaaaaaagaaaacaaacaaaaggaagacaccgaagacggctcgaccgtaaaggcgaagcgatatattcagctgcagcagtggagcaaagagaaagaggagtgacactagctgctagagaaaacgttttttttttgtctggatatgaca

SEQ ID NO: 11464 - DNA, 1278 bp, Oryza sativa
gaatgtgccagttcatgcattgatcagcatgcaccggatgttagcatgatacatcctatatgtatgtgtaatatcttgtttcatccagcatcttcttgtgccattgcacggcctgctgagccatggtccatgggcctaattgctccatcgatacatttgcgaagaagcttctggaataaactccatccggtggccggtgcacgcacgcatgcaagagcatttctagatcgctacacgcgcacgcgcaagatcgtttcgtcaagcctcttccgtgaaaccggtgtttccacgtggcaccattctccttgcgatcttttgcatcgaattcgtattataagatacaaaagtctatgaaacctccgttgtcttcctcggccgaacccgagtgattgattcctctataaaagtctatatagtgcccttcatctaaccttcgggaagagcccaccatcggcccccttgtccactaaagtctatgtaatgtccctctacaacccaaaccctctctaaaagactataacacctccccacccgaggagtttttcctcctcggtttataaatccttccaaacttcgaaaatccatatatctcaaaccgtacctctgattaactccgttcaactttcataatctctataaaatcgagatctatttactggcaccattagattgtattgaatattactttattttatttttacgattgtgtggggttattctttggccgtttattggacgttttggatattctggatatttatcaaacacgggtattctggttatttttagcgatgcagatttctcgaagatatcagcacctaaagcaaggcaagtcactacactcccttccttcaacatattgaacctatatttatatatgtgttgtgtgcaaataaaattgcatgctaattataaaactgcgtacctacacttgaatgaaaacccctccttgatcttgttgtcattatgtttacacaatcatccattgtgcctgagtctatttatttatacgtcgtcaattattgacatcgcttagcattgctattatagacaattgcacactccatagttcatcaaacgagtgcaattaaattattttatggtggttacgtaagcagttaagtatatttagcccagctgaacccaaaagcggtaagtaggttcagatgatgaagtggaaaaaggagctcacatgttgcaaggattagtcttctcgacgaggtcaactgggcaatgcacggttgataattagataagacgtggtgctgcgattgcagg

SEQ ID NO: 11465 - DNA, 281 bp, Oryza sativa
attcttagaccacctcaattgtgtcgttcactgggtgccgtttagaaaatgggcatcaatggatgtttcccaacaggtatctatagttgttcttgtacaagtgggtacttgtgtgtagtaccgtgtaacatgcatagtgattgctactagagagaattaagagatggtacctgtctatactacatgtagcgtggaacactgttgttctcattttcacggacctatgcttgaaaccaaggtatcatgtcctaaacctatgtgtactatatatatcggcacaa

SEQ ID NO: 11466 - DNA, 1501 bp, Oryza sativa
ctagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccacttcaacttttgtccattttcagacggtattactcttgcatgatttaattggatatattgcttacgccaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaacctagaagaaatagcaaaggataaaatatttgtaacacttgagaatacacagtcatctcataaagattcaacatcagaattgagaaaaagttctcaaattgctgaatccaaccttgtggggaaagagatattacatgcttctagaaaattggtgagccaggttcttacacacaaggaaaagaagacttacaagcttgctattattggaacag

SEQ ID NO: 11467 - DNA, 1501 bp, Oryza sativa
tacgttcatcggccgatcgagtatatacatacgtagtcggaatcgatatcatcgtcgattcacagtcctacactaactatcaaagactgagacccaggaaatatcgatcggctcacctctacataattaaactgcgattaaagtatacaagtcccagaataatagacacaccaagctaactactagatactcctagattactagtagaaattaatttagaattgattctcaccggcgacgtacgggcactgcagctagctagctggttccatgacgacgacgacgtctgaggcgagaaacgacgacggcgccgccgtcggttgctgccccaccgccacggcgaccctcgcgagttcttcttcttccccggcgcagctgctagtactaccagcagagatccgttggtggtggcagctggcgtgctccgtcgcctcggcgacgtcggcggctcacctggaccggatctttcacgcctacttcggcggcgctcgccgtcgtcggcgaacgtatatatacacgtcgacggagccagagatcgagatatagctagggttatatatatcgtcgttgagtcgatcgatcgatcgcccctccggcagctacaagccgtcatgccctttgccctatagctagaagaagagagatgttacattttatgcaagttgttgtacaaccacaatatgtaagataagatgtaaaacatttctattatttaaaaaaactttgagtagtatttttattttttttattttttgactcattaattttgtgtctattggtagatatataccaaagatataaaccattttcattgttagaaaacacatcaagtctttaatatttattgaatatatataggtcagaaaagccaaactacatgctccttgcaggccttgtagttcccggcccatcccagggcctcaatctttctattaggcctaatatgtactagtacttcgcaacttacaccttacacagacctctagttatcgttaggaataagttcactggccgtccttttacccgagtctgttgaggtcctataaccgtaatatcataaatgtataccactaaactatatataaccgttcaaaaaagtcccgatacagtatagatgcctggtttcgctgatgtagcatcctagtcagcaaaataattaaaatcaatatacgagccccacatatacatgagagaaaatggtatgggcccatatttctcctttcttttctttttctcttctcttctctcctgattctctcgatctggtgtagcggcagaggggaagagaggtggccggtggcggagcggggacggcggtggtgggagagggagagaggtggcggccggcgcgactaatctagactctagactcgtgtatgataaagaataaaattttgctaagaaaaagaggccaaaatgaaattttattaacagtgaaggggctaattgcataagtgtccataataaacccttaatctctctccaaaaccctctctcccgc

SEQ ID NO: 11468 - DNA, 1501 bp, Oryza sativa
actcgtcggagatggcctcctacccggcgttccaagtgtaatgtgccctctctcctccccctcctcctcctagctcaacccctgaacacgtgctctgtacatatgagcttgattctttatcgcgtcgttttctttgatcgatctggacccatctttgtttggtggattgtgctctggtttcatgttcaatttcatttcttggaagatgctgtgcaagatggaggaatggtttgggatttgaggatttcttgggaacacctccctactttgtttatttccccttcatattataatgggttttaggtttaagaatttttagatctggacatgatcttatatgattaaaatatgggcaaatagcacagaagcatttggtgcatctttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatctgtgagtcttattgggttttagtttgttgtggcacatgaggcattgcattatttgtagtagcactttcaaggtttcaatttttaggggtaactacaccattaaaaccctagatttgtgatattttaaggcgttttatgccacgaatttgtagatctgatcatttacacaaaaccacataaccctagatttgtgagtcttattgggttttagttaataatttgaacatctggatatgaacagcaataattaaaatttgggcaaagtagaaagtgttgtactttgcctatttttagggtagcttgaatggcagcacattcctttggtgttgcataaacccaaccaaaaccatagattgctgatactctaatggggttcacatcaagagtttttagatctggatgtgaaaaatctgatgctaatgttttgccaacacccctgaccgtttgacactaaaatttcttcagtggttaccgttcttctgaaataatctagctagcatgtgccattcttagattgcttacactgcatttgcttgtagatttgtcggattctgatgagctatggttaataatttctgaatctgtacatgaacatgaagggttgaaatttatgtaaagtagcaagggatgtattttttgggcagcatcaatggtggtacattctttgcggtagaatttatcaaaacgtcaactcttaggagtgcataaagccacccaaaagcctatatttctgacgctgtaatggtgtttatgtcaacaatttgttgattaagaagtgaaatctgatgctaatgttttgccaacagtctaccgattgacactaaattccttcagcgattaacgatcattgttttgcaaactaatgtagctaaaccttgtaccttcttcattggcattcactcctaaatcaagtcctaacctgctactgttgctttgctactatctccagaagc

SEQ ID NO: 11469 - DNA, 1501 bp, Oryza sativa
ttctaagtccatataatattagcatagtaaaagtgaataaacaaaaatgaccaaaaccgcagcatcgtatctctacccctagcattctctagcagtatgagagtttacctttcccatggatggccggatactgaccctggtggtacatcaatttccatcaatttttaacaaattccaatggaattttgttaaaatttactattttaaattttaatttctcaaaatatatttaaaatttgcttcgaaacatgattatgtcccgtcttgaaatctcaaaattttaccggtttttacttttccccttcgaaacatggaccctgagagcggagagggattctaatcatttgggtggacgtccactcttttatcgcatgtcaactaaatagttatgaaaatttttttatatcagtccataaacatttaaagtcaaattcgatttctacatgttacaacaaaaataacaaaataaactttaattggtatatgcatattcgcagtcaaaattattatttttattacaatttgtacttgtttgttgagcaatatattacatattagtctaccgtatcatttttttgatttttttataaaccctaaaccctacattattagttgatatatgataaatgagtggccgtccgctgaagtgattattaaaaactactgctctactctatgcttttaggcagacacctgctgccttgaagaacaaagttaaaaaagtgtataccattgtcgcagaggggtgtgaatctcagcccctccctctataaccacgtagctagcccatccgacaggtggacccacttacatataccacccacttatatacactttcatcctcgcttcatgtaaaatagttaacctgagagtaatatagttggagagaaaagaccttataaattggttccaacattgctaaacaaggtggtactaaacatgagcacccaactctcatgcgccacacatgccaaatcctaattaggccaggatgttacacgcagcgagtttgtacggtgagtgcgtgaactcataatgtgttcatgatatcatcacgagttcgtgcgactagggcgcgacttcgcatggagaaaaatgggtggatgcgaactcacggcactgcagatcgcatgattaaataattaattagcatcactagaaattaattaattggtggttatttctattgttattagcatttaattaaccgctaattcatcgtcaacaatttagtaggcatttcgctgttcagccaagcaaactcacgcggggccagatttttttttatgttttagacctttaaaataaataaatttaataatagacctcctaggaacttatttttaaaaatgaaccttttcgccacttgtgacaagtcgttagcgattagttttgaccgtcaatattaccaaaatagaggagaactagttatgcttgcaatgcatattcatgttagaatcataatattccactagcatttggttactaaccttttgcagag

SEQ ID NO: 11470 - DNA, 842 bp, Oryza sativa
cttagcaatagcatcgattagaaaaatccaggaacaacacatccagatgaagatcgatgcaagtgtcatgacgacgacacaacttgttaatttgacctgtagccccatcatgtacaaatcgatcgatcgagttgtttgtattttgtccacgcaatatgtatatgcccataataatgatatatagtatatgttatcaattaattgtcgttttgtcaacaaagaaggaaaaaaaatggaagttgctctggagcaagcaacacatgttttttttagagcttttttacggtcctcgaggcggtatcatgagatagcactttttctattgtaaattaatttggtatctcttggtatctaggtactactccctccgtttcaaaatgtttgacaccgttgactttttaacacatgtttgaccgttcgtcttattaaaaaaaattatgaaatatgtaaaattatatgtgtacgtgaaagtatatttaacaatgaatcaaatgatatgaaaagaataaataattacttaaattttttgaataagacgaatggtcaaacacgtactaagaagtcaacagtgtcaaacattttgaaacagagagagtatgagttatcataaggtaccaaatttttacactaaatttttacactaaatttttggtatctcatggtacatcctcaaacatagtagaattgctcgtttttttatgtatggttggatgacgtcgatcgatgctggctgtcaacaacaatcatcagtataaataattcagtacaactgaaatttctcctcaacgtttagcggcagcagcatccagaaattaagatgagccaattagaggtggttgaga

SEQ ID NO: 11471 - DNA, 1501 bp, Oryza sativa
atttatatgtatacatatagttttacatatttcacaaaagtttttgaataagacgaacggtcaaacacgtgctaaaaagtaaacaatattaaatatttaaaaacggatggagtataatatggcctacaccaacataaactaactgtttgcacaaaatatttgaatgagatgaatggttaaacggatatgaaaaagtcaagacgtcgtctatctattatattattaaaacagctttgaaagaagacaccacgttcgctgtgggggctagaaattcccacattaatcggagaaaaagaaaagaagagtccaagtagaaatacaatttaaaaattgcttgaaattcgaaattaaaaataagcaatattgaaagaagagtccatataagaacccaatacgagattaatcaaattcagaataaaaataaaataaaatctaaaattagaaaagaaaaggagagtctaagtagcaatataatttaaaataactgaaattcgaaattaaaaataagaaatattgagagaacagtccatatagtaacccaatacgagattaattaatattcggaataaatataaaaataaatctgaaattagtaaaaaggaaagaagagttcaagtaagaatacaattttaaattaactgaaattcggaattaaaaataagcaatattgaaagaagaatcgatgtaagaaacccaatacgagattaattaaaatttaaaataaaaaataaaataatatccaaaattagaaaaattaaaagagagttcaagtaggatacaattttgaaataactgaaattcaaaaataaaaaataaaaatattaaaagaacactatacggtattaattaaaatttgaaaaaaaaattctaaaattagaaaaagaaaaaagtatttccgttaggaatataatttataaataactaaaaatggtgataaaaaataaagactattggaaaaaaagaccatctaaaacacatgacgagataaattaagtaattataaaggagtagagtagtggcagttgatacgacatataaaaactgttaataaaacaccaattagaatcctaataacgattaaaaggtggggcgacaggcaggccgtgaaagcaaacggacaatgcggttgccgggacctagaaagtaaagaaaatagacctcattgataatcatatccgacttttaaaatctcaatgacaataaaaaggagaagcagcgggcggggtgtatagtagtatagttgcagagccgccgacggttggcgggacttctaaaaaataaaaaatgaattcgaacgatagttgtgttcgattttggaatcccaatgataataaagagtaggcggtggatgggccgtagaggagtatagcagcatcgtttgacgggacttctaaaaattataaaaaataaaacctaacaagacaataaactctaaaaactacaaggcccaatttttaaaggttccgaacttctaaaatcatgtttgattttaaaatgtcaa

SEQ ID NO: 11472 - DNA, 1501 bp, Oryza sativa
ccctcggattcgtttggaaacctctcccctaacctcgccggcgccatcaatggcggccggatcttccgcgcccgtttccccctcatccggccgccctctctcactcccaaccctatataaaccctccccgtgcctccctccaccgtttccgccactcgccgctctctatccccgccggagtcgagctcgcgccgtcgccctctctctccgtcgtcgccgccgagctccggtccgccgccgttgtcgtcccagaccacctctcccctcggcgccgcctccttcggcttcgccgcatccccggcgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcgtttcccccttccctcccctctctcggccgccgctccgccgtacctatggccgccgccggcgaccatagggacgcgggcgcgccgcctcccgtcggctgtgccggcgtggccgccttcgggcgcgccgtgcggctgccgcgtggggcccggctgtcagccgctcgcgccctcgggtgcggctgacgcgtgggacccacggcgccggccggtgtgagcccgggtgcgcccggtccaccgtggaccgtggggctgccgcgtgggccccacccccgtggacccggtccgcgcgctcctcccctcggctgacgcaataaatccattttaaattaaaatttaaatgaacaaattcgcaaatattcatttaaagagcatataaacttcaaatggccataacttggccatttgaactcggaattggaccgttcaagtctctaatttttccctaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcactttatttaaattcccgcgttatcactgttttatctagccatgcctatctacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggattcacaccgccccctctattcaaaatccccaaaatggttttaggctgagctcggggtgcatggttttgatagtagcacctcggccatataaggaccggt

SEQ ID NO: 11473 - DNA, 850 bp, Oryza sativa
aatggaaagcaaattcatttgggaactaataaataaccaaataaatattcaaatcaaacatttgaattctcaaaaccaaaatatattgattacatttcaattcaaattcaatcccattcacttttgcagattagcccctccctttccttcctttccctttttcttccttttctctcttttctcagccgccactattcaatgtccgccaaccgttcgatcccgtctactgcgtgcaccacatcgcttctggccgcgccagtcacgcccgtgccgcaccgcaaccgcgcctccttcccctcagctgcgtccgaccccaaccctagccgcaccgcacttgccgctccgcaaccgtatcgcgttgtatcgcgccgtgcgtcgcatcgcgccggacccacgcccgcgcccgcgtcatcccttccgtgccgcgtcgtgccagggcccgcaccacgccaagccgcacctctaaccgctctcctagattctctccagaaaacacggagctgcaccatcgcccatgtgcgcgcgtcgccgtcgccacgcctgccttcatcacccagacacgcgcgtcccatcgcccccatccacgcccaatggataaaacggagccctctcctccagctagcgcccagacctgcagtctataggttataggtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatccctctcagccttcttctcgta

SEQ ID NO: 11474 - DNA, 1501 bp, Oryza sativa
taaattctccatgattagttacgctctttgaaattatatttgaatttttcagagcttaattgttaattttattaatacaaacgtcatttaacaattatttacttggaaaaagaaagaaaatacttccttttaggtttgctttgaaataaacacattcaataacttataattgtaatgcttctgaaaaaataagcactaaaaatgaacttattctatttttttcggcccgagggacctaaaatagacttatttccggcccttgccggtcggtccacggccttttgtgcacgcgcaagtgcactcccctccccaggccacaacctgggcttgggccggaaaaatggcctcactctcgatccctcttgggctgattttagcctggacgacaccgatcgtccgatctttagggttttgatcggacggccgagcgtcgatatcggggaaacaaaacccctccctctccttagccgccaaaaccctagcccatttccctccctcccatctcacatcgccgccctcccctccgcgcccccgagcggcggcgacggcgcccctcttcccgcgagtggcggcggcggcgccctcccccacaaccgacggggcggcgccctctccccgaacaacggcggcgtggaggcggctgcggcccggcgggggtgggaggggcggcgggccggacctcgcctccgccagatctggcggcatggaagcggctgtggtccggcgaaggcaggagaggcggcggcgtcgtttctttctctctctctctctgtgcatggtggggaggtgcggcggtggtggtggtggcggacgtcatggaacgccggtcgggccttgcctccgccagatccggcggtgtggaggcggctgcagcccggcgggggtgggaggggcggcgggccggacctcgcctccgccagatccggcggcatggaggcggctgcggtccgacgggggcgggagaggtggcggcgtcgtctctttctctctctctctgtgaatggtgtcggtggagattcatatgttcttggttgaaagttttgttatgtgtgttattgatggaatgtttcatgcgtgttcttgatgaatttcgactgggacttttcttggggggcggacaaaaaatccccgcatttggttgtgctgattttgagaattgtttcccttgtatccgattctgagagggattgggattcgggggctgcgggcgaaggcgcaccgcgagggacgaaggcgcccttcgtccgacttgtgacaaccggaaaaatccaaatatttatattagttatagatatggtttagttaagatgaaattcactgcgttaaattcacttggatatatatttggttagaaaatcatgagatataagtaggagtccgatcgtctgaaattagcatgcgagttttttaaagagatttcttatacgattccttctgtatttttaaaagtgaacgaacttaaaaaaatgactcaaatacggacttgtatttccaaaagcga

SEQ ID NO: 11475 - DNA, 1501 bp, Oryza sativa
ttcgcccgcagcccccgaatcccaatccctctcagaatcggatacaagggaaacaattctcaaaatcagcacaaccaaatgcggggattttttgtccgccccccaagaaaagtcccagtcgaaattcatcaagaacacgcatgaaacattccatcaataacacacataacaaaactttcaaccaagaacatatgaatctccaccgacaccattcacagagagagagagaaagagacgacgccgccacctctcccgcccccgtcggaccgcagccgcctccatgccgccggatctggcggaggcgaggtccggcccgccgcccctcccacccccgccgggctgcagccgcctccacaccgccggatctggcggaggcaaggcccgaccggcgttccatgacgtccgccaccaccaccaccgccgcacctccccaccatgcacagagagagagagagaaagaaacgacgccgccgcctctcctgccttcgccggaccacagccgcttccatgccgccagatctggcggaggcgaggtccggcccgccgcccctcccacccccgccgggccgcagccgcctccacgccgccgttgttcggggagagggcgccgccccgtcggttgtgggggagggcgccgccgccgccactcgcgggaagaggggcgccgtcgccgccgctcgggggcgcggaggggagggcggcgatgtgagatgggagggagggaaatgggctagggttttggcggctaaggagagggaggggttttgtttccccgatatcgacgctcggccgtccgatcaaaaccctaaagatcggacgatcggtgtcgtccaggctaaaatcagcccaagagggatcgagagtgaggccatttttccggcccaagcccaggttgtggcctggggaggggagtgcacttgcgcgtgcacaaaaggccgtggaccgaccggcaagggccggaaataagtctattttaggtccctcgggccgaaaaaaatagaataagttcatttttagtgcttattttttcagaagcattacaattataagttattgaatgtgtttatttcaaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtacaacgcacgggcacttttgctagtcataataaaataaatgataattacataaattttttt

SEQ ID NO: 11476 - DNA, 1501 bp, Oryza sativa
tttttacaggaggcggcgctgtacgtgctgagcacgaagccggcggaggaggccatccggatcttcaccgagggcctcaagccggtgcacctcgccgccggctgcggcggcggcggcaggaagagctccacgatggcggcggactcgtcgtcggacgacgacctcgacatcggatgcttccacgatgactacgccggcaagtcgtactgccgccaccatggcggcggccgtcgccgccgtcgccgttcatcttcggccgtcgagaaagacgtcgccacggcgcccttctagttctagctgcttctagaagaaccctttttaccttttttttttttttttttgctttgtttgataagctggccttgtatgtgtttttataccgaacgggccggccggttttgtgttgagctaaaagcggcaaattttggcgtgtagtagtttgaaggccatagagaggcctcggctagaagaagaggcgtgacggtagtgaactgtcgttgcatgtaaatatcagtagctagctagcacgtacgtattgcactgtacattatgaacgcaaagtttttgtttcctttttgctttccctttcgagagaaagatgaatgtttacaattacacatttacgaaagttgactagatattttccaaggaagtgaagtgacgactactgtactgtgaattattccatctctccttttgtctccttccatgacgagtccagtagtagaatgctggtctgacaaccaactgatagttgaatttgagtgtcaagttgtcacaagaacacgaacaatctcgcaagtgtgcgcacggaatgagaaagcctactaatctaactcgggccttaggtttagcatgaaggctctctttcctgtctgtagctttgatagaccgtttccacaaatctaggtaacggcccaatcgaggtctatttcattttgaataagttcacattcggtccacctttactgtctccaagtttgaaataagtctgtaaccaaaatgatataactaagtccctcaatttacaaaaccgagtcatctgagaatatcctagacagtattaaacctgattttagctgttgtggcaagcttagtcatcgtgacactactgggaaagggacattagctagaaactgaaaaaacttcttttagcctacataaattagaattttgaacgggtgtatgtttcattgatataaattagaattttcatattctattcatacttctatggtcttaatgttatgtgagtggtccggagtatgattgggctagaccaagaacggataatacccaacaggcactgttcattgtcttccttagctcaaggcgaaacaaagaggagggaagatgggcgccggtgctccggcgaccaaatgacggtgaggaatgtagtaggacatgtcccacgatatgactcatccatagatgctgaaggttggcaatgaagaaaaccagaacaagagggacactgggggcaacgaggtggtcccgatag

SEQ ID NO: 11477 - DNA, 1501 bp, Oryza sativa
gtagagcccctgcctcatacatcaagaaaccactatgcatggatactgcctccgctcagctatctactccgctaggtctatacccatacaagaagtgcggttgtacgggggtcgtttcatgcttaacttcatggcttggtccttaattgaccggggacggcactagccttttccggacaccacccaaatcctccgtccgccccagtcgaaaacagttgtttaattttatttctcctttcacaaatcatatcatcaacatcatggtaatgtggcgctcatgtctccacatgccgcatctcaattaccttcccaaaggtaattgcccaagcatatagcatttgataaatatgagtatgcatgattctagaatagcatttctaagcagttgtcataattaactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgccttgctcgtagttctgcgggtcttgatcctcgctcggatccgcaactccctcagggtctaaaagtacgtgcgaagaatttatttgaactcaattagaattcaaatgaaatccaaataaactcaaataaaagtcgaatgcgaatcgatctttctatatcgactacaaagtttgcaaaaccacttcattccaattttaagttcattcatcctaagtctttttgtgatttagaagtacattcctaagaattcaacataattatttagctcttaaataaatctaaatttctaccgcgaattgattacttatagagattaccaaaatattctataattatataaaattttgcaattctacaactaaaagaaacctacaactaaccccaattattttaattttctaaacctccttaatctctccctaattttctatttatttttacttttcttcttttctattcttttttttcttttctttctttcttttcatctctcttctttctttctttttctctccctcccggcttctcccttcctctctctctctcggctcactgcctacccggggcggcggcggcgaccgaacaaggggaggggcggcggcttaccgacggcggcggtagcgacggcggcgcaaggcaggcgacgcacggcgcggcactcggcgcggcgcggcagcaccgagggtggcggcgcggcggcatgaaggcggcggcgcggtggagaggaaagaggggaaaatggaggaagaggaggtggggtggtgtggggtgaaatggtgaccggggaggggatttatagggcgcgaggagaggtggccggccctaatggcgacgcgacggcgcggcgcgtggggctcgaggcggctacggcgatgggcgcgcggcgcggcaggcggtagcggtgacgcgacgggtgggcggcgcggcgcggggctcggc

SEQ ID NO: 11478 - DNA, 1501 bp, Oryza sativa
cggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctaggtttggtttagacctcattgcctatttctttattgatcccgccactgattctagttcatgacaccataagttattcgatgttgatccggccactgattctagttcatgacagcataagttatggatcacatcgataaaaacatatgccggtttagttctcaaccactgtactaattctttagctggtttcaaacaaaataggacaagcatataaagatgcgatggaatttgaaaacatagattgccaagtgccatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcgccgcgcgagagcgagaggaggaggaggaggaggaagccgggatgg

SEQ ID NO: 11479 - DNA, 457 bp, Oryza sativa
attttttccataacaaagatacatgtaaacaacgagatgatgaaaatagtttctccggtaaactgtggtggagaagtggagaaccgaataggccttgcaaagagagagggggaggcgcctggcgtacgtgagcgtggcgtgggcgcgggagagagaacaagtcaaaggatgcgaacgcaacaagacgagcaccagcagcatggtcaggacgacacaacacaactagtctcctcgactactcgtctctcggtcttccttccctccccctcttcctcctcttgctcttcccttccaattccaatcccgcgcgccgatccgatccattcccaccaccaccaccgtcgtctccctcactccaacctccgccacctgcgaaacctaagcttgctgctccgccgacgaggctgatacgtgctgagatactactagtagcacctgtacgtctaagctagagcta

SEQ ID NO: 11480 - DNA, 1501 bp, Oryza sativa; identical to SEQ ID NO: 9771

SEQ ID NO: 11481 - DNA, 1501 bp, Oryza sativa
catacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggcttta

SEQ ID NO: 11482 - DNA, 1501 bp, Oryza sativa
agtatccgatgtacatctcgcggaggcgggtgaggcgggagagggagacggggacatggccggagagcgtgttgccgttgagtccaaggtactcgagcgcggcgaggtcgccatagctgtccgggattgcgccggtgaagtagttgccgccgaggtggaggtagcggaggcgagcgtgtgaagcggagaagggaggaagcaaccctgagaggttgttgttgtaagcgtcgatgagctcgagcgaggggaagtagggggaggcgccaccgccggagtcggggacggggaagtggccggaaaggttgttgttggagaggttgaggtggcggagagaggggagggtggggagctcgagggggacgtggccggggaggcagcaggcggcgatggtgaggttggcgagggagtcaaggagggcgatctcgggcgggaggtacccggagtggagcgggagggcggtgaggttgatggcgacgacgcgggagcggccgtcgcaggtgacgccggagaaggtgcagtgcgcgggggaggtcgcggccgggtcccagtcggcgaacggcggtggggcggtgccggagggggatggaacgagcgccgccttgagcttggcgagcgcgtagatgtcgcggtcgggggaggcgagggagggtgggaggaggaggaggaggaggaggagagtaggaggcattgtgaaatgcgatggtgagagggggaggggaagaaggcggggtggtggcgggaataaaaggaaggcgggcgcgcggcctgcaggctgcaaggaatggagcagaagcagaagcagaagcagaagctgtgggagtcactgacggcgttaggttggcgtggtcaatgcggcatgtacagataccagaggacgacgacgacgaggcggagactgacagaccgggcgcggagacgatgggacgggacgagatggccggagacgtgtgtggcagacacacacacacacagagccttcccttcttcccttcctccattgattgatcgcgggctgctgggctgctgccaccaggggcggctactagcctttctgctgtttaccaggagtacgtttgaactagtaggggtgtatagttcataccaaaattaaaagtttagttgaaattaaaacaatgtgatgaaaaatttgaaagtttatgtatataggtaagtttttatgtgatggaaaagttgaaagtttgaagaaaaactttggatctaaacttggcttagtattagtctagcacggagatcatcttcgcccttggttaggtggtgtttggatctagggatttaacttcagtctatgtatttagacactaattcatagtgttaaatatagactatttacaaaactaattacataaaatgaaagataatttgcgagacaaattttttaagcttaattaatctataattagagaatgtttactgtagcatcacataggctaactatggattaattaggctcaatagattcgtctcgtgaattagtctaaga

SEQ ID NO: 11483 - DNA, 1501 bp, Oryza sativa; identical to SEQ ID NO: 6189

SEQ ID NO: 11484 - DNA, 1501 bp, Oryza sativa
actggggcttaggcggtctcacaaccggtctaggctcttcagccagccttgagttcagcccaagtagtaaataaatgtatcaatggatcctcgcaaaaaaaaagtatcaatagaataacggtttgatattgaaacaaaaatactcctcgtaaatttttttatatttggcactattgatgttttaacataaatttgaccattcattttattattaaaaatatgtaattatcatttaatttatcgtgatttattttaaaaaaattaaataagataaataatggacaatgtagtaaaaaaaatgaaaggaaatatcaatgtaggacagtacagtaaaggtacgtcggtcggtcggtgcagagtataaagcaaggagcgaaaatatctgtgtggcttcgtacctgcaggggacgggcttctgccgtgtctggacacgatgggcctcccctgcattgcatgatttatttatttattgatccattaaattttaccccactcttccacttgctatttatattaatttactccaatttatatactccacgacaggagcgagctgagaaccctaattactactgcatccgttccagaaaaaaaaataattttacatcgttcatcttcaacatttgatcattcttttatttaaaaaaaattatgattaatattttctattgtagatgatgaaatataaagggtactttatgtgtcaataatttttaaaaaaaattataaattttttaaataatacggacgactaattgttggatataaaacttacaactacatttaaaatgtgggggaggtagtacttaattactgcccggaagatccacgatgcacattgcgaatatctagctattccagctgatgaatgcgtgatacatattgtatctgatgagactgttgagtgatgaagctgaagctagctgatgccgatgctgatgctgagcaatctccaatctccccacggggagagattagcccaaccaaacctaaccatgctcttcttcttctcctcctcgtcgatgagtatttagtccatctccttaaatgcagcggtgcgagttagttggcgccataaattccttcacttcaatttcttcctagctcagctttcccctcttctccttctcctcctactacccaatacgactactactagttttctttcttggccatcatcatttgttcctcatcttactctagcttctccattccaaaattcaccaccgccggcgccgccatctccattccaaaatttgctctgcgtcgagtcgtgtgatcgatcgatcgatcgaggtgtacgtgtgcgctgctggggaaaagggaaatggatccgtcgggcgccttcttccacgcggctccccggagcggctcgaatgtgtcgctggcgtcgctggcgaggacggccggagggaggaggatgatgcacagggtcttccgcggcgtcatcaccttcatcttcgccataggtcgctaattaatctctctcttgctattcaat

SEQ ID NO: 11485 - DNA, 1501 bp, Oryza sativa
aggataaaagtcaattgtgtggggtgttaattgacagtcccctctcctccaagggggccatggtatttatacccataggtatccctttgtccaagtggacttagggaaccaaatatggatccaatcgaggaagtcattgttgtttccatgaaaaattctggttgtctttctttatccggaactccctcgaggtcagttcccgtataagacatgatatgtggtggatcctgccgagatttagttacctattattaggtatgtggtatccatacccctgacagtagcccccgacttcaatgcaaatgaacgaattcatattctcgaccgctaaccatggaataactgttatcgagctcaagtgaccgttctcggtgagttcagagataacgttagacttcttttgtcagcctcgggaggacacctaaagggtttgtctgagtcaatctccgacgtcaaccaagaaagtacagagcatatgactaagtctcctgtcttgctataatcgagaatttggattgaagtcaagaaattttatctcggcgggtacaccatctcttcattccgtattccttgtcgagatccaccaactgttctcgagcaatcgagaaggcgtagaatctgcgacgaagccttgtcaacatttgtcgtactcgccttagtcgatcttggtgtacaaccatagagacatggagtcttcgataatgtcgaatagaattttcctgaaatcaatactcagaaaagaatattagatagaaatagcccccgagtgaacgctcaaagggtaacatgttataatatgtatggaaaaccgaaaatgaattaaacttacagaccaatgttttgtatatgagcgtctactcttttaccgacttcgatcagtcagtttgttgagttatacactctccctagcccccagccttgtcatcggagaatcgttctcggaagatatggctcctggacctttgacctgcctcggttgaacaagcactgatcctagcccccagccgtgaagttggaaaatccaatttccgattacacggcttggttaatacgcacggtgagaactcttacacaaccatatcttacatggtctttcatctctgaaggatccgacaaggccttatcggctctgggcatccccagccgaagttcccttaggttcctcagaggccttggcaagacggcgtaaagggacattcggataggtttcaactctaggtgtcatcgaggtaagggatctcagggtaaaacacctggtgatattgggtacctgatatcaaactttgtgaagtagaggtaatgggagaatcgctacacctctggtcgaggaccaggtagtagtcgtaacccgaccacttgaagtggaaatagtgggagaatcgctacaccgctggtcgagaacagctagtagtcgtaactcaaccactataagtaaatgtacgagagatcgctacgattgactggttgagaaccagtgaataggtgtctctcgatcatttga

SEQ ID NO: 11486 - DNA, 1416 bp, Oryza sativa
  unsure (1)..(1416): unsure at all n locations
accgaacgtcgactggatataaangantgtacggtatatctatcaattacccgatctcatnaatatannngacgcgtntnnnaaacattntttcaattctcctatctgtataccnnccnccccccccccagtgggcntttggtttgactttcaattgcacagnaccncatcacgttgcgaagtgttagtttattacgtacatggtggcagcttcgcgcaccagtcgtcgacgcacttgtggtagcaaacggccggcacgtccttgaagcagttgccgaggcactgcttcttgcacttgtagtcatcgtcgagcccgacggcggcggcgccggcggtggcgttggccttggcattggccttgtcgtcgtcgtcgtcgtcgtggcggtgacagcacttgctcatgcaggaggagtagcacttccagtccgtgtggccgtcgtcgacgtccgccgctgcagcctcgccggagcttgatgagctcaagctgccgtcaggaggccaggactaatcgacacaagaattcagatacaattaatcagtaaatttggtcttaatgtggacaaccaattaatttgtcggggtgtcggtacgtaccttggcaccaaggtagcctcggccatgcgcgctcgccgcggcgaagagcggcgccgccgccacggcgaggaggaggacggcgaccgccgccgctctggaggccatcgccgcagctagctagctgctcgctcggtgaggtgtgaacgggttggctttgcttcggtgaggagagcgcggtatatatagccgcgcgcattagcgcttgcattgcacgcgcgccgcgccggcggcgaggaggagggggtcacgcgttccgggtgcgcgcgagggcgtgggcgatggcgagggctccgggattcgacgccgtgcacggaatgttcgaaaactgaattcgtttcgagcgatcggagagacagagaggtgcagctgggcatgcagcttgcgaattcacgcttttgttcgcgtcgcggcgtcgcgcggggaacagattcgcgtgcgtcgctcgcgcgggtaatcgatctctcttcgtggtcagctgatcagttcgaatcgattaaatccagtttgttttgatctgtcatgatgagagaacacttacacaagaaagcaccaagcagcccatacagaatcattaaacattttcgtttatggtattcggtctgacagaagtagctagggatcaaggcagtaatccgtgttcaagtgacagtaactgggcacttaattagttttccaccgtgttgattaatccatgtcagtacttagtagatcagccgcatggtaatttgtatggcagataatcagcgagaaacaaacgtcatagttgactcaagacaagactgttaattcgattcgatcgaacggcggtatgtatatatacct

SEQ ID NO: 11487 - DNA, 1501 bp, Oryza sativa
tcccgtgagctgaagtatcgatgtatcacgttataattatatatcttactgtaaaaagtactccctccgtttcacaatgtaagttattctagtatttctcacattcatattgatattaatgaatctagattaatataaacatgtacatatataggagttttttttagtgctacatacatttttttatttcatctattctatcagctgatgtttttgccaaaattgtctttgtccaacgcgcgattagttgattaaatcaaaatctgtgacccctcttttctttcatggcaggtcagattccgataagaacgcagccacataatataatgatgtgtgcacctcatgatctcaaggggcaagatatgcacaaagattttctaacgatatcttattggtagcgatgcatgcctgcatagtctaatttggagccaaaaaggtcatccatggatggcaccgtgtacctaagatacaacaaagagatgacgttcacaagttgtacaactgataggagtagtagtagactggtcagagaggaggagctgggcaagctaggcaaggccagtcacatcttcatcacgtggacagcttgttcatgttcgatcagtccagcataagcgtccaaagcttaacttttcgggcaattaaattagtagtcggcatcaacgtgcgtcataccatagtcatatgttaggtaactactctctcggttcttgacctagaaatgtagctacatcttagaatggacgagacatatattgaattgaatcgtgaggatgctaaaaataattcggagtagctagctagctagatcgaacttctgtttgtgtttgtaactacttcgttttagcatgtcattataggtcgaagtgtcgaacaaaagaaaagtttatctctataacatgtagaccacaggtgtatggcatactaccaaacattattgagctaataagctgatcaaatcattgatctgacacgaaatcgtagcacaacgtggctaccaaacatatatactatcccctttgtcccaataaatttatttttggttcctttccatttatctcaaagcaagtttatttttagaaactattatattagagtttataaaaatagagaataattatatattgggagtaaataaaataagaaataattgtactgtgatttaaagtaaagatattttatcctcttcatttaaatttgtactaatatataggtataagataggtcaatattaaacttattttgagacgaaggaacacaccctttataggcgaccacgacgcacaactacaccacaagcagctgatagcccacccagccatatcaggccgaccgccgcgccgcctgtcgcgtcaagcttatagctacgcgacgccgccgttgctgctgcattctctcttctcagtcttctctccactccctccgcgccgcccctcgccccctcctccctcgcagtcgcagcctcgcgtacgtaccgttgctgtgtttgcacgtacggcga

SEQ ID NO: 11488 - DNA, 1501 bp, Oryza sativa
ctctcggttcttgacctagaaatgtagctacatcttagaatggacgagacatatattgaattgaatcgtgaggatgctaaaaataattcggagtagctagctagctagatcgaacttctgtttgtgtttgtaactacttcgttttagcatgtcattataggtcgaagtgtcgaacaaaagaaaagtttatctctataacatgtagaccacaggtgtatggcatactaccaaacattattgagctaataagctgatcaaatcattgatctgacacgaaatcgtagcacaacgtggctaccaaacatatatactatcccctttgtcccaataaatttatttttggttcctttccatttatctcaaagcaagtttatttttagaaactattatattagagtttataaaaatagagaataattatatattgggagtaaataaaataagaaataattgtactgtgatttaaagtaaagatattttatcctcttcatttaaatttgtactaatatataggtataagataggtcaatattaaacttattttgagacgaaggaacacaccctttataggcgaccacgacgcacaactacaccacaagcagctgatagcccacccagccatatcaggccgaccgccgcgccgcctgtcgcgtcaagcttatagctacgcgacgccgccgttgctgctgcattctctcttctcagtcttctctccactccctccgcgccgcccctcgccccctcctccctcgcagtcgcagcctcgcgtacgtaccgttgctgtgtttgcacgtacggcgatgcgcgccgttggcgccttgcttgctgctgcatcttgcctgccggccccgcgcgcgcccacctgccccaccacctgctgcatgctgcgtctaccgcgcgccacggtgacgcaccggcttgcgcaacaacgctcctcgcgatgcgtacgcacaagtgatgtggctgccgcgtacgtgcgtgcagcgtgcgctctgctgctttcagacgacgagtcgatcgatcgatcagcagcgtacggcacgcgcgccggcgcacgcaatcctcaacagggccggcaagcggattgcaagttgtcagattttgggataactgcaggcacaaaagatttataacgggattggagattttgagcacacatttgatactccgtatcatctttgtgtgcaggtgcaggtgcagtcggcagtcgcatcgatcagttgcttaagagtcataaattaaacgtcgggccgggcaggaggattacttgcacatttttagctcgatgtgaggatccagccaaggaaaaggacatggtgtagacgtgcacgtgcaaagaatcgagggacatttattcggcggcgatcacgcgacgaaattagacgtcaattggacaagatatatctttctccttcgagattttcgatctgcttaattgaccaacgcactcgctattcatcgtgtgactgaaattagaagaagtttcagtcatatttttctt

SEQ ID NO: 11489 - DNA, 1501 bp, Oryza sativa
cttattcgcagttctactaccgttaccaggcccctttttgggccgttcggcccactacaccccaatgtattgtcgtgggccgtgagaccaaccggatcagagaagcgtgctgcggtcagcgtcacaccgaaaccatgacctacacggctacacgcgcgcacgccccgcctcgcctccgcttttctttcatagcttcgtccatccatggcgcagccgtatcatcctcagtcctcgctaagctagctgcctccatgcctgtgacaagggagatcatcgccggagccggagccggatcggcggcggcggcggcggctgtactggcgttgctggtcgcggccgccggcggtgacgaattagcggcggcggtgggtagcagcagcagcatcatgccgccctgcttccacgcgtgcttcgaccagtgcgtgcagcgcgaggagtactggttctgccagttctcctgctaccgccggtgcggcgccggcgccatcgccatcgccatcgccgccggccgcttctccggcaccggcgactgcgagcacgcgtgcgcgctgtccatgtgcggccagatcgacccgggcagcaagatgatggccgtgtgccgcgacacgtgcggcaagagctacgccgccgccgggtgccgccgccggccgaccagccttacggcggcagtgtgattcaatatttcgaccgcgacaaacaggattgccttaagcatgacgaacatctcgaattaattctcgatatgatgttaaaacacaaatccatgcacaacatattaacacaaatccatgtataataatactcttgagatggctaaattattgtcggagttgtgctccaatttgtaataacgcaattaattacgcaaggtatatatacataccgccgttcgatcgaatcgaattaacagtcttgtcttgagtcaactatgacgtttgtttctcgctgattatctgccatacaaattaccatgcggctgatctactaagtactgacatggattaatcaacacggtggaaaactaattaagtgcccagttactgtcacttgaacacggattactgccttgatccctagctacttctgtcagaccgaataccataaacgaaaatgtttaatgattctgtatgggctgcttggtgctttcttgtgtaagtgttctctcatcatgacagatcaaaacaaactggatttaatcgattcgaactgatcagctgaccacgaagagagatcgattacccgcgcgagcgacgcacgcgaatctgttccccgcgcgacgccgcgacgcgaacaaaagcgtgaattcgcaagctgcatgcccagctgcacctctctgtctctccgatcgctcgaaacgaattcagttttcgaacattccgtgcacggcgtcgaatcccggagccctcgccatcgcccacgccctcgcgcgcacccggaacgcgtgaccccctcctcctcgccgccggcgcggcgcgcgtgcaatgcaagcgctaatgcgcgc

SEQ ID NO: 11490 - DNA, 1501 bp, Oryza sativa; identical to SEQ ID NO: 5825

SEQ ID NO: 11491 - DNA, 1501 bp, Oryza sativa
ttgggcgcagggggcggtgtgctcgcgggcggctcgccggggcctacagctgctgctcaggggaggggagtgtggcgctgcggccgtgcggcgtgccgcctcgagcccgcgacggcgaggtagggcagcggcagcgctgcggcggcaccctgcgcggctggcggccgggctagcggctgcgccgagtgacgagtcgggggcgtgacgactgacgagtcgggggcgtggcgtagggttggccttgcccttgatggcctgatgggctgcgaactggtgggccgtgggctgcgctgccgcgggatatgtcggtttaatcggttgttcggttcggtttctctataaaaccgccgccgcgggatatgtcggtttaatcggttgttcggttcggtttctctataaaaccgaagctgaagccgtacaccgaatagcacaaaaacagaaaccgaactgacaaccgaaaaccgaaaaaaccaacaattcggtttggttcggtgcggttcggtttgcggtttgcggctaaaaaatgcccaggctgacctcaagctaccttagatccaaacgtcttcttactgtttcttttttttttttaccatacaacaattttgcaaactctaaatattcttccctctaaatattcttcccccaccatttcctttatccttgaccgctatctgtttgaaataaaatataaatatcaaaaaatgatgcaccatcaaaatactttgcatggtaaatataacaatacttatcaaaacatcattaaaaattcttactgctcaactagaaaatctcattggattaaaaaaaaagctaacgaataaagcatcagccattttgaatatatatatctttcgtttcaaatacgaactaaataattcctataaaaaacctgataatatttgtatgctatagaggatcgatgaatagtactaatgggatataaaatatccagcgtgccacgcgccattttctaatcataatgttagaacaagctcgaaattgttacaactcacatgcaaattaaatgccatcgactagtgaactttggtttagtgatcgtgctagtctgcaaattaagctgcatttttgttaatatctcgatggaaggatggcagccacgacgacagcaacgccgaacatgaggatggcgagaccggtgaagttgacgacgaacgcttcgctcggatagccgtggaaggggaagatgaagcgtgctatgccggtctcggcggtgcagatggccatgaggaagatgacgatgcccaacaaaatgtgccatggcgcgtagtcagccctcatcgtcatcaccgcccccgggaatacaaagtagacaaaacccaccagccactgcaaataattttagtcaccggatttagtgaaatacaaccgcctcaccatttcgcttaatacttattataagcggaaacagcttatcaacggtcaaaaaaattgtgaatttagtttaaaaaaattgtgaataaatcttttatatacgtgttat

SEQ ID NO: 11492 - DNA, 1501 bp, Oryza sativa
tacaaaatagagttttatgcatccagatatatatctgtgaggctaccaatagcaccatcccaccatctaagcctacaggaagaccatctaacttaagtcctattagcatcctcaaaataaacaataccaatttgacacctaagctacaaagaaagaagagacaacataacatttcagaacaggtgttacaataactagaacagaaaacatgagctctagacatcttgatgtttttttccccagcttttagccttctgttgctgcccctccatccaaattttgagttttattgcgagacaattatcctgttactacacgatgatcgttttgttactgcgcaattcctgctagacccctgctagacaaaaacaacaaagaggtggatgaggggggaaagtgagtaggcgggttagaccggggtcggaccatcgggaggacgctttaaccgccctttaaccgaggtgggaggtgggttttgggtcttaggaagggtgagggaggtggggttggcccatggaaggtaaggtcgaagaattcgtgcagtagcttgtacaaagagtatgcagtcacataatgtgagacgtctcactatcgtagggtacgtcacctgtcatctaccaataaaacaataattagctataaatacgagtacccgtgtctagtttttgatttgaacccggtagacagattccaccacaaggaacctaaccagttgagttaagctcacttcaccacataatatcagtttttaacgatgcttagtatgtagaacaatggcgggaagcaaagacgatgggtgcctgggaacagacagcgaggagcaatgctggtgccttgccttgaggttggcaaggatttggatcatctgactttacatgtgtgaagttagagagctacagtgatgtgattttgggagtatttttagccgtccgattcacagcggacgaatgaaatcgatcgctaccctaactatgtacagtatgtatgttcactgtcttgcaccgttactacagaaatacacttagaatcattgtttttgtcacaccctgaaaatcgctaaattataaattgttgtgagaaagaaatttttaaaatttatttgatgattaaagtaagtgtgtgaataaaatctatgaaaaatttgaacattaacttgagctagataaaatttcattaaatacttggtctgcccaagtattttcaggatttttcttggatttatttgagcactggaagtatttttaataaatgagatatcatttcagtatttatttaaattaaaaagtaatttaattcctcttctttgcccgggccgaactcagcccactcctcttctctctcttccttagcctgcagcagcccactcttcctctttctcttagctgaagtccagttttggtccttcttgcaattaggcctagtaaagaaaaggaagcccgaaaagaagtctgttttgcctccctatgctacagtgtcgcccctaacctccagccggttgatc

SEQ ID NO: 11493 - DNA, 1501 bp, Oryza sativa
tgggcataatgatcttgtatacgattgctctatgtcatgacgatgatattagagtagtatttggtaatttaagcgtgttgtttagattactagatatcgttatttggggttatatgctgcgggtatgtcgaggtggggcgctgatggtgacagctcagtacaggtattcctctccgtgcgtgtatataatcctaagtgactttcctgaggagggtactcatccgtatttagccccggttggatggtcatgatgggttgtcgtaaggaactcggcaatcaggggtggcttatcaaagcaccaggagggcattggaaatgtggtattgactaaataatcatataactaggatatatatataatgtgtatgtatattacaagggtaggaatagattctttttactttctttccacttagcttagatgatttattatgagagtatataattctcgtgctgtatgtcactctaccctattcattatcttaacccctgcttagactttgattattacaagtaatatataagttattagtatagttttctctattataatctttccacagtattaaataaatacgatacccttagaatactctcgggtgaaatgctaaaatggtatatccgtgcgcttgcggatgaaatgtgtaaccataatatagcacaagtgtttctgggtcattgttgggaattatatttctagtaatgtcatgaagaaataccaacactagcttaattaccctcaacgcacatgtcccttctaataaaatttccagctttactcgatctgaaccgtgcatcatgtcacaaataattgatatttgttgaagattaatttgcaaaatttgtgaattaagcaagattttttttttcaaatcttgcacctcatcgctgctagttctcaagcaggcatcgccgattactgttgctcaacaccttgcaggagcagctcgccaacagtgagtgctacggtccggtggcgagtgctagggtaaaacatggcggacatcctcaccggggagcccactattcgatgacttgtcagaggaggtgatgctcaaggagatggccaacatgcgcgagaccggttcgagtccacgaggacaaagctattagaccttagacgagctgccggagctgtcggcggacaggctgggacccgcttgaaagtcgatcgatgtggccgggtccagctcagatgatgacatggaatacgtggggcacactaggaaaaaaaaccaaatatgtcacacaagtcatcaactgttcgagtaggaagttaggaacaggactaccctgttacccttgacttgcttataccaaccgggcctcaccgtcttgccgtcgtgctcaccccgcaacctctctgtcagccgtcaccaccatccctagcgactgatggaagcttagggatggtaatttccccgttgggggcagggacccgcccctttggggacggggacggggctgcttttcgacccgtgggttgggcggggacggggcc

SEQ ID NO: 11494 - DNA, 1501 bp, Oryza sativa
attcacattgcaaatccctcttttgtgtcgacttaaggtgagagagtgtaccacattggatggagttcctataaagcaactcgtttcacaatgcatgctattttaatgggtcccacgagcttttcacctcccctctctctcctctcttcctttccccatcgcggaggaagcctcgtcgccgtcagccaagtccacgtcggcttcgctctccctgccctctacaccggtgccgctctgctcccttccaccgccggcgtccttctccctgccctctgcatggacgacagcgccatcgaactcactaggtccggcctagggctcacctgatctggtctcggcagcagtagcagcacggcggcggcggcatcggtagcttgatggataggatggcgtgtggatggcgcacccgctccactttgtcctctcgtttccctcctcaccacagcggtggtgcaaattgaggctacaccccaaatcccctgcctcactcccacaccagcgacaagctccaccgacgtctctcccctctcccctctcatgtggcaacgagcttggcgccaccttgatgcagacgggggccttgattgtcggatctggtcaggcaaatcggcgagtcgatgagctcctcagcagtggggcgaagagaagggttgctaccgccatcgagcacctctacgctggtccatggcaggagctcctctctctctctcctttttttacgcttcctctcttttgttttctgtcacctataacaacgccacccgttctctccgagggagcgaggagcatgctgttgagctgtgatccaaattcatttgcacttaataaaatacagcttctgccttagcgaagcggaggcccgtcgccggaggcttgggccggagcccccacggtacggatcgtcattccttttaggtttccaccatatatatacctcttgtaagccgccgtgtggcgttgtatcctcacccccgatatagtgaagatattttgctggttgacgctcgtggtttttctctcctactttgggagggtttttcacgttaaatctcgtgtcttctgtaattgatctgttgttttttatcgtaggaacttgacatgtaggtggtaggctggggctgaatatcacctaagacatgtttggttgtagttgtagattttagaaaataaactagaagccagaagatgaaaaatccagtttctctatatttttagaagctggctaccatccagctacttctcataatcttaaacttcgtaaactgggattttcagaagcactgtgaatagcctaaaaagtcgccacgatttggatgggacgtccaggcatccggaagcatggcgtacaagatggggtacctttaaatcggagactgactgagtgaaggttggttggttcacacttcacacacatctttttcgaccaactgaagtactactagttaataatctgcctttttaagggagaccggcacgcaggcccggcaatacctacgtactg

SEQ ID NO: 11495 - DNA, 1501 bp, Oryza sativa
ttaacatctattcccctgcaagtttggataagtaaccttagatccttggaggatttgcgtttttgtgggtgtagctccctcacatccataggtgtgtctgaggctgtgtttagatccaaagtttggattcaaacttcagtcattttccatcacatcaacctgttatacacacacaatttttcagtcacatcatctccaattttaaccaaaatctaaactttggatccaactaaacacagcctgaggcaagcagcaggcgcactgtcggagtattttcatccctttcaaatgtcatcatttcttcatgtgatgcactgttgagtcttgatgagtttcttatgcccgcttatatgcctgtggtgaaagaccatttaggtaaaatattgcaaaaaaatggcattactgccggttgatgacctccatagcttttcccacttggaggagctatgtattgagggctgtcccaagttgaatatgcagaggagaatgacattaccatcctctcttcggaagctctgcttagtcgactgtccaagcatagagtgcatagacaacagccatctggggagttctatgacactcaagggactcatccttcgacttaatagctgtccagacctcatctctattgttggtgctatatctgtctctgaaataaagtcaggttatataaatgattgccccaagctgatggagataatacagcctttcaaaagatatcacgactggtacgtgctacggaaccacacttgatagctcttttttttctgttaaaactggttatctccatctatcatagagtaatctcattaactttttgatatttttttgtacgacttattattaagctcacagcaaattgccgtgctagaagtgctctccttccttatcataaattgtgttgtactccctccgtttcaaaatatttgacgccgttgactttttagcacatatttgactgtttgtcttattaaaaaaatttataaaatatgtaaaactatatgtgtacatgaaagtatatttaacaatgaatcaaatgatatgaaaagaataaataattacttaaattttttgaataagacgaatggtcaaacacgtacttaaaaagtcaacagtgtcaaacattttgaaacggagggagtacttgtagactcgaccaaatctcataattggtactccctccatcctaaaatataacaacttttagccatcaggatttgctaaaatatagcaacttctccaccaacattctcttcccaaccaattataactttccaccattcatgttttccgcctatctccactactcatccaatcacaatcctccaccagttacttctacctacttttttaataaccgtgtccaaccctaaaacttcttagaggcttctccggtccagcgttctgtacctcgaggtacatgtaacgtgaggtaccgattacaatccaaccgttgatctctagaggggtacgatgggtagtgaacgaagagaaactcagc

SEQ ID NO: 11496 - DNA, 1501 bp, Oryza sativa
caatccacggagcggtggaacatggaggtgtcaccacgccgatgcaccacgtcgcgaggcaggcgccgaggcgtcgggagcccagacccagctggccctggttgattgccacccgtccccttcgccctgttcgtgtcggtggccagcctatgcgcgtcgctgagtttctcttcgttcactacccatcgtacccctctagagatcaacggttggattgtaatcggtacctcacgttacatgtacctcgaggtacagaacgctggaccggagaagcctctaagaagttttagggttggacacggttattaaaaaagtaggtagaagtaactggtggaggattgtgattggatgagtagtggagataggcggaaaacatgaatggtggaaagttataattggttgggaagagaatgttggtggagaagttgctatattttagcaaatcctgatggctaaaagttgttatattttaggatggagggagtaccaattatgagatttggtcgagtctacaagtactccctccgtttcaaaatgtttgacactgttgactttttaagtacgtgtttgaccattcgtcttattcaaaaaatttaagtaattatttattcttttcatatcatttgattcattgttaaatatactttcatgtacacatatagttttacatattttataaatttttttaataagacaaacagtcaaatatgtgctaaaaagtcaacggcgtcaaatattttgaaacggagggagtacaacacaatttatgataaggaaggagagcacttctagcacggcaatttgctgtgagcttaataataagtcgtacaaaaaaatatcaaaaagttaatgagattactctatgatagatggagataaccagttttaacagaaaaaaaagagctatcaagtgtggttccgtagcacgtaccagtcgtgatatcttttgaaaggctgtattatctccatcagcttggggcaatcatttatataacctgactttatttcagagacagatatagcaccaacaatagagatgaggtctggacagctattaagtcgaaggatgagtcccttgagtgtcatagaactccccagatggctgttgtctatgcactctatgcttggacagtcgactaagcagagcttccgaagagaggatggtaatgtcattctcctctgcatattcaacttgggacagccctcaatacatagctcctccaagtgggaaaagctatggaggtcatcaaccggcagtaatgccatttttttgcaatattttacctaaatggtctttcaccacaggcatataagcgggcataagaaactcatcaagactcaacagtgcatcacatgaagaaatgatgacatttgaaagggatgaaaatactccgacagtgcgcctgctgcttgcctcaggctgtgtttagttggatccaaagtttagattttggttaaaattggagatgatgtgactgaaaaattgtgtgtgtataacagg

SEQ ID NO: 11497 - DNA, 1501 bp, Oryza sativa
tgattcattgttaaatatactttaatgtacacatatagttttacatattttacaatttttttttaataagacgaacggtcaaacatgtgctaaaaagtcaacagtgtcaaacattttgaaacggagggaatatatattttttgaaatatcataagaaaacaattaagtatcattatagagactgttgatgctgtaaacaacgtacggaggagggagtacgtaccgcagatgaaggcaggcatgcatggctgcgcccctgaaccatacatgcagaaactgataaactggccaagcaatcaattatccccgcattatgtttgatatacgatcgaaagcccagcccaggcaccccctgacttatattaatcgatcgccgcatgcacccatgtcagcaagtttcacagtttgacactcctcatttcgtcgtcggtcgcagccatcggccggtcatggtcacacgaacagactgcctaacattatacagggaaattgatttcatccgataccctctcgtttcgtatatgccacctgaatattcactaaaagaatacaaaagaagttagcaacatatattaatatgaaatatatcactccacaaatatgcaggtttaaattcagcttctacaagttgtaacaaaaataacaaatatagttgtgaatgtgcaataattattttcactttaatttgttatttttgttgcaacttgtagaagttaaatttggtcttgcgtgtttgtataatgatatatttcttattaatctatattatcaatttttttaattttttataactatttagatgatatgcaaacaacgaggatgccctctcgagtgatgaaaatccacatcccattatacaagactgtggtatttcctctgagtgtatatatgatgctattagaaaaaagaatagaatactagtacactaagaatcttttgtttcagtttgaacgacgtagtacctctgtaactatataatttcgtgccagatcgaaactatgtgatattggaaacgttatttcagttgatccttttattagcgggagtcgttgaaaatctatcccatcactctttcatattttccccccttctttttaatttacttctaaaacctcatggttgcatgcccatgggtagagactctactagtgagataatccaattcaattacttagagaaaaaaacggggtcacacggtcacaggcagccaccccgcttgcatccttccctctacctacctacctcacctcaacaccttacctcgtcttcctcctccatcttctcccctcacgactcctccaacgccctcctccccacgccacttcaccccctccctatatatacccacatccatctcctccatctcaccaaaccaacacaccaacctagctaactcactcactcactccttcttcttgcgacctagctatcgagctagagcttccaaaaccctagctagctagctgagacagttagtttcatctcgaactagttgttgata

SEQ ID NO: 11498 - DNA, 1501 bp, Oryza sativa
ctcatgaatccatgcaattaatctcacacatgcttatgcatgctccccaatccatgaacaacttcaatatattcctttctcaaaaccaaaaaaaaaaaaagactataccattcatcaaacggacacaatagcacatgcatatgttaagtacaacacgtctagaacacgtacgtatatgaacatgcatatgttgacttgccatatatgcatgtgcagttgtgcaccttaatttagcctactggccggatgtcttaaaaactaatctaatggcagtagatgtagggtgcacatgcatgcacttgtgttgtaattagataagttttttttttcacaatgcacgctaccttgatcaagggatgcatccatgcgatgcgaggagtaattgtagtacacattgttcgtacattacacatacacagggaatagattttgcttaatagaagctatttaggacaatagtaatatatatagaaaactataaaaaccaccacataagtcacttggaggttggcattccaatatctataagttattttgttacaaaacccacccctacttaatttcactccaaaaaccatctctagtcgcacatgcttattaatagaatcagcatattattgctgatgtagagttaccacgtgctaagctatcgaattagtatgattatttcaagcatttttcatatagaacttgctaaaaaaaatcaaactgttcaatatagtttaaaaatgtgcgtgcgaaaaacgtaaaaaaaagagcgtacaaaacaaactcactcaaaatatatattagcccaccaatcgcacgacgtcgtactcgctccatcccataaaaaaatcaaacaagtacattctagttaattctagttagtactacgaatctaagcatgcattcgtacttattcataatactggaatatgtcacattcgattttagattcgtattcgaaaaattttctagctccacgagccgctgtggttcggccgagtttagttccaaaatttttcttcaaattttcaacttttccattacatcgaaacttttctgcacacataaacttccaacttttccatcacatggttctaatttcacctaaacttccaattttaccgtgaaccaaacacaccggttgttgtacgttacatctgtcgcgtcagtgctgcacacatgcatgccccacgccatgacatcctcccctctctccctctccctctcacttaccaaccacagctctcaccgcttaaacgcccgcctcgccacgccgcttctcgcccttcctcttcctccttcacagctatataaaccccatctatcccctcccacctcccaccaccatctccactccatcagctagcttagctcagctcaaccacatctcgaactaaccaactaagctaaagctaagctagcttcaccgtcatcctccactgacacatggggagcttggacgccaacccggccgccgcctacgccgcgttcgccgccgacgtcgagcccttcc

SEQ ID NO: 11499 - DNA, 1501 bp, Oryza sativa
acatgagttagaaacttttgaatttttgatcgtccgatccatattgagatgtgttgagattcgtgtacgtgaggagaattaaaaaaaaaatcgagcacacgtgtggcgtacgtgagggagttaaacttacgacgcgacacaacggcgttaattttactacaattatcttatagttatatttcaaagttgaaaagttcttttaaaaaaaatcctgtcaaaagttttttagctagtaaaaaaaatcagcgaaccgacagatatcaaaacccagtacgtcctccgtttcacaatataagtcattctagcatttcccacattcattgttcaagtataaggtaatcatctagataattaatatatatggcgtcacaatcatgcattatttgtgctagataatacgcactccctccgtcccacaaaaatcaatatagtatcagatgtgaaacattatagtattacgaatctggacatacacatgccatgattcatcgttctagaatatatcacatccgatcctagattcttttttatgggacggagggagtatatctaggtgctacttgcctgtattaacatgtacgaatgagtttgataaattgatggctcagctaaggtacgatacagagagctgcgcgctttgcttgctagcttggtaccatcagtgtattcattctgactatatatatcttggtagggctagctgtgactagaacagcatataaatgtatgatgatccaaatgcaagttgatccaattttttgcaacgcatgcatggctaccaaatatttaaattgatcgatcgagaagcagacaaaacaattattaattgcatcacgaggacgtcgaggaacgtctgcaagtttatcgagccatagcttacatgcatgccactactaattaagcttattataatatatcgatgcaatatactattaactccatcttgaaatatactagcaacttacaactaattaaagggatagatttgtattactacgacgtgttattcagtcctcaggctccatttcgtttgtgatgaaggggtaggttcttcctcgatttttgttagcacatattttcaagccaaattttgctacaggacatcgcgacttcatggtttagttctaggacaccgcacgaagtaatttttggaggaagacgctctcaaatgttgcctatttactggtggacaatttccggttgaagaaagagaaatcgcgtgaaattaatgtcaaaaatactcttgggctcacatgtcagctctcctatctctcttcttttctctctctatcttcctccttccagcgtcactctgagaggagaggcagcgtgcggacgaccggcacgggcgtgaaggctgtgcgggcggcatggcgaggcgtagtggcggcgacggtggctcgcggtgacgccgtgcggggtgcgtctggctggggctcacggcggccgtgcgggtggcacggcgaggtgcagtggcacggcggacgtgcagatggcacaa

SEQ ID NO: 11500 - DNA, 1501 bp, Oryza sativa
aactaaaaaaaaggtagacagattatctattgatttcattgcaaaggcagacagatcagtcattcactcatgaatccatgcaattaatctcacacatgcttatgcatgctccccaatccatgaacaacttcaatatattcctttctcaaaaccaaaaaaaaaaaaagactataccattcatcaaacggacacaatagcacatgcatatgttaagtacaacacgtctagaacacgtacgtatatgaacatgcatatgttgacttgccatatatgcatgtgcagttgtgcaccttaatttagcctactggccggatgtcttaaaaactaatctaatggcagtagatgtagggtgcacatgcatgcacttgtgttgtaattagataagttttttttttcacaatgcacgctaccttgatcaagggatgcatccatgcgatgcgaggagtaattgtagtacacattgttcgtacattacacatacacagggaatagattttgcttaatagaagctatttaggacaatagtaatatatatagaaaactataaaaaccaccacataagtcacttggaggttggcattccaatatctataagttattttgttacaaaacccacccctacttaatttcactccaaaaaccatctctagtcgcacatgcttattaatagaatcagcatattattgctgatgtagagttaccacgtgctaagctatcgaattagtatgattatttcaagcatttttcatatagaacttgctaaaaaaaatcaaactgttcaatatagtttaaaaatgtgcgtgcgaaaaacgtaaaaaaaagagcgtacaaaacaaactcactcaaaatatatattagcccaccaatcgcacgacgtcgtactcgctccatcccataaaaaaatcaaacaagtacattctagttaattctagttagtactacgaatctaagcatgcattcgtacttattcataatactggaatatgtcacattcgattttagattcgtattcgaaaaattttctagctccacgagccgctgtggttcggccgagtttagttccaaaatttttcttcaaattttcaacttttccattacatcgaaacttttctgcacacataaacttccaacttttccatcacatggttctaatttcacctaaacttccaattttaccgtgaaccaaacacaccggttgttgtacgttacatctgtcgcgtcagtgctgcacacatgcatgccccacgccatgacatcctcccctctctccctctccctctcacttaccaaccacagctctcaccgcttaaacgcccgcctcgccacgccgcttctcgcccttcctcttcctccttcacagctatataaaccccatctatcccctcccacctcccaccaccatctccactccatcagctagcttagctcagctcaaccacatctcgaactaaccaactaagctaaagctaagctagcttcaccgtcatcctccactgacaca

SEQ ID NO: 11501 - DNA, 1501 bp, Oryza sativa
atcttctgctctaaattatataaaatcatacaacttaaatcctgtggtagtatcagcagctggtttagctggcgccacatcctagtaaaaaaattatggtggggcctaatgtcaacaccatgcacacgaggtcaacgggagggggcgttggctcgtcgtctttgtcagaaacggacggcagctcgtcgacgatgatgccgccaccacccgagttcgacgcggggaacggcatgaatgccagtgccgaggtagatggagtaggaggttctggagctggcgccgatgccctctccactggcgctgacaaccatgacgccgtcaacctcggctcggcgagacgttaggcatgcatgcgggtcgacaccagtcgcggtcatagcctcaccgtccatcatcttcttcatcttcacccgcggaccaactcgaagaggccaactaagaacatcgattcctgcatcaccaatccacacaagctttgcagcttcctggagaggggagggagatctcctctcttctcttgttctgtttcttggactggtccactgtttttgggtggcagtgccattgatctggtgaatatgcagaggctggtctcttgatctgatgatggcgagcacgacatcgacgacgaccgcggtgagcggcgcgtgcacgagggtcaatacctgcggacagaggcggtcaagtgtggtgcggtgcgatggcagcgggggcgttcgccgccgctttcaccgtgaagactcgggtggggttggtggtggctgtgtgtagccgtgcacaaggcgtggttccgggtgcgaaaaagagaagaggaacatgtgagtcccaccatatattatttattgttttttatgttagctgattaggatgccacgtcagctaaaccagctatcgatactttcatgggtgggtcctatgttgcacggttggttttgtatagttcagggatgtcaattaaacaaaactcgactacagttgagggacagaaagtggacttcttcccgacttgtagatgaccactcatggtccaccgacttaagttggttgggccttggcactgttttttgggcctaaccggaccgggcacagactcattgcttatctatctacccctaatcatccgacttgcaccggcggcagaagaggcggagcggaggggatctagggtttccgagggtcgccggcggcgaggaccaccaccgcctaggtgagtcgagttttgcggtggccgtgccctcgcgagaccgacatggaggccgagcggaggagcgaccgcgaaggggactacggtggctggatggcggcgggctcgtcgtcgggggcgatggtgcggcgggagacgaggaggtcggaggtggggttggagaagtcatcgtcgttgccgccgcctttgcccaaggaggcagtcaagattgacaagaagaagacgaagaagaggagtgactacagtatcgaggatattctgaagattcttgatatgagcgaggaggagttggctgta

SEQ ID NO: 11502 - DNA, 983 bp, Oryza sativa
cagcagctgacgggatcagctaggcccgggtggccgattgtaaagttgttggcccgggtggccgtttgaaaagctgttggccgggtgccaatcttgtttcaattctaaagactgatacattgcacatactccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaagagatggtatcagagcacaggcttggccctagggcgaaacccgacgtttaggacgaccctaaggatactaagttcaaaactgcttgcgaaaagctaaggcttcttttggtttccttattttcaatagtttgtttctaaaatggttactgatccttctccctctttcaaaattgtagatggcagtgaactccagcttcagttcccacggttttggtgagggtcaccacgtcgctcagcttcgtgacctcgcccgtttcctcggtttctcgtgtcccgagtacacggggtactccgtggaccgtgttccccctcactg

SEQ ID NO: 11503 - DNA, 231 bp, Oryza sativa
ccggtgctcggcggaggcggtggcagcgtcccgtggaggaggctccggtggcagacgtcaatcgggtgtagcgccagggcgtcgccggtgatcagaggtgggtctcgcgtcatcgacacgaatcagagcaccatgtcgttgatgacatcatccgtctgtccatcacacggatcaaatcaaatcggttcttcgatgattcttgatttcttgattgattggtcgattccgcga

SEQ ID NO: 11504 - DNA, 1501 bp, Oryza sativa
ctaatgacggattaattaggcttaataaattcatctcactgtttattgagggattatgtaattagataccgacgtgacacgctaaaactttacatccctatacctaaccacccccttaatcccttaatcttcatgtttagaagattcgaacgggggatccagtcttcaacttggcacgcacacgtctcaatctgcctctccattaatagccaaacaagctgtgtggcttttctcttgcaacttgcagctgtgctgatgttgctgcattctggtgaactaggctaaaaggcattttgtggtcaggccctgtttagttttacggtgaaaagttttggcgtgtcacatcggatatacggacacacatttaaatattaaatatagtctaataacaaaataaattacatattccgtctgtaaattgcgagacgaatttattaagcctaattaatacttttatcaaatcatggcgcaattaggcttaaaagattcgtcttacaatttacacgcaatctgtgtaattagtttttttatttatatttaatactaaatacatgtgtccaaatattcgatgtgacatgatgaaaagtttttgcgtgaaaactaaacaggacctcatccacattgccatggatacatatcattcatgccatggctagctacctcttgataatagtagaattgtcacgccccgaactagtcccgaccggaactagcccgtgacgctccaatttaacctgttaatcgataccagtcccaggaaatagtgctggtatgacagggagacagaatatcacagcaacagaggtctctttattatagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggagtatgtgcaatgtatcagtctttagaattgaaacaagattggcacccggccaacagcttttcaaacggccacccgggccaacaactttacaatcggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgctcgaacagtttgttaacctctgcagagggggtacactttacccaca

SEQ ID NO: 11505 - DNA, 1501 bp, Oryza sativa; identical to SEQ ID NO: 2356

SEQ ID NO: 11506 - DNA, 1356 bp, Oryza sativa
caacgtggtgtagcgttgatcagtggagattcattattactttaattactcaacagttttactgttttgctcaataaaatgttttacaactgcctttatgcaaatagcctcaaacccctccttgtatccccttgcacgtctgcatcgttggtgtggcttgctgagtacggtggttgtactcagccttgctattattccccctttttcagaagtgtagtgcttctgagctgaagatggagttagaggaccaaggctcagaccccagttgagttttgcctgtggagtggagctgaagccccgctaggttcgcctttttccgctgctgctgcttttgtttcggtgtgaggactaagtgcctcttctgtaagtattttccgtttatttacgtttggaactgtttattacttgtcgttttgtgtaccctggctggtcctggacagggatttaatacacaaaatagtctggaaatttgggctaaatttctgggcgtgacacgggggcggcgggattcgcggcggcggcggcgctagggcgtgggcggggcggcgggagcggcgggaggaaggggatgacgggtgggccctacccgtcagcaaggagaggaggccgaatgggccgcgaggagaggagagggagggggaaggagatgggccgagccggcccaaggggtagaggagggaaaaaaggactttttagagcttttctttttataaaaccattttaactttgtttatttcttaataattattatttgtgctctgaaaattccaccaaaatttatttacgcattttacgcttttaggaaatatacaaaaatcctccaagccttatttgacttttaactttgcaccttttatttgttggaggctttcccacggattttaatgattctaggcataatttagaggatgtattttagagtcgttttgggacgtgacacccagtttataaaattatgttgatttaaattattgcattatcgctttatttaaattcccgcgttatcactgttttatatagccatgcctatttacctttgttatgatcttattattgttattgttattatttccttgttcaccctagaataaacaaaaccccaactagtgcacactctactcatggtaccactagtatgattttaggtagatgcttcgctggttaattaggcaacattaggtggttttacaactctagactttaggatattcatatcacctggacactatggaatggttggattattgtggaattggattcacacctccccctctattcaaaatcctcaaaatggttttagcctgggctcggggtgcatggttttgatagtagcacctcggccatataaggaccggt

SEQ ID NO: 11507 - DNA, 591 bp, Oryza sativa
aaaagtttattcagaatttagtcggcagtcggtcgggaattgtcgggtgatatgcattaggtcgtgtctatgttcggtagggtaagtttatgcgtatcagtatgactatgcatctatttcgtgcattaagttattgtttagtcagttgcattagtgtcttttgtctcggttcgtgaaaaatgttgttctatgcataaaaatcatcatgctcggttatttatttgagtcttcttttgctttgcttaatttggatttgagcatgaattggttcctatcccttgtctactttagatgtcagtcctatccctcgtttgcaagcgccgccccgagcttcagagtcgctgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 11508 - DNA, 1501 bp, Oryza sativa
tgtgtacctcggctgattcctggacgagaattttatgcacaaataagttcggaaatacaagtgaattttcgggcgtgacaacaaatgcatacccttggtttgtaagtagggcgtactggaggtgatggtgttctttgaggagctggaggatcggttggaggtgtttgttcccttatttcgctaacgatgtcggcagcatagtccacgacttctgctacttcatcttccaggaattcctctacatctggatctatgggccgctggtcatccgcagcaactttttgtttattaggtttctttcttgcagccgattttgtccttttcttcttgccagcaataggggctatcggcacacaaggcagaccgtgtagcaacgttgaggtcttggggcatgatagctgatgactggaggagttagaccacccctattaggaaggagtcctggagcatattggatatctatgccactttcactgcgatggggggagaagattctgttgtctgtaaagaaagagatttaaaagttaagattgatgcattggcttaattgacagaattgacaaaggggaaaaattcttacttgagggacagcttcaggaaacagatctgtcaggtacattgaaggtgattgatgtaataaatatttcttccactctatccaccatcggtcaacatcctgcctaaaggtggtcatggaatgttcagcagccgatccgtcatgagtgccgatgttatttctcccctactctagatcttatcggcaaagaacaaactaatctgcagttggcccatgcctagttgccttgcggcacttgtcggatggtagaattcatatgatatctggatatttttgcctcgatgaatgctgacaggaattatgcaagtgctgatggctgttgagaatacctctctagatttctcatattcttcagagttgatctcatcaaagcgaaaatcatttggccattcaaaggtgccaaatccttcatatgcaaaccagattctggcattccttggaaatctatcatagaagttatggaaccattctctgaaaggttcagccgacagcttggatgcggtgctgatatatgttgcttctctaaaggacatacaccggcgtgtggtgatctcttctccatcatcatcaatagttggctcgaaccttgggaatttagcatcttgtaaaggcagccaattagcaaccttcatggtatgtaagttgagccaaatctaaaggagccaccagggacctcctgtgccgattggaagtcctgaggctattttagttattgcagtgttcagagtctgatataaatagcccaggaggtattttccaagagggaattgctttttctccaccaaattctcagctatgtgttgtcagttagcagtaggaccacaacttgagccgcagaataagaatttctcaagccacatcatgaggagggttgcatgttcccttggacctactgatccagtgcccatgtttttggcgaaaaaa

SEQ ID NO: 11509 - DNA, 1501 bp, Oryza sativa
acctctcacaataattatagatgttatacctggtaataatttgctagctccctggtttggagattagatctgtacagccgggtatggttgttcaggatggttgggcctatgcagcatgggtgtgatgttcagtgttgattaaaatttctgataaattactccactgttttacttctcttaaatctttgctaaatgctgcttttgcaaaagagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgacatctgccccgcgtgcaatcaatagggggaattattccccgggatcccctccccctttccccccatttttccctccctctctccctcggattcgtttggaaacccctcccctaacctcgccggaccgtggggctgccgcgtgggccccactcccgtggacccggtccgcgcgcccctcccctcggctgacgcaataaatcctttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgttattattattatttccttgttcaccctagattaaacaaaaccccaactagtggacactctactcatggtaccactagtatgattataggtagatgcttcgcttttaattaggtaacattaggcggttttacaactctagactttgggaatattcatatcacctggacactgtggaattgttggagtattgtggaattggattcacaccgcccccactattcaaaatccccaaaaatggttttaggctgggctcggggcgcatggttttgatagtagcacctcggccatataaggaccggt

SEQ ID NO: 11510 - DNA, 1501 bp, Oryza sativa; identical to SEQ ID NO: 9961

SEQ ID NO: 11511 - DNA, 1501 bp, Oryza sativa; identical to SEQ ID NO: 9960

SEQ ID NO: 11512 - DNA, 1501 bp, Oryza sativa
cctctgggtcaccgacaggtggggcccacctatcagccccgtcccctacctccggccggcgccgcccgcgcccgcaaccgccgctcccgcctctcccgcacacgcccgcgcatgtcgcccactccccgcactcgccccgcacgtcccgcaactgctgcccctcacccgcccatgcgccccaccgagatggccgggattcaatttttgaatcccgcctctatctcctccccacctccccacgtcgccggccgattcccgcgcctctcggcttcatctcgcccccttgtgcctataaaaagcaaccccgtcccctcctctaccattttcccgttctcgtcgagctctcccgtgcactccaccaccctagcgtcgcgcaccacccgctgccgccgcttcagccacctccggccgccactcgccgccactcgttgccgctagagcccccgccgagcctcgccgtcgctgccgtcgggttcacaagcccacgggccacgccgcccaccccttccccgtccaatgccgccgccggagtccggcttccaccgtgcgccggtcagctcgccattgccacctcctttggccggcgattttgcccatctcgctccctctctccctctctaatcacactcatttgcttccctaggttaccccggagcccgtcccgccgtagccgtcgcttcccgccgctcaccgtcgtcgatcgccgtcggtgaggcccctccccttcttcccctctctctcccgcgccgcctagcgctgctgctgcttaactgccaagcctccgcgccgccgcctagctgcgttgccgttgctcgctgccgtcggctgcgccgccgcctagccgtgtcgccgccgctcgcctcctcgggccgccgcgcgccagggccaccgggccagcttaagccgcccgcgcgtgcgctcggccgtacgccgccttcgccgtctgatctaccctcgggtagatcggggccatccgttgccgcccgcgtggcagcccacgtggccgccatgtgtgcgccacgtggcgctccccatccccgatcccgtggactcggtccactgtggaccagcggacttgagccgatgacttgtggggctcgcatgtcggcgccccccccccttcgctgacgtcaccagggttaattattgtgcaatgaatcaattaagttttttctttttatagtaaaaaaacacagtgaatcttctaaaattcatagataattcatccgtgctctataagccattcaagtctcagtaaatcaagaaaaattcaaagaatccaattaaaatggttttgttctctatttcagtagtcttacagcctgtttgcattgtttgctttgtatgtcgcatagattccgactctcccgacgctccagtgtacttcgaaatagtcgccgaggttcctccagccacagagcaaggcaagtcatgattgtcacttgaacatgttgatcccatattggaaatgctctattgctttcctttaaatattgcattg

SEQ ID NO: 11513 - DNA, 1501 bp, Oryza sativa
ccgacaaccctcccggccggatccgccccccctcgcccgccgccgacgccggaaccaaccaccccgcccgccgatgacgcctcccctcctgccgccgccaccgcctctcctcccactagatttgggggaggggagggcgcggtcgccgctgccgcctccgccggcgagcagagaagggaaggagagagaagagagcgagacaagggagggagagaagagagcgagagagaactagagaagggagcgagagagaaaccttatctcctctcgtgtcgcctcctcatggtggggcccaccggctcggctcgtgttatatgggtgtcggttttgttttaaaaatcggcacctataatattttataggtgtcggttttcaactaaccgacacctataatatattataggtgcctttttttaaaaaaaacgacacaaaatataataggtgcctgtttttatttaaaaccgacacctataattactaaaaggtgccaattttttgccattttaacccgtggaggaaggaaaaggcttataggtgccggttttagcactatcggcactgcagtggcgatacctatttgatgttttgtagtagtgtttcgtaatttcttcagccaccggctatgtgtatgttccatacagtcagagcaagccattctttccttaattcctttcacaagtaagtgtttcataatacgagctagagaagatcaagtcgcctatttaattatggaagacccgaacgaacgaacgaagattatcgctccaaaacggcattatagagttaactacctgccctttggaagatgcaacttttcacctctgtaaccgtctcacgtaaagaaaccctgttaaccattattaaagaaaacaaagaaacctcgtaaaacttttctccccatcttaaaaattaaataatacggcagagaactcatcaaaagaaaagagatggttttttgagggaagaaaagatacgtggctgtagtagagaatgatatgaaaatagatgcacaacggtgtggagattatggataccctatacctacacggcatgtatatccgactgggtatggggtgccatgtataaatagaatatctttaaaggaatttaggttaaattctaaacttgtatgtcaagaaaatacccaggatcctagtcggatacaattgtatcttatctgtaactacctattccgttaggaatatgggctgtaccttgtaatacggaccccttcccctatataaggagggtacgggtgtctattggggcacgatttttctcccaggtcatacgatcaataatacacttggcggggcaatccccggacaggagtagggtattacttcttgttaagaaggcctaaacctgtatatgattctttctctaaacccatccgcttttctagcttgatagccacccccttttagtattgccgaaatcatgtttcgacagttggcgcgccaggtaggggtagcgtcagttttttcaccgagtagtgcga

SEQ ID NO: 11514 - DNA, 1501 bp, Oryza sativa
gcacccttggactacacattattattgcatacaattaaaattagttttagactataatttttgctcagcataagttttgcatagaacttgtaaaggtcatttaaggttctgatccttatttttcacgtgggatttgtggagttaggatggtttggattgtgtggtttatatcagtattgacctttcttataactgcctgtcgtgatgtccgtatttttaggggagactctgccgaaatttctaataattttaggacttagttttttagtgtattttggtgtggcattctaggtacgtggttacttggggtgttacaggagcggaggtggatgggaacaagggagatgtatgggtgctagctagtctcgttgaccttgtctcagtggctttactgctgcaaagttggagactcgttttcagatccaacgccctgctccacctccatcatttgttgggaccctcagagaggatggaggtggggccgaatggctcgaggtcatataccctgtggcccgggttaactttctggtctgacatgaagatggcagtgccgaagctaggtgaggaggccaccggtgccacaaggaggatggcatgctccaaatgtagatgacacgacctaggtggtggtgatggcctcaagtttgttcgccatcaccaccgctcggccccttcaaggggagacgacgtcgagcgggcctatgccaagatcttgcgcccatttgtgcgaggttcgagcaaggttggggaaagaaagaggggaaaataagagtaggcgttgatatgtggaccttataatttttaaattttttttccttgtcacttacatgtgagcagttagtcctacatctactttttaatacctggatgctgcatcagtcaaatcaccctaaaaaaagcctcgaagagtttgttttgtactggattttaatatttgagaaggcgatatattcggttttgcggtggtgtacaatcatattcggccaatagtccagggagtcaaaatggaccttttagtaaatagtaaattcattaaccgggcctatgcaatgtaaagcggaataagttcatttgaggtcccttaacttgtcaacgaatctgattttcgtccctcaaccagaaaaccagatacaacgggtccttcaactatcaaaaccggtacagattagatccctcggcggttttgactgacgtggcgcctacgtggctaatttgactcagtcttcatctgacgtgacattgatgtagcgtttacgtgacaattctatccagaaaaataataaaactcgtgggatccacacgtcagtttcacacacaaattaataaaaaatggtatcatcctcacccctcctcttcctcctctctccccatctcccctctcttcagaaaagctggtccattcgcgggatgatgggctcccgcgctagcatcacgaaccgcaccatgttcccggagtcgtcctggatgccgtcggcgagcacctggagcccgtacagctcgg

SEQ ID NO: 11515 - DNA, 1477 bp, Oryza sativa
  unsure (1)..(1477): unsure at all n locations
agataatctggcctttgtttggggcgcccccgccccccaaatatttttggtttttttaaaagcatccttaacagctaacaatattgatcctccaaagcctatttaatggtcattaaaaagattaatcctttatatttctctaaactccaccagatcatccatattacatcctctaaatcttaaccctctaaaattttaagagtaaccttcacctaccatccatatatattaatttttcttttttcacctttcccttatcttattattcaccattcactcgaattntagaaaagnggngcagaagaagcgggaggaannnaagnanaacnnnncnanngcnnannnnnngannannnagnnnnnntcttactatacttggcattctcggctcggattgaatccaaacgtaaccgaacaaggcctaagctggtttgctagcatttaggattattttactttggattttgtgagaagcagttaggaagttgtctcgtgatgtttagattagttttctgatgtggttaataggtgcagctactgtccgttggaaacggttgctttgtttcgagaggtgttctgggcattccgtgtgaagttaggtttgggaatttggtgcgattagtcaaatcgtgtctcgcttagcacttgcacaggtagtttagccaaggttacatgccagttattactccctccgtattttaatgtatggcgccgtcgattttttttatcaacgtttgaccattcgtcttattcaaaaaatttatgtaattatcatttattttattgtgacttgatttatcatcaaatattctttaagcatgacataaatatttttataattgcacaaaaaatttgaataagacgaatagtcaaacgacgttagaaaagtcaacggtgtcatatattaaaatatggagggagtacattttagtgcaagtgaagtgatagctgagtgagaatcttagtgtcaaagtaatggaggatttgggaaataaactgcgttcatgctgaattagacctagtgggcatttatacatcacaacacatggtactgttgccctttcctttttctagccttagtgttgtgatctatatatgccctttagggctaattcagcatgaacatagtttattctccattcctcaaatcatccattacttttgacacttaaaagtatatcaatgtataactgagggtcggtttggtttgttccttgctaaaattttggaatgccaaattttggtgcggcttattttggttgcaaccgcactcttaagacaaccttaccagaattatgggaatgcccatgatcctatgttgcataccaaaattttggtggcaaaccaaataatacctatcccatctctaccctaccaaaatttggtagtgccattacctgacattagcaaattttggtatggtagagaaccaagccagccctaaatcagctacaacattccgtggatttcatttggg

SEQ ID NO: 11516 - DNA, 236 bp, Oryza sativa
tttcgctgctggctagaggacataatatggtccagtttagagactagccaaaagttattttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggcca

SEQ ID NO: 11517 - DNA, 1376 bp, Oryza sativa
accactgctgccacaggataaagaaatctaaaagaggaagtagctgtaaccggtggagtgttaaatgccgttttttttcggttttcttaaacttgtagggttgtgtcatataggtccctaaactctcaaaatgcatatccaagtcctagtacttgtcaaagtgtatcatttagatcccaaattgacacatcccctctaggatcctacgtggcgctgatgtggcaatgccacatagacgtgacgtgtcctttttttttcttcttttctttttcgttttcttctcattcttctttttttttctttttttctgcacgggtcacagagaaaggagaagaaagggaaaaaaagagaagaaaaaaagaaaaaggaaaaaaattaaatgggtcccatttatcagtcaaaataatgccatatcatgtccgtgtggcatgccacatcaacgccacataggatcctgaaggggttgtggcgatttgggacctagatgacacactatgataggttctgggacttggatatgtattttgagagtttagcgatctagatgacatacccatataagtttaaggaccgcgcgtacactttactcaagagaaaaaaaacagggaaacgctaggattgtgccacgtatacgggagcactgatcggagcacgccctgggagcaggcaagcagcgtccgtaagggcctgtttggcacaactccagctccagctccacccctcctggagctggagctcagccaaacagtttcagctccaccaaaaataagagtggagctgggtggagttctctcacaaaatgaactagagttgtagagctgggtttagacagctccacaatttcactttagatcaactcctgaagctaaatttaagatgtgaagctgtaacaaacaggccaagtatggtcgtatggatatcgctctatactgcgtggtgggccttcccgtcccaaggcaaacctggcccgtatgcgtccatcaagaggttgttctgtttgtttgtttcgatcgtatgacacatacagtcatcgatgcctcagccgatggatggccaggtacttcgctgagccggcaacagcacaacgctccattctgatcccccgctagttgcagcgctgatacaaatgcaagctagtgatttcgctgctggctagaggacataatatggtccagtttagagactagccaaaagttactttaagagctactttttagtaaaggaaatagtcctccaataaaatagtcctaagttgtttggatccaagggttattttgagagctatttggtttttaatataccttcccatgtagagttcgccacaactgctttatatagagttggaagcattgactgatcttaagtatagatggcca

SEQ ID NO: 11518 - DNA, 1501 bp, Oryza sativa
gaatcggatatagagttggatttttttagagacagaatcggacatattcttttttttttattttcttcctttttacccggtgtcggattcgtacagatccgatttttttttcctttttttcgcccatttttttggtcggacaggtttaggttttttttttcatccgaatttttctggatcggatagatttggttttttcgccctttttaatcggacaggtttgttttttttcttttattccgcctggttttttttttgataattttggtttttttttcatcaggttttttttgacgatggaagcacctcttattttttaatagtgtatatatatatatatatgtatatatatatatatatatgtatatatatatatatatacacactatactacaccctgatacattataactaaaatactccccctcacatcctacccccaccccacccctaccctaccctatacctcggcggcaacgaggaggagaggcaatggcgtgaggcgcccggcgacggcgacgacgtgctatagggatctaatgggtcaggcggcaagaacgggcatgtccgtgttcgtgcgaggaggcggggacggtttcgctcccgttcacgcggttgtcgccggcattcgtccttccccgccggtactcccgttccgctcagccacggcttcgacctccaccgcccccaccgggcctccacctccggcgtcagcttcctttgcgcgccccaaggagctccaccgccactggttagccccgtatcccgtcacccatttcctcctcctattcctccgctctaggtggcgacggtcgccgccgccgccccccgtgcttccggcgccgtcactcgtttccgcttctgtcgtccacgctggtcgtcttcttcgactccgttacctgacccgcgaaatccagggagctctcgacgttggtggacgaaggaagccgatggtacccctccctgacaccggtggctgcgtgaagccgttgtcgtggctctccggcaccggatctggtggctcggtgtagaaactgaacggcggcggtgtcaagaatcggcagcggcgaggaggcgcttccaatggtgtggaatgaaatcctccaaatcgatcctggaagcggcgatggcaaaatcaatcttgctgtgcgctgttctatttcttttttgcctaagggaatatataaggttaacctcttctcttggtcaccgtgaatcagatttgctttgcatcagcagttagaaccgattaaatttgttttttccttcatttgagttgctatggttcttgtggtgttgaatcattcccatcgccaagatgtgaacctgcagggtaaagaaggatgagatctacagataacccacttaattaggtattagcctgaactgaaaattactactcctcatctgatgtatatggcgaacttactagacaatcaggcttttgaatgttacctgaccacacattgttactaacatgtgctaattttagtcagaaata

SEQ ID NO: 11519 - DNA, 1501 bp, Oryza sativa
gattgcattgcaggtttcaacttcagagtttacaacccacactctgctccacatttcatttctatcatgggagatgtcaaataattgttgtaatgatttgagaagacaagtagagaataaataaatgagtagccgaacattattcatgtactctgtagttgaatccatcaggagagaaagatatttttctcataaacagggttgatcggaagttaaaaatcaataatgacaaagaacatgagcatctatgtttaccttttgggtttctgctggatcatttatagtctcatccattgcttttaaattttggtgtggatattggtggcttgatggtgtataatcatgtggagatgtgcgggagaaatttgccgggggtgatgcttctgttggcgcgaactggaaataattttcccaccaaaacactgtgatatattgttaattacttgccgttaatgatgggattcacctgatatggttgtgggccaaggagaaaaagcagggaaacactaggattgtgccacgtatacgggagcaccgatgggagcacgacctgggagcaggcaagccgcgtcccatacgacacaagtactccgtatctgacaaggctggcgtgccgaaacgaaacaaaacaggttaaaggcgagtttatatataggaaaatactttacgtcgagcgaccggcgcgagggagccagatcggacgctcctccgcgcgcccctccccccacgtgtgtactgttgggccacccacttctctctccctttttttcacaaaagatgtttcacctagtgtacttataatgtttcactatttatagatctaatgttacagttaattaaaatactcttttgcaataaaaaacccacatattttggaaactctctataagggaatttggtttattttttgttccaccaaaaatgttttacctagtgtactcacaatgttttactatgtacagatctaatgttgcagtgaacgaaacatttcattgtaaaaaaaactcacatattttggaaaccctctattaagagaatttggtttattttttgttccaccgaaaaatatttcacctagtgtattcacaatgtttcactatgtatagatctaatgttgcagtgaactgaaacattctttcgctatttgctgaaacattgtttttatataaggtgaaacaatacccgatttaaacgagtgaaacattttcgatctacttagtgaaacaattccgatatatctggtggaacatcgtgcaacatttaaaaataattcaataataagctaattttttcgtcggaatatatccatatgtgatcttgttttgaagatttaattgcaacaaatttaatgatgcaatcggatcatgatttggataagtaatttaagagaaaaatcagtttaaagtagttttacatgtaaatcggacgctgacgtcagcgcccggttttaccccctccggattgggcgcccgaccgggagtcgtctccttttatatatata

SEQ ID NO: 11520 - DNA, 1501 bp, Oryza sativa
atatataccacaactaatatcgccgtctaattcaccaatcaaacttgggcaggtatatatacggcatatgaactttccaagctagccaagtacagtgtagatgttgctcgcaaaattccaatttgttcaactgtgtactatctactgggcagttttcatagagtgtgcattcttgcttaagatgttaccaaattttgagttggaattcttttttccgttgagttgaattaagaaaattttcaaattggaatgaagttgaacaatccagataaagtgtgggttgtatattgaaggatttttctcacttaagaaatttcatacacaaaagaattattaatccaactcaaaattttcataggatgaagttttttttttctaatttcctttctgtctagggtttttactcatgcttattgaaatatatataattgctagttcttctgccggtttggtttcagaaaagttaagcaattgaggaatttgtgtgaaattaagccgaatgtttatgacaagttgggtacgtcatagaagtgatgaaaggtgtagcgaggaaaaaaaaaagcaattgtgaagctccaatgatataccggttaactacagatatgatcgtacgtatgcaaatatcttctcgctatatactacctccgttaattactaaatatttaacgccgttgatttttttaaatatgtttgaccgttcattttattcaaaaaaattaagtaattattaattcttttcctatcatttgattcattgttaaatatacttatatgtatatatatagttttacgtatttcgcaaaagtttttaataagacgaacggtcaaacatgtgctaaaaagtcaacggtatcaaatatttagaaacggagggagtataaagctaagagagcatatgtatcgacgtggcaactcgtcaaatgtagcatatatgctagcctgataacattgcccataaaaagctggcaaaaaatgaagctttgtgaggttcttttaatcataggtgttagaccaccccactagctagctagctataccacgtactccctccgtccaaaaaaaggcaaaccatgggtttccgtgtccaactttgattgtccgtcttatatgaaatttttttataattcgtatttttattgttgctagatgataaaacataattaatattttatgcgtgacttgtctttttaattttttttcataattttttttcaaataagacggacggtcaaacgttgggcacggaaaccatggtttgtctttttttgggacggagggagtacttattgttcttttcagtacgatcgatcgattcgccacatagcttacaagttagaacctcatctctatatctacctaagtttgactaaaattgaagtgttcaaaagattaattggcatctagtaactcttttgtccacaaataaattaacgatgttcgttttttggacgtgtaccaaaatgcagcttaatttgaagaatggtaatactattgccctatg

SEQ ID NO: 11521 - DNA, 1501 bp, Oryza sativa
cacctgaccttgtctgtccaagaggtggctccgttgcttcattatagtgtgtttcagcaaatggcaccctattaagcatgaacctcataagtcataagatcaatacaattttacttctttactgtcaatgttttaccattcatctaattcaaaaaattaataatatgctaaagtataagtactgaaagttcctttgattataaaagatggcacatcaaataaatatatatatatatatatatatatatatatattaaatacaacgaatagtttaacgctatgttaaaagttagcggcatcatctatttaacaaacaaaaagagtatatccttccacatcatctctaaatccatccaaaaaaatgtgaccattaatcctaatctaacacacaggggcgaaggtacagtcaattaccggggtcagtagaccccgatgattttattttaacctctcatatcctctttattttaccagctatgaccccggtgaaaacaaatattagaccccggtgacattaattgttgattgttgtgttaaattccaattgacaactagaaacgatactggcagcagcaaatagaaaattacctagcatttatgattatacgtcagccgaatatgcatatactttgagtttttgagatttgagaccatgcataaggccagtggctcataacttttcaaattccctagcaaaataatttctataggaaattattttaaaaaccatattaatctattgtctttcaagttttttataagctaataatgcttaattaatcatgtggtaacctcgccctattttgcgtgctgggagggaagggttcagatcccatagctaggtctgaacacacccagattgtatcagggttcaccaattcgatttaaaattagattccaaatatagcaatatggctttttttttaccaaaatttgatatttttttattaatttggtttaattttacaatttcaaatttgaattcttgaaaaactattccaaatttcactcaaaatctacttttgtcccaagttggaacatcgaaattgcgttgttttcaatccgttttgtttgaaaacatagaccatggctagtaatgaccccgacgatcatttatcctggcttcgcccctgctaacacaccaaaagattatctgagaagaagaaaaaaaggcacacaaaaggacatgtggtggctatgatcccaggatgcccaggtgcactgccatttgccaccggcctcagtggcagtggcagtgtcagttcatgttggaaaagcaaagctgtccacgcgtggcgcgccatggcgggaggaggaagacgaagacgaagcagccgcaaccctacacgcctctctcacctctcctctcctctcctctctctctatatatagctctcgtcttcttccacctctcactcactcaacccaagcaacgcgcagcacaccatcaccagccaagtgttcgacagagttcttggcgagctagaggtgtcgaacacct

SEQ ID NO: 11522 - DNA, 1501 bp, Oryza sativa
gatgtttgaattcgcttagtaatatcttcccgaaatctcccgcgcaattcgcctcccggtctcggtcacctcgccgtcctggctcagcaccccggccgccttgagcgtcctcacggcccaatgaatcaactatgcatgcggcggctcgaagaagtcgaagctggccacgacgtcgtcacctccggcgccgacgagccgagcgccttgagcgtgaggatgacgccgacgagggcgttgacatccgccatcttgttcgccggattccacacgtatggaaaccccttctcctcctctctcgtgtacacaggcagaagaacgtccccgtcgggcacatcttcggcgactcattcaccttacgccttatgtggcaccatttatggacgaccgctttcaggcctcgaaccaggcgcgccgccgccgagccgccgccgccgatcagatgtacgggggcgttgtccgttccgcagtagccggagtcgacgatgtacttgattccatcgacgaacaccgagcagacggcgacgtcggtggctagcactaccttccgcctgccgtcggccgccggccggaacacgtcgtggatccggtgcatcgggaggccgtcgtgtaagcagcatgtagctagccccagcagcgcacagcccgttgagtgcgtgctcggctgcctcgacgtccgtgcagcccgggaggaagaccagcaagtcgcccggcggctccgtcgtgtggatgcggcacaccgcgtcgacggccgcgccgaggtagtctgtcaccggctccgggaggtaatgttggtcgattagaccggagtaggtacggaaccagagttctttgccgtccatgccggagccggagaagaagccgtgtacaacgcccttgcagagggtgctgtagtggttcaggcagacgacgacccgaaggtccaggcggcgcgccgccgcggccttgacgcagctgagcacgacacctgtgatcgccatcccgtcgtgcgcgtcgtccaccacgacagcaccgtagcgggtgaggagcgggtcggcggcgagatcgcggaggagcgcgccgtgcgtgatgtacttgacgaccgtgtcggcgtccgaggagcggtcgtcgagggggacggagtaccccacctggcgtccgagctaggcgcgcatgtcggccgcggcgcaagtcgccgcgagcacggcggcgaggcggtacatctggggcagacgacgcagccgtggccggcggcgtggagcaggcgcgggatctggctgctcttgccggtgccggggccggcgtcgacgagcaccaccaggtgcagcgccacgtatttcgtcaccatcgcctggttctcctagtggcggaactcccgccgccgattgcgcacccttctcggcggcgccgcggctggcggtgtcgtcgtcctctgagcggctagtcgggcgctccggcgaggagtggccatggcgacggggcggggtcggcgtgcggggcgcgccattggtcacacgacggcgct

SEQ ID NO: 11523 - DNA, 1501 bp, Oryza sativa
gagctccttgacatccatgccggagccggagaagaagccgtgtacaacgcccttgcagagggtgctgtagtggttcaggcagacgacgacccgaaggtccaggcggcgcgccgccgcggccttgacgcagctgagcacgacgccggtgagcgccatcccgtcgtgcgcgtcgtccaccacgacggcaccgtagcgggtgaggatcgggtcggcggcgagctcgcggagaagcgcgccgtgcgaggtgtacttgacgaccgtgtcggcgtccaaggagcggtcgtcgagggggacggagtaccccacctggcgtccgagactctgagctcggcgcgcatgtcggccgcggcgcgggtcgccgcgagcacggcggcgaggcggtacgtctaggagcagacgacgcggccgtggccagcgacgtggagcaggcgcgggatctggctgctcttgccggtgccggggttgtgatttgcgtggaatgctattgattttttatgtggggatctgcatcgtatggttagtgctatagatggccataaagcactaggcccgaaggcccgacccacagcacggctttttgcccggcccaagcacggcacggcccgacttgggtcggtcctgtgctggcccggcccgaccgccgggccatgcctgggcctccccaccgacacgctgggctggcccggcaggccaggctcggcacacaaagtatagggactaaaatagacatataattgtcactgtcctaagaatagggaccttaaatagacttattttagctatttatataccgcagcccaaagaagagagaggtaaaatagacttttttagctatatatatatatatatatatatatatatatatatatatatatatatatatatatatatgtgtcacagtccaataggagggaggaaaattagacttatttccgaggaaaagcacgatagcccattgtgcctttgggccggcccggcacggcccaaggcgtgttgggccatgcctgggccatgagtgcggcacgtgggctggcacggcacagcccgatgtgtcggtcgggccgtgccggcccgacaagccttggcccaggcacggccgggcctgggccgtgccgtgccgggcggcccacatggccatctatagttagtgctaataggaattgagatatgtggtcttgtaacagcaaggtattatttttacagtgcaattagctctgttcttttcttatatgtgaaatgcgcatgccagctatagctctgagggtacaatgtcaaagttactgatcaaagcatgtcagtttctaccatttttttatatgctttgtgttaaatacgtgatctgaatttcagcatgcaatatatttgaatttgtttcctagtggttagattagtttgctagtagatttcaggtcttttcctattagcactactaggttttatccaatttatatatctctcgtaagccacactggaagggtgcgacaacgcattgttttcttgc

SEQ ID NO: 11524 - DNA, 1501 bp, Oryza sativa
ctcacagttctgagaacaataataagccattttatgaatttgaccagtgagcaacacctgcaacaacaaaaaaaaaaacaaaccataattagtgaatacaatggatttggatttcatacaagtaaataaagtgataataagtcataccgggccatctctctttttcttataggcaatttctactccttcgagatatccagtctcaagcatatctttcacatttttaatctgtccctccacataagtcatcccctcctcctcctctgtaattccagcaataagtctctctttctcacttacagtagtcagctcccctttctcagttgtgacagcaggcataccctcctcagcagcacttgcatcctcagtttcagcagccatcagcttctctttcacagctgtgacagcagacagaccctcgtcagcagcattcgcatcctcagtttcagcggccatcagcttctctttcacagctgtgacagcaggcagacccttgtcagcagcattcgcatcctcagttttagcggccatcagcttctctttcacagctgtgacagcaggtagaccctcgtcagcagcactcacatcctcagtttcagcggccatcagcttctctttcacagttctgacagcaggcagaccctcctatcagaacgcaaatgacgcatcctctgcacggcgcgttctcgtcctcgcatctctcatcagtgggccccgcgctcgactttttgagcgaggttctcgatccttcgctaggaaccgaagaagctagtgaagctatgggcccaccaacttttttcaacacataggacgaagtaacgctccacgtagacgaaggaacgcccactgtgaagggcctaagcaacactcgcatcctcattttcagcagccatcggcttctgtttcttaggtgtgacagcaggcagaccctccttagtagtcgtcgccattccatactccacagtcatctctaccgcactgtagcaatttagtggcgtttcagaactctctaagtgttatggaaatatatataaatagagattattttttacatagaaaacccttatgagagtatactacaggcgcgctgactgacaatgaccactatatattgaggattcgattaaaaatgcaagaaaacaatgcgttgtcgcacccttccagtgtggcttacgagagatatataaattggataaaacctagtagtgctaataggaaaagacctgaaatctactagcaaactaatctaaccactaggaaacaaattcaaatatattgcatgctgaaattcagatcacgtatttaacacaaagcatataaaaaaatggtagaaactgacatgctttgatcagtaactttgacattgtaccctcagagctatagctggcatgcgcatttcacatataagaaaagaacagagctaattgcactgtaaaaataataccttgctgttacaagaccacatatctcaattcctattagcactaactatagatggcca

SEQ ID NO: 11525 - DNA, 1501 bp, Oryza sativa
gtcaggcaggagggccattgctggttgcaacttaccttgttctcagaatggttgcaacttaccttgttctcagaatggttgcagctttctttgatcatttggcctccctttatgcattcatctgcacaagcacaacacaggatagagaaataagtggtgactgatgaatgaggaagagcagcaacgcaggggggttaggcggatctgatgcatggtcacgccggccgccggcgtgggccgctccgaggctgccggtcgccggggcggaggcgccgcctcgctgacgagaacccgcgggcgcagagctgggaattcgagagatttgttgcaaacctgattacgaactgaagctttggttttctctgaatcttcggaggtggaagacgcggaggggcgcggggaggcggatttacaccggagacggaggaggcggccagcacgcggcgacggctgtagtggagtcgtcgccggagtttggagcggcggcggcggcggtggatttcgctccgaggaaggaagaaagatgggctgcttgggctgaagcgggaaacctgaaacttgttagcccagaacggggaagcggcccacgtggtgcctatactagttgggcccataacgggattgcggcccatcctacttgggctggaaggaggaattttttttatttataattttttttattaaaagttttacaaaaataattttccaatttgaaaattaacggaagtagtcgcctaccgccctcaaatcgccctcccagagggcggcgaaaatgacatggcagacggccgttcgctctcgggcgacggccgtcaacgaaatttgcaggcggcccccttgccgtcctccgcgagggcgattttgtactgtgcggggggccgcctgcaaatgggcggcgagggggggcatggaattttgcaggcggcccccttgccgccctccgcgagggcgattttgtactgtggggggggccgcctgcaaatgggcggcgagggggcatggaattttgcaggcggcccccttgccgccctccgcgagggcgatttttgcctcaccccctataaagcccagtccctcctctgtaaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattataagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 11526 - DNA, 607 bp, Oryza sativa
cactcaaaagggaggaaaccccctaccttttcccagcaacccagcagccgttctgatcagttctcactcccctccaggcctccactccaccctgtcggcgatcgagccatccatccaccgatgccgcccgcctccgccgccgccggtgacggcgcggcgcccgaccaagagccgcccccgagccccccacccccgcctccccctcccccgccgcctagaccggcgccctccctcgcctccgcgctccccttctggttatacctcaccgccaccgtctccctcctcgcgatcctcctcccccacctcctcccttcctcctcacccccaccccctctcccctctctcctccgctcccacgcctcgggcggcagcgtcctcaagctccatccgggccccgacctcttcgccgtcacctccaaacccaccaccaccgccgcggcgcaccgccccgctgtcctcgtcctccccggcctcgccgccggatccttctccttccgccacgccctccgctccctctcctcccgcggcctcctcgccgcggccgtcgacctcccggggcagggcatgtcgccgccctgcgacgcgccgccgccgccgcctccaagca

SEQ ID NO: 11527 - DNA, 757 bp, Oryza sativa
ttgcccgtataaaaacaaagggtgtgtttgaggagaagggaattgaagagattgagaagatacgtaaaacgaggtgagccattagctcatgattaattaagtattaactattttaaatttcaaaaatggattaatatgattttttaaagcaactttcctatagaaattttttttgcagaaaacacaccgtttagtagtttgaaaagcgtgcgcgtggaaaacgagactcaatctcccctatcaccctggaatgaacagagccaaaataattatatgtgtagagatttgtctttcaaaaacactactatcgtgatgtcttgcacttgttagatttagtaaaaatttgaccaaattttgtcgtaaaatttgattggagggaacaattgcttggagcaaagttgctacctctgtaaccttttgagaaagctaaagtcagattatcaccgcgaattatcagctggattagtctctaaggctactaggaaaatttgtatgatatcacaaaatttccccgggcagtccctaggtttacaaaaacgctgaaaatcaattggttttttggaaaccggacttcctggattgagaacacaaacagagtgtttctcggttaacctcaaaaattcaagttgaattttgaaatttttaccaaatttgaacatatttgtaagtagttttcatatggttctcacaaaaactaagaaaaccgctgaaccctgatttgaaaattttatgttttgattttttttaaaaaaaaaga

SEQ ID NO: 11528 - DNA, 673 bp, Oryza sativa
ctcacatttcacaacacacacaaccactttgtattcattgtctcggcctgaccaggggcagtggcggtctgacgggcgtgccctggccggccccaagtcggcggtctgaccggtgcataaggccggtctgaccggcgggaccggcggcacttgtgcggtcagaccggccccctggaggccgggatggtgttgctcggggtggccaatacagagccgacggagccgtattcggtcagaccgagctgatggcggtctgactgagccgaggctggtctgaccggccaatcaactgtggtctgaccagccaagccaatggggctctctgacagggctacaatggctagttttctagccgttgcagagtagcacggtctgaccggccacatacctccggtcagaccggcaacacacagagttgggggatttcgcccccaacggctagttttggttggtgagagtataaatactccccctccagcagcaacgggcctctcttggtacccaattcattgcatacaccccttgcatctctcacacacccacttgagctttgtgttcatccatctagtgtgtttgagggttgattagccaagagtcaagtgcattgcttcattgtagagctagtgtggcacttgattgatcatgttactcttggaggttgccgcctcctaga

SEQ ID NO: 11529 - DNA, 544 bp, Oryza sativa
taccttcgtttataccgtatttcgaaagggaagaaaaaaaacatcactataggactcgcacatacttcctccgtacttgtaaagaaagtcgtttaagacaatgtttaagttaaatcttaggaatataagtcataaataactatctagatgttgagtttgaaaatgtaaaaattatgcttaaaaaatatgctcaataaatatttttatagaaacaacaagttaaagttgtgttttggagaccgtgtcgctgtacaaaacgactttatttactagtactgagggagtactaatataataatctgatcgttgattattattattagttgagctttgttgggatgattagctagaaaggcagttggggacttggggttccttcgggcgtggcatgcggcaggcatgcatgtgcacgggtccctagcgtgtccgtccaccaccgagccacaccccccacccccgcaacagccaaagcccacgcccatctcatgcgcgcgcggtggtgtacgtcgtactagcgtaaaagcctcgccccccaccgccgcga

SEQ ID NO: 11530 - DNA, 1501 bp, Oryza sativa
  unsure (1)..(1501): unsure at all n locations
ggtttgactgaccgctctgttcccgtctccggtgggcccgggcccaccgtgctctcctccttgccggccggcccacgcacgcatctgccactaaaacaaaagagaaaaaaaaatatagaccagagtatataaaataaaaaagaaaaaggagaggtgtcacagcaaagcgaacacatgaaaaagcaggcaaaggatttttctactccttttccctccaaataaaaaaagtcaagtcatgcgtgtggggccacacggcgatcgacccctcacgtgggccccacctccgtggttgcctcctcgttcgccaacctcccttgaacgcagcagcatcaacaaaaaaccaagaaagtgacacttttaatatctttacagatttttctttttaatatcctttggatttctaaactccaaaaaaatatcattattattattattaaaaaaaaggtgaggttagcagcggtggtgggatgactgatgatgaggagtgatgagcagtggagaaaaggcaagcaagcaaaggtggacaaaaagaaaaggaaaggacgaaaccacctcacctcatctcatggcgtttttgttatctgctccacctcctccaccacccccatctgctttgattccatcaacgccacgatacaataattactccgtattactctctctccctgcttaatgccgcactaacccttttttttctaatctggaccggcaagctagcctgtgtggtgtgatcagcgcctcggaaagcgacgctcgcagagatccccggatcggattagccagctctccctttttttttctctatcaaatccagagagacacacacgaaaaaaatatacaaattcaacagtttttaaacatgtgcacatgcactgtgctgccacgacggaggtggggcccacatgggcttttcgggtgtgtcttggtcgtagggacatgcgaggattagatggatggatggatggagtggtggttgtcattattgcgggggttacttaattaattaatttggtcaagcggtcaatcacctggtttagcgctaacccttttgtttatccattatattatttaatattttaatattntgtctcgtgtgcgagtgatcgatgcttcccaccaccatccatccatgtgtcacccctcctccgcttgctttatatagcccacgcgcctccctttcctttgccttcgtcttcgtcttcctccagccacgccattctgtcgcctcctccacttcttctccttcgccatggctgtgcaggcgcagtatgggggtgggatggcggcggggatgtgcttgccagaccatgaggtggaggcgcagatgcgggagctcggcgcgatgttctcggcggcaggtggtggttgctacaacggcggcggtggcggcggagggtatgactgcgccgccgtggtgagcggcgcggcgcagagcgagctgacgtgcaacaacggtggtgtttgtggtggtgcggtggggatgggggtgggggcggggagg

SEQ ID NO: 11531 - DNA, 924 bp, Oryza sativa
tttactcctactgtagaattattattattattactactagtcggaacaaccaaacgagagagagagagagagacagattattttatctgcttaattatgaaaatgaatcaaacattttgaaaagtgaacttaataaataaccacccgttctaaaatatagaagtagcaacatgctcccagctccgcatttctgctgcgtgtatttctaaaatgtactatttgtccggagtagtaatacttcagtactgtacttattttcaaagagatgaagcaatccgatccggctagcactcctactcacaaaaaaaaaaagggaaaggaaagctgagcaaaggcagtgtggtgaagcacaaggagatgtcaggtgtgtactgtaaaacccaaaagaaaaaaaaaaggcaaatgcatatgcctcctgccattgccaatctcgctgtctactactactcccaactccagtaccaccagctacagcaaagctgtgcagtgcagtagtgcagtggcccgtggctgggggtatcttttcacatcaccagtcatccaatccaagtatccaacccaccccaccccctgacactgaactgggtgcattcatgtggatatctttatcctgcatctcattaatccgcctcggaaaccgtgccgatttgggtacagtagtacaattaatcctgcggtgattaatgcccggatgcaaaaaaaactgccgcctcacccaccgaaagaatcccaccttttccggacgtaacggcacaatttaattaaccccccttcttttaaatctttttttccgtttttcatgggaaatttgatctcgaacagtttggtttcccatggaaaatgggataagtagttgacagtaataaataaaatggtaaaaaaagggccatgcattcaatttttacaatcagatgcctgactttt

SEQ ID NO: 11532 - DNA, 1501 bp, Oryza sativa
agagcctgtgctacagcttgctacaaatatgtagcctgcttttattttctcccctcttctctctttttcacttaaacacaaatctaatgtagcaatttctgaagctcacttgcatcacttatttattatacttgctcttagccttcttatcaagtaccacaacttattgtatttatgaagtatgggataaagttaaagaaaagtttggcatacaaaaaacaaggcaaactatgctcagcagccaaacatcccctaatcccaagcctatttttctaatgtctctaccatacaccacaaatggcccaacgcaatcagtttataatgaagtcgaattcagacaagatttttttcactattgtccaccatcatttcatctatatgcgagatcttcctttttgtgaatttagatgatttttttttgttttacacaagttttcatctaaattgggagtttcattgtacacgtatttcaaccctcctttccaatagaaattttcctatggcagaaaaacattcaatgacgacctcatattatcacaaacataaaaaatatgatggttcacagaaccgttatgataggctcttggcccatttgtgacgatgctatgctgcatgcagtactatgagatacactactacaaaacatataatacgtaccggttcataggtgtcggtttttatttttttaaactggcacctatcctatcttattgtaaagttataacctactaaatcctaaaactcaacatacaaagatgtcacattatcatgcattaacaagaaacaacatcatcacccactaacaattattgcatttaaacatcatgcaagcatgttatattatctataattttataatttattaaattttagagttttaaaatctaagaatgttaaataatatttcaatatatatcttcatcatttatgatatatatatatatatacctatttggttcatcctcacttagttagtgttatttctctcttctcccattaaatcatatcacatcaattatttttagacttagatgattaatctatggtccaaactatctcactccctttttttctcataaaactccattatcttacttttacatttgaattatctatatactatttaaatttaaattatcatacaccatatcacttacgtaagtttatattatttagctatcttacacatttttttatttattgttatcatgctaaaatccaaccataaaaactagaacctattgtatatgtgccgatttttttttttaaaaaaaggacctatacttatattataggtgtgtcagatttgcataaaaaccggtacctataataagctataggtgcccggcaccagagccaagttgaaccgagcacccattctcacttcgtccaggcggcctcctcctcctagtccttatccatctgggcggtctcctctatctctctctctcctctccatactccactcctcttcctctatatccgcctccttgttgcaaca

SEQ ID NO: 11533 - DNA, 1501 bp, Oryza sativa
taactagaagaagagaaaaaaacaacaaaagaataatcaattaaatactctagctagtatagctaggcagcacagtgaaaattaaatgaaaaatggacatcccactcaccaaatagtgctgcatgtactggcaaaacaaaaacaaagttgctccacgatcagatgacaagggaaagagaacaagctccccaatgttgagaaaaagggacagatggatgcaaatttgtcactagactagcctcatctaatcattgagggtcctgggagagagcagtgtgtgtgtgtttgtgtgtttgtcgtctcttacctcgccacgactatacctttgggagtacatatcatggtcaaggtaggggtgccgttcctatcggagaatccaggccctatatccttaaaacaccaacgtaacacagctagctagtactaatatataagcatcaagaaataattaataaaatcgtgttaattttaattaacgatcgatgagtgacctatcggattcagaggagtacgtacgtactataccaatcgatcatcgaattaatggaagagatggcgattaattaagctcatcttccaatcatcaaattgctgttggcgtactactctccatatataggaccaaaatcacatgattggggctctccccccgtgtgatagggacgctggttgattcactatcacatatccggccaaccctatatataacagagctcctatcatggacatcgtccaacatgacaatacatcaaagttaatttttgcaaagaaaaaagaaggaaaaagaaaaattcatcagtttcgtttgatatatatactgcctaattttggactggttaagaaagaagcacgtagtaattaattagttaaatacttcattgatttttttaaacacactacaaacacaccgtcgctcacaacgtgcccacacttacccctataaacgtatacatacacaacttcgaaagatagctagaacgggcatatcttaagttgaatgaaattaccatgacctttcaaagataggttcgatatatcttgagattgatgaagttactatggatgccttgctgtcgacaggtacgttacttataccattgaataaaaaaataacagtaagtacgagcaaccatgtcaagtttaggacttgaattgttacccacggtttggtttgtttcatgtactattataagtattgatgggtcctgtgggtcgatcttgatccaatatatgcaatctgaacagaatacattgaagagactgagggagatctaggtgcagagtttttggattagtgccagcatttaactcgttttttcatcctctgcggaaaaagttaagattcttaaattgacaagagcctaaaattagagaatttagcaagacttcttttgccaaagaggaggaagattttcgtatgggcttactaccatactcgtgttaattcctccatcacacgtacgcgcagatggatgaaagttggactttgggacacctcagt

SEQ ID NO: 11534 - DNA, 708 bp, Oryza sativa
  unsure (1)..(708): unsure at all n locations
cacgtccgaaattttgtagaatggcatgtaccgcttggagttcctatttgtccggtcttgtgaacaccaccccatcatctgcgcataaggctatgttgaaccatgtgttcttccgtgcaagggctgtagaatacatgtttgttgggcggcggattaaagcttttgcagcgggtctatcgcaaggatgagtaacatgggagagagagggtcgcgttgacgtaaaccccggtcatgttgaaagccggtccctgccctgccatttaggatcaccttggatgacgtgcttgctataatggaggtgacccaatttatccacctggccaaaaaaaaaaaaaaccccccccccaaaaaaaagggaaatttccctttncctcaaagcggtcgagaagatatggccagttgacagaatcaaaagattttgctttatcaagcttgaggaggatcgctagaattttggatgaatgaagttcttttaccatgttattgacaacaggaaagttgtcctttatgtttctcctcttaatgaaggcactctgatttttggataccaattgttgtagtttcggtgtcaatcaatttgctaggagtttagagaacattttgccgaaagcatgaatgaagcttattggcctgaaatcccccactctgcaagcattatgctttttttggcaatagggcaatatagggggtaccgagctcgaattcgcc

SEQ ID NO: 11535 - DNA, 920 bp, Oryza sativa
tcaattttcatttctttttatcttcattttttggataacccactttaagaagcatcttttaaatgctttgatgtctgtaagccaggatgaaaatataagtgggttggtcctacaacctggcatggggtaaaggcatcaattataaattatctcgctccaattaagtaagaaaaattaaaatagatgtggtagtatttgctttgcaaattaccactaaactagagcatcatgtaataattatatgtttctagattgttctatgttatgtgtcacaaattcacgatgtactgtagcaagttttacaaaaaaaaaatggatatagtcttttaattcatatctgtaattggcttatatattgctgaggccacatcatgcttgtttcatacttaagattccttggtgcaaccaacacgctcagtacaatcaatcagtatgctgttcaactagccacgtgacttcatatattatatatataatttagatgctatgatcacttgagattattgtttatctcctaaaatgatcatttattgataaaagcttcaatatcaaaatgtatggttaaatagctcctatatacaagctgagaaaaagttgatagaaagtcgttagatgtctaacggggtataagtaatgggtctacccgttttataaaagataagctgggatattttgatttttggtgagaaaatttagtattttcttttatttagggttaaatttgctaagcgacatctaaaaaacgtgttattgggcggggacacagcaagaacgtgtttttggtgtaggacacccaaaaaactggttattagctacccccccgttaaaaccctttttttttttttaaaaaaaaaatttttttggggggccccccggcggataaataatggatgaagggaaaactagcatgggtggaacca

SEQ ID NO: 11536 - DNA, 787 bp, Oryza sativa
taaaaaaccaggactacagagggttatcaaccgggactataaaccctttctccaccagttatttatataaataaatttttccaactttgtttttttattttttaaaaaatttatggtgtagtaggaagagaagaagggaggaggatggaggggggggagaggagtgtacaggggatggggatcgatcgcccattagccacagccgttgttgatcacaccggctatactccatctatctattaaggctcgatttatcatgcatggtcattaaaattctacttttgactttattagttcctcacatgatatgtttttctaagtactttaacgcactactatagatagggtttttccatacggctgagaaccatctttccatctttccatgacatcatttttgcatgcggacctcttaagagacccgtatgggaaaatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatatagg

SEQ ID NO: 11537 - DNA, 981 bp, Oryza sativa
tgtgactattgtttcgccaagcgaggtgaggcgcagtgggtatgaaggttcagatttagaaataagtatcgagatggtttatttttaaatttaaaattttaatgttcaaaaaataacaaaaattcccaatgaaaagcgtgtgactatacttccattgtctgttgcataataaccttttacctacctaagagggtggcactggagagcacaatcatgtatagttctcttaacaatcatgtatatgtactttcaaagtgcaagtcacaaaggcaatatgatacatccaccgctctagtgtatttataatctttgtccttcaacatacaccagaaatttatggcacctcacaaaagggaaaatataccttctgctgcagcctacttatcgacacatctccttttacaattgaattgaagtaaaatgaagcactgaagtttaaaagaattctccttttacacatctcatttttgccataaaggaatttttttatgtgagattgccacttggatgatggaatatacctgtttacttttaaaaaaaaattcaagcgaattatttcatgtccgattggcactgccggcccttcatataaaactttttagtggataaatttgtttgcagattgttaccaagtcaggatgtctattgtttaatgccagattgtatcccactttatacagaaacttgtcatgcaaccaactaaccgggacaattccagactaccttcgcaaaagcaatggatcaattgttttcaggtgtgcctactttcattattattgatttcccttttagcattttccagattgtggggttgttcttcctgtaatctttgggcaccctaaaagaaaatagggaagggaagtgatactatgcttctcaaataaaaacctgcacggaaattaaagcacatcaatggtggatattaaaagtggattaacagagtaatccccccattagcaagggggcagttttgtacttaga

SEQ ID NO: 11538 - DNA, 1096 bp, Oryza sativa
attaaataaatatacaataggaaatatcgttgactttcactttttctccattgtacccaaataataaagcatgacattttaaatagaaagtcggaattaataaacttgaagttgtacccatatcaaacacataatatttcgaaatttgaaataaataataagtaaattataagtaatatggacaaagttttaaatctaactggctatattttaaaattacacaatatcatgacaatagcccgtgcaacgcacgggttggtgactagtatatcaaattgagatcaattaccaggtttgatgacctagctgattactgatctagacttgatgtatttatatatgttgatctatctatataagtgataaatatacataaaacaagtaaagtagcatgtatattaaaaaaagatcagctgaaactctgattctatatctaattataattaatttcagattagtttttagggttctagacaagactagggatgaggcatctcaaagtaggtaaagaaacctaaagtctaaacaatcaacgaattaattacttttcaagatagtagatgccttagttaatctaatctagtaaaacgatttagccaataccaaaacgagtaccagccgatagagctaaattgagatactaagactaaattaactaagacatatgacaacagatggttatgataaaagaactataacatccaaaacgacatagtagccccgatagcacaagccattgagacgagttacctcttgtcgagagaactcgacgaaaagaagaacaaaaacggatgacgatgcgccgaagttgtattggattatttcccttattacaatgctctggggttcatatttgtaccccgagtacaaacatagtccattatgaacgcgactcaaactttcctaaagataagatacaaacaagaccacatggcggtctgttgccaaatctctaacaatcgacttaaatatcctaattaatatatacaattgccttaatcgagctctatctctaattgacaatgacggttattccaatctagacccgaaacgagcccaagtcatatcgtatcggccacttgccatattggctaag

SEQ ID NO: 11539 - DNA, 1501 bp, Oryza sativa
tcacgtacgtttcgttcgttcacgttcgttcgttcgttcgttcacgttcacatacgtttcgttcgttcacgatcgttcttcgttcgttcacgtggcggcagcggagcggcggcgtggcggcgcggcatcggcgtggcgcggcctggcgtcgtggcgcggcttcgtcggcactgccggcgcgacgtcgtcgccggtggcggccgcatcgaggtcggggttggcatcgtcggtgcggcggagtcgtgttcggccgcgacgacgccggcggcagcgtcggcaacgaggcggctgatggcggtttggggagagagagagagagagggaggcggcggcggctctcaccccagagatgcggcggcggcggaggcggcgacgatgacgcgcgcgagacgacggcgagatacaacggcgacggcggcgcggggatgccctaggcagtggcggcgaaggagaagccgagagagatcgatccgggaaaaaacttctaagtgttggtggagaagacgagggcgcgcatcgggaatatatatacccctagatctttagtcccggttgatgagaacaaccgggagtaaagatatctttactcccggttgatgagaacaaccgggagtatctttacaccctgttgttctcatcaaacgggaataaagatattttccagctatttccaaattctttttaaacccggttagtgttaagaaccgggactactgataagcgcactgaatattaatttccattacatatgtgtttctaaaatagaaaataatgcattaaaattatttgaagtcgaaaaatcaatgacaattacttcgaaacattattgttgtctgtagtaaattaagtggataaaacgtaataagcaaatatatgatttaaaattaataaaaattctaataatcatatatacttagcatatgaatgatattaaattgttaaaaattgtaattaacatatgtatatacatacgacatgcatgatttaaaattaataaaaattataataatcatatataattagcatatgaatgatattaaattgttaaaaattgtaattaacatatgtatatgcatacgacatgcatgatttaaaattaataaaaattataataatcatatataattagcatatgaatgatattaagttaattgttaaaaactctaattaacatatgtaaatgccacatgcatgatttaaaacttttaaaaaatttaattatcgcatataactagcatatgcatgatttcaaattgttaaaaactctaagtatcatatgtaaatgccacatgcatgatttaaaacttttaaaaattataattatcgcatataactaacatatgcatgatttaaaattgttaaaaactctaagtaacatatgtaaatgccacatgcatgatttaaaacttttaaaaattctaattatcgcatataactagcaattacatgatttaaaattgttaaaacctctaataatcatacgtaattaacatatgccata

SEQ ID NO: 11540 - DNA, 506 bp, Oryza sativa
cagatcgcttgatctctcagttctatatttctgctgacaactacatgaccatatctacatgttgctcaatgttttgattttctgtgagctaattaaagttatgagttcttatagcttaagtactgaaagtttacaaattcaccaatagatgtaaggtttgtctgagtttagtgtctgaccttgacccttgcagtgtgtgtaaacaatatactcatgttaccttttaaggttacgatttattctctacaaattcatactaaattcatattatacaagttcatacttaacaattgatttggatttctaggtatttataaaatccagattattttgtgaacatgaacatggaatgtatctaaattctgcgtgtggacacagccttgccatgtttctcaagtatgaatatatccttgcacacactgtttcccccctatttttacttttcttaaatatatattatacaaatgtgcttttgattaggtaacttttctctctgttgttgtagc

SEQ ID NO: 11541 - DNA, 576 bp, Oryza sativa
tacattgatgtgccacataagctacagtacatcaggaatgagaggagtgcatcaaaatactttagaccatgatggatatttcgaaagtgcaaatgaggggtggccggtctgtaaaaacagttttctcctaaaagatcgacattggtcaagcgaccttaatctaaaaaataatttcaaaggtacttcagaatggtcaaagctcagttctgcgatagacattgtcatagacatttggatgcatgtgtcatggaagtgcttatactattaatatgaacatgtattttggtttttttttaaaaaaaaaaaactggcacatgattgtcaattttgcctaaccatagcaaaataggtgtgtgaagtttaaacatagcgaactatgactttatcaacccactcaaatcatgctccttatgaaaagttctagatgagaaaaattttaggtttgggagtgtctagattgaaatttttagtcgtttttctacccacttggatgtcaatccaatggttctcatcactcccactatcattctttcttaggtatatataaatatattgtttgtaggaaactaggaatca

SEQ ID NO: 11542 - DNA, 614 bp, Oryza sativa
tatgccgttttgcttatcccgcgaataagcgaaacaatggctccgttagttggataacatgtcacctgtcatccttaactgcgcattatgcccttcttttttcttaaatgattttagcagtgatgtttagtgggcattacccatactgttgtttatcttatgctctacatatgaccttcataaacagttctcgataaatgcaagaagaaatgtttttttctcatgaaattgggtatgtaggctcatactggactttgaactaatgtatctaggtagcctgtcatgttttctcacacccagcctttgtttacacattttggcttgtgagcttcacaagacaccccaggcatctctcttactcttttcaccgtgcacaattatcaatcttacttctgcttggtttttctataaatacttaccaatctatgctcaacagtccacatctccaccaatcatccgctagtgttcatagcagccttggctaatgttgaggcacatgggcaagtgaggctatgctcaaatacccatctttgaattccgcagttcctccaaacggcaccatcctctgcttccactcgacttctcttttctctctccatctctctttctctagg

SEQ ID NO: 11543 - DNA, 1501 bp, Oryza sativa
ctccctctctgctcctgccttcacttttttttactcatgcctcttctctgcctctgcctctctctctctctctctctaattattgaccagctgagatcgattccaatccgatgtttcatactccatgcaaatggagtagcagcacaaacgtaatgatctacaaaaagtaaatcttgatgccatgcaaatggtcggcagatccgaaccttattcatggcaccgttccggcccatcctctgctttcacctcccttctctcgaattacctgatcggtagtacggaatattgtggaatctgggtctctagctatcagccaatgaaatttcattttaaccaaaaaaaatcttatgtaaaaattggttgtaacttcattgagtaaagatcggaatattaatctattaaaaaaaactgaaatcttattgtagcaaaaggtgtatcttcggtctttgccaaaaaagcatgcggctcagctggatacacttcaaattcagccaatcgatatgatgtatacttgagagtgaaatataccatgttaagaaccactattgattcgtgtaccaaaattatgtattcggattatggttgcatgtttaacatagtctctgagtgtgtaattggttcttaagaagattttggagaaatggtttttgtgatgtttatcaagagctagtggcttggcctaggtggagcactagtatgaaaacagcaagcatggtggcctgcgcagattgcgcggctagcatcattatattttctcccatataataacatatatgttttctcaatgtattattctaatatattaaaatgacaacataattttaaattttgtactaactttacaaaactactaatatgtaatattcatattgtattttatatacgtgttagttattaattatttttaatatcaaattttagtaatttgtacattatattcctatacggacttggactctaaactcatctttcaatattctttaatttttaattttgaattttagttacttctaaattatattcatatattgacttcatattcttcttcccatgtttgttaaattttaaattttagttatttgtaaattatatttttatatgaactctaaactctaattttaattctattatgtttattctgaattttagttagttttaaattcctatatggactctatactctacctttaatattccttatttttaatttcgaatttctataatttcttaattgtatttctatatggactctatactctacttctaatattccttatttttaattccgattttctattatttcttaattgtatttctatatggactctatactcttcttctaatattcttaattttttaattccgaatttcagttatttataaattgtatttctatatggactctagtctcctctttcaatattccttatttttttaatttcgaattttaactatttctaaattgtatttctatatggactatgtttttctttttctccaa

SEQ ID NO: 11544 - DNA, 1501 bp, Oryza sativa
cactatgatcaagttttgtcatatataggacaacactgaagagtacttagttttgtttagctctgtaagttttgtcatctataggacaacactgaagagtacttagttttgtcatctgttggaaagtactgaagagtacctggctttatatagttttgtataatcatgcatacataagacttatataatccatgttgatcaaatccgcattgatggctattgagagtactttgttttgtttgctcctgtaagataacttgaaatgtttttttgagcaagttctgtcagcccttgtaagagttccgtgttctactaataaataattgttttttttaatataaataccaagttagttttgttaggttttaaaactatgatatatcatgttgagttttgtgttatataatcaagttagttatgttctgttagctacattgaattgtcagagatcatgtgacaaccagtgtgaaaaatggcaaccagaatatttttggttctgaatttggtcaggtcgagtgtagttgtttgctctgaatttggccttggaagaagctgtcattgttcaaggctacttgtcattttttttcagcatgtgtgcagtcgagaactagtttctgtgagagatgtatgcaaaaccaagaaaaacaagaacaactacattgtttgtcatttgagtgaattttcattcttttgatagacccttcaagtttagacatgtcataagtttatttggtggtcaccagaatagaactaatctgcatgtacatatttagatcaaaattgagatatgcatggctaatctgcataaaatcaattgtcataaattatgcatataagttttttgttctgttagcactgaattttgagcagatacataaattgtgccgtaaaattgacagtttgaaacaggaaactaattccatgcactatgttcatataaaatgtgatgtaatctgtaagtaccttatctgaaaagaagttacttgaagaagcttcccctttctcctttttattcagtgtagcttgatttttctgaaatgtggctactcggctgtgggcttttgactttttcctgtgggaaaaagtgcaccggaggtccctgaacttgtcaccgagatacgaaaacgtcttgaaccgcaataccagatatgcggggtcccctaactatacaaaaccggtcacccgaggtccctcggtggttttgaccccggttttagtctacgtggcagctaagtcagcatgggacccatgtgggcctcacatggcaggtgtccacgtcaccctctctctttcccctttctctttctctctgtttctctttcccctttctccttcctctcgctctctggtctcgcacacgcagggacgacgccgcggaggtggccgggagggagcagcggggcacgctgtcgatgcggtggcggaggaggaggacgccggccaccgcgccgcggctggatccggcggggagggcgtttcatgaaggtggtggtgggggagg

SEQ ID NO: 11545 - DNA, 1501 bp, Oryza sativa
ttcataatgatagcgctattatgacagaggatgtgaatctcgtggctaggtttaccaacctgttaatcttctcagtttttaaaagccacataaaccatgtggataaccatcatgataaccctatgcgaaaagatttgatgaaccctgtccgtagtaatgcttctctctacatttgtactcactccatctacttttgatagtcatattttcaaatctgaaaaatttatttttgataagtatatttcaatccaacaacctatcatcttaataactttctcggatttaatgcgtgactctccattcttccacacatgactggctacatgggcattaaaaatataaatattaatgaatcgcttgtttacgaggaatgactagtagcatgtttaaatggatgataagtagaattacttattcttggtctatgtgtcaagatgaaatatgactatcaaaagtagatgtagggagtatttatgaagcttatgatagctacagtttatcccaaatcagaagtttcatataaacatttgagcttttcaatcaaattttgttaaaccgtagtgtagagctcaaagataaattagaagtcaaaaaccgaatcttctagccttttttaattcttattagatgcttgtttagagcaagtttaatagtatagctaactactagctccaaatcatctatagtcaatctaatagctaatttatacaatggttaacttcaaatatatgctacattattaataattggtcttacatgtcatatacacacaatattttagagtccgtgctgcaactggctacaaatctatagcccacttctcttctctcctctcttatctcctacacatatgcttatagttaacttatagtctgttattgtacatgctttgagtatccaaaacttctccaagcaaacctatgggcctgttttggggagcttaagattctgaaaagcagctggttggtagccatcttataagaatctagaaaagctgggtttcccagcttctggcttctagttcattttctggattctacaactacaacttctcagaatctagaccaaaagctaaactgtttggggggagtttttgattctgggagaagctgctgcagctagaagctccccaaacagggcctgggcgggggtgggggcgggtgtgattttcgacccgcaggggtgtcagggatagggccccgcatttgggcgagcaggggacgggggagacattttaccgacggtgaccctcgggggcatggggatgtatataaaccctcaaaatatagcgcatagaaggcccaaaaagcccaacccaccataaaaagctactaaaccctagcctctgccttatctctctctcagtttcttcccatatcccctcccctcccgtgagacacacaggcgcctcccctcctgtgagacacacaggcgacgacgcaacagggcgcactggatctcgctgtcgctggccaccatctcccctcccctcctctccagt

SEQ ID NO: 11546 - DNA, 903 bp, Oryza sativa
tctcctcgttgtttgcttgtcactctaatagttatgaaaaaaatttgagaagatgttttaacatgtaatatatcactctataaatatgcaagttcaaattaatggtagctaagctgaaccattttcctttggttgcatatatgttggtttctgttctgttactgaaaactttgccgatgtatggcgggatgtcaatttgaggaattcctgtctatcatcggttccctgctttgatacgtacgacagtaatgcatcggcatgcagctttgtaggatatcagtataatttttttccaattaattactactagtacaattgggagtatatccatccatagaacaataattttcatttgtagcagtcaataaacgggaagtgatgccccccctccccccgcgtcgggcggctcgggggcgaaaaaccctacccgcccgcgcctccttttcctccctccccccacctggccgccgatggagcccgccggcggcaaagccggcagcgggcagggaaggcggcggtgaggccttcttctcttcgtggcgtctccctcctcagcgcaaaggacgaagatgacgaagctccccaccggcgtggtccgtggcggccacggcggcaaggtggggaggaggcggcggatccggagccccaatggccggatctggccctccctcgcctggatttgcgtggtggcggcccgaggatgtcacaccccaatctgataccgccgtaaaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttatcttaacttaggttgcagc

SEQ ID NO: 11547 - DNA, 1501 bp, Oryza sativa; identical to SEQ ID NO: 8661

SEQ ID NO: 11548 - DNA, 1501 bp, Oryza sativa
ggtaaaggacaggattacggtggaacggaggagacgcgccttcagttttttccttaaaaaaaatgatgggctgaaaccaccaggacggagcttccggcccgttcccagcccattcgtatatttctgcaagtataccaccacatgtaaggtctagtgaaaattaattattttattactcctgagtgtactgattgccaaatatattctgtcagtacaaagtggcatgccgatccattactgtcgtgcgtatcaaaagcaacgagccgatgatagacaggaactccttaaattgatatgtggccatacatcggcaaaagttttttggtaacacaacagaaaccagcataggcaaccaagggaaaatggttcagctcagctaccattacttgttcaaatcaagaaacaaaagtaacagcctcaggtgatcgataggggcgtatccgcgtatgtgcatgtttcagatcgagtagtcactcaggcagctccggcgatgaacatcttctctaaaaaaaacaaaactcagacaactccttgcatcatgactttaaactcgtcaaaattgatcattccatcgccatctctgtcgaaaaccttgagcattctctcacactcctcatggccagcgtcgtgctgcaaacccaaccttctcatcacattctgcagctccaggggacttatgaatccatcgccgtcgccgtcgaacacgctgaaagcttcctctagttcttcccagctcgcttgcttctcttctaatagtacaagagcttcatcctctacctcgttgccctccgcattgaaactgagcccaagcgctgccattaccacagcgacatcgccatgcgtgagctctgttcttgctttggtttcagaatgttcagatgggcatgtgctgtgtgtgttgtgcttgtcacagagaagaaaattcagaggctggaacagaggtaggaacaccttcgtcatatggacgagcagacttctagtgaacatatttccgcagaaacacagtgataagaatgagaacaacaaataagaaagaaggataatgaaaaccaaatgcttaggtagcactagctatactaacactgcgtgaacagagtactggtttctgcatggttcttgaatttatagtgcacgcatgaggcgtcaactggctggtcgtctctatttatgtattgaagagatgataatggggcaggagtaactatgaaagttcagcgaattggccaagagagagcagtggcttgactcctcaagtccaagtttcaacgtacacaaaagtgaatatgtactagtgagtatgtactttctatagaaatttatcactacaattaactttctggttatcatacaagtttgttaattcttcagtgtgaaaccatgtgaacactgaagaagtcaaacataggctgtcattgcatattcaggagctatatccatccgtattgctaccaattgcatatagagaagttccgtgaatatccaccatgaccgtgtattctgt

SEQ ID NO: 11549 - DNA, 1501 bp, Oryza sativa
gcttaatccaggaacatccctccaggtggtagccgcggccagcagtagcagcgacgactttggattgggagagatcgagtagctcgaaccatggcgggaaatcggggtctgcaatccaggagggggacttggacatggcataaaccttgtcgcccactgccattagggcagggcaccattttgcggagttgagagcgggcccatggatgaccttctctgtcctcgtgtcgaagatgatggtgtcgccgggatcgcccccgacgccaacgatccacgcgcgatggatcgaccgcacagaggtgaagctcttaccgccggcagcggtgggcaggcgggtgatccggcgcaggcgcttccgcttcgcctgcggtggagatgaagtggcggtggcagtggcggtgacgcctacattgtatacggagtagggcttagaatacctggaccaatcccagtggcacgccacaaggtagacagaccgaccacgtccttcatccaactcatcgccgacgatccccggctggttgagatcctctgttgcttcttgcatcggctgatcgcaatccgcttgatcctcgtccgaatcaccgccgatgatccccagatgccccgactcaaactgatcggcgtcttccgtttcttctagctctggatctgtaatggatggcttgggcttgtcatagaaagccttgccccttgctccatgacggtctctcgtcttcctcttttcgctgcccatccctggtctatgctgtcgccgagaggccggaggaggaggagatgatgacggcggcggcggctgcggctgcttaggacagagtaaggcccaccaaacacggaaaggaaaacaggcccaaacaaaacaaacggctggactctgttcagtctgattatacttctgtttctcagcccatctcacaattgtgagttcgtatttttttttcatcttttgacattaataacacagaatacacggtcatggtggatattcacggaacttctctatatgcaattggtagcaatacggatggatatagctcctgaatatgcaatgacagcctatgtttgacttcttcagtgttcacatggtttcacactgaagaattaacaaacttgtatgataaccagaaagttaattgtagtgataaatttctatagaaagtacatactcactagtacatattcacttttgtgtacgttgaaacttggacttgaggagtcaagccactgctctctcttggccaattcgctgaactttcatagttactcctgccccattatcatctcttcaatacataaatagagacgaccagccagttgacgcctcatgcgtgcactataaattcaagaaccatgcagaaaccagtactctgttcacgcagtgttagtatagctagtgctacctaagcatttggttttcattatccttctttcttatttgttgttctcattcttatcactgtgtttctgcggaaatatgttcactagaagtctgctcgtccat

SEQ ID NO: 11550 - DNA, 1501 bp, Oryza sativa
tttctcggactcccagagcccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgttcacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttctcacaggaatcggtccttatatgcgaatacgggacagtaccacataggcacaacccccgcatcgcgagtttttcacaattcattttattttcaaacacaccgacaccacatgtcgggttttgaaggcttcacaaacccatttcccaagttttcgacaaacaacggtgtatgtgggatatttagtatacgcgctcagagagcacgaataccaaggtaccacaagggtggagcgacaaggaaacagggtagtacgacctacggaaattagtgcgactactgggtaggtccgtcggtttggcatggaaaccgaggccaagcaagttaagtgtgtgattctaataatgcaagttgcaaacgaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattactggaagttgaacggagtcaaacggaagagcggttgggaagatatgaattttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggaggga

SEQ ID NO: 11551 - DNA, 474 bp, Oryza sativa
ttagcctggttttcttgggccaagccaataagagaaacaaaagggatcaacagatttgagaattcgtaattcagtgtatatatagttcctgaaaataattcagggagggtgtccataaaaatgttacagccggtgatgattgttatcattttttttttaaaagtagctatgcctattttcattgtattactgttttatgtatgacaatgacagtgtcccaatatttcccagaaatgctctagtttaactaaacgtcaggtttatacactcagtgtgacacacatgttgatgtatggtcccttgcctgatgaacatcagtgttcttggaccatatgatcttgcctgacgaacatcagtgttcttggaccaaatgatgccattctataaagttcctactgagctaacaaattgctgtcctgacacaaagctgcatgaagcaaatgacagatttatatataaccaagactagcacaa

SEQ ID NO: 11552 - DNA, 1501 bp, Oryza sativa
agaataattaatattagtagttgaaaatattcgtttgttacagtaaattcattttctaattttatattctctaacctcattaaaaaagaaggccccacccccaaaaataggataggcactagcggtcggagatcaaaaccccgaacccccattgccctctttgattcttgtttcagtggtatgtccgaactctatccttactgaacacatgaggtcctgggttcgactccccatgggagcgaattttccaggatttaatggcattgtgctttcagtggtaggcgacgtacccgtcaacagcgaggtgcctgtggtgacttcgtcaatcttaaggatttgccggcccagtcttcggagatgctcatagggttagagtttacgtacgtgcgttcataggggtgagtgcgcatgcgttgtgagtgtctccgttgtactgagtaattcttaaaaaaaacatatgctgaaaaatatgaaacatatgtttataaccaatctctgcaagattatctgaaataaatatatagagatgaaacatttgcacttcgatcgaagaacagattaggctgtcagatttactactgggagtatgaaccaggtatatgaagcccaacaagtgaagagtacacaaactacacaataacatgaaagcaggaaaaaaaaagtgatcagttttttatctgaaccaaagaaagaaatttctgttgcaccatgacgtggaaagtaagtgtatgtgtgttgtgtggtgtgaacgagtcagtcaatgcagtcaacattaacaaaccccacactgtctctactagtcttcgtcgtcctcgtcctcgggctttcctagtccttgccgcgacgaaatcaagcacatgccgctcacagaatcagtcttgcagacttgcactccagtactcttctgggaatttggcgtgaaatccaccgagcgacgccgacgcaaccccaacgtctacagagaaatctcaacgcgcagccgcgcagcgcaggcgcaatttctcagtacatcaccacgccgactggtagtgaagacacggcgagtgatctcgatcgactggacagtctggactgcgaagaacgcttgcacttgtgtgcagcgacgcgcgaatttccagggatttgttgctgccacctaccggccggagtccatggagacagcactactagtctactactaccaccgtactatgaagtaagcagattagtactctgcagtcgccgccgtccccgatagggacaaaatggcggggactcctgtcaggtcaggaaatttgcttgaaatcttcccgacgcgacgcaaacgcggcaagaaatttcccaaaacgcgggtgcggtcactattaaatcaccaccatttgctagtgaagttcaagaaaacaaacacatcgctagcaacaattcggatttagacgcgttaggaggggggaatggccgctgacgcttacgctgacgccgcgccgccgcggcgagctccggcgccggcgacttcgacagtggc

SEQ ID NO: 11553 - DNA, 337 bp, Oryza sativa
gtcatctttttagggttccaccatatatatacctcttgtaagccgccgtgcggcgatgtaatctcaccccagatataatgaagatattttgctggctagcgcccgtggttttttctgtccggttttggaagggttttccacgttaaatctcgtgtcttatatgattgatctattattatttatcgtttgttcgcctatcgtttcctaacaccttgttactgtcaagtctcaactctgctccaataaaaaagaaaaatcctttacagcttaatttgctataggtgtgcacttacttttttttgccgggtctgtgtatgcacttttactttttgatagg

SEQ ID NO: 11554 - DNA, 1337 bp, Oryza sativa
cctgtccggggatgaatccgccgagtgtattattgattggatgattgggagaaaatcaacatccgcccctagaggcacccggaccccccttatatatgggaaggagtccgtgttacaaaagataatctatatccctaacagaataggcagatacagataaaatacagtcgtaaccgactaagtctcaaggtatttccttgatgtacaagttgagaaacaaactcgaaatacaaataagatattctatctatattcggtatcctatattcagcccaaacatcatcgccgtgtagatatgggatatccataatctccacagtagcccccgagacctttgcagtcaaccattatagccttctcaaagatagtaatccgagtgcttcaaattattcatgccaaggcctgccgagtagcgaagacgaagactgtaaagggcgaaacaataaagaatacggtgcatcgaatagatgcacctaattaggtgtagcccccaactatgtgattaattaacaaactaaacatatagttgagaacagaatattagcacaatcgcgcatcatatgacaaaagcatacgcggcgcctaaagaggcattctagccgactgccttttatccataataaaaagaatccgagtggttaacactctaaaaggttcacgaatgaacacacttgacaggcatccgaataaaaactctaaggattacccaccaagtattataaaaattatgggaatgaataagtctaatagcctaggctatgactatttaccataatgaaaacaggcatataacataccaagggaatgactataataaaaacaagtcattccaagttaacccaaacagcttttgtagcctaaaaaagcttacaaaaacagcataacgcttttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggaacacaatgggccacgctgttaaaagtattgggctgaggtactgttcaggcctaagcccatttgcacctccgatacccttaacaagaaatcccgagatccaagcgacacttcgtcttccccgccggaactctcgccattttccccactccctgctacagtagagaactgcgccggcaaactagggttcaccattccgctcaaatccaccttcgaaaagtgcatcaaaatccttcccgtgatccaccgcctcaatccctcacctctccctagccatccctcgaatcaaatcagcgcattcgggtaaaatcga

SEQ ID NO: 11555 - DNA, 1501 bp, Oryza sativa
tcttagcttcaaagcaacatgctgtccccagtcagcccatgggttgtcgtcgatgttatcatcgtcaacttgaaactccacattctcacttgtttgatcattatgagcacttttgttcatatatatgtgaactatattcagcaaacaactctcttattttggtgtgcacaactgttagatacccgggggcaatattctcctagctttcgctgctcatatgcactaatgcagtcccccttgatggtagttttagaaataagttaaagcacgaattcaagctagcaacaaagctcttaaaacctagggtattccacaaagttataggacagctcatgcacaacaatcaatttaacaagttcttttctacataattcttgatcaaattgccaatccttaagagcagcagcatgtgaatgagtagatgacctgatcgagtacttccaccatttgacccaatctagctttaccatcacaactatccaaatgtctgtggcaattgctcctatcaactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagtcacttgaagcatgtgtggtggagagaagaggggaaacacacgcgctcgctcgcctcgcctcgccggggaggcggcgcgcgtgcacgacgtacgcgtcgaatggtccgaaaaattggctcctcacccttgcgcagatgcagcttccttttgcagttttgttttgctgcaaattcggattcgtttttgttttggaaacgttccgaaaaatccggtgtgtgcaaacggcgtggagtccggataaggtacgcgcgacttatccggttcggttacgcgcagtagagatcgtgcgggcgccccgatcaagcgacccttctctatataaaccgacctgccgtcttcacgcaacacaagcgaaatcaatctagggtttgcctcctactctgtactgcgccgtcgctcgtagactactccatcccgctcgccggcgtgcaccgtcgatcgggagagcaggtctccggaacctctgccttcgacttcctgcaccgggagaaggaggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccgatctttccgtcacctcggtacgtgttcaatatgttacgcatatttgatctgttcatgttatactgtgtagtttacatgtatagatctaatgatgcgttcatgctagttttcatctgtaatgtcatgatttatttatgggatagattaaatcattatatgtctataatctcaacattccaaaaaccttattataggcactgtgattttacta

SEQ ID NO: 11556 - DNA, 1501 bp, Oryza sativa
taggaaaaaagttaatcctgacatagcattgctgatcgagcatcgccaatcaaagtaatttcaaccattatttatgaaatctactagtaaaaaaatattttgccactggtagttgaggtagcagtacaaatatatatgagccattgaattagaaactatgaagagtcttgattgattctacaaaacacctcatataacatgttatatttccacaatatggtatcagtacttcaaaatttccgttgcagctattatagtaccacacccttaaacaagtattccgtcttaatcacttaattcttctatcaaattccaacagagcagcattactgagaaaacatagtcaaattaaaagcatctggtggagaatatctaaacatgggatgtgtaatctgagatgaacttggaaaaagtacgaattactcccctgaactatcacggtcggccaattaccccctaaacccgaaaaccagacatcgtttaccttgaaccttcaatatcaaacaaattaccccctcgacataatccagagcggttttgtcctacgtggcaatccagtcagcattttttttatggtggggcccacctatcatataaactctatcacctgtctctctcccccctctttcttaggccattgggcgcaggtcgagcggtgcgccgcgcgggggcgggtggtgagcacggtggcgggtcgacgagctcggccggctctagtggcagcagcgggggtggtgagggcggcgggacttggagcgaggcaacggcggcgggacgtggaacaacgcgtgttcgctacaatttcatcgctccatccatccatccatgccgcgtgtgtgctggatctgctggttgttggatctgctgctcctgcgacccgtggccgcgtgtgtgctgtcctctcgctggttctgacgaccttttcttcctcgatgccgctgtagatggccggcggtgagcaggaggaatcatcactggtgttcttatctccgaggaattttgattctctgtgtggagattatggatatcccatatctacacggcgatgatgtttgggctgaatataggataccgaatatagatagaatatcttatttgtatttcgagtttgtttctcaacttgtacatcaaggaaataccttgagacttagtcggttacgactgtattttatctgtatctgcctattccgttagggatatagattatcttttgtaacacggactccttcccatatataaggggggtccgggtgcctctaggggcggatgttgattttctcccaatcatccaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggttggggttgcgtcaagcttttcgccgatcagtgcaa

SEQ ID NO: 11557 - DNA, 1501 bp, Oryza sativa
tccttgaaccccggagatgctcccatccctttgaatcaaaccctcgtcgtctcgtcgtgttttcccctttttgctctccggtgattgccgccgccgcaatccgccatcgtcggcttctctcgcgtcgattcctctcgccgccacgcccccggggatccccttgacctccccctggctgccccaaggccgtcggccttctcctttgtctccgcgccgtcttgccgcttccgccgccgcataacaccgccgtgcgtgcgccgccggtgaccatcgggtcccgcgtcactgcgtgcgcgtcgcaacaccgtaccggttcggctaagcccgagcccgcgcacccttcgctctcctcgcgcgcggccacgtcggcatgccggcgagattggccgccgccgccggccgtcgtcgcgcgtcctcttcctgatgcgagccgtggaatgagttccccttctcctcctcctgccgccagtgctagccgccccttccggctcgccgccgttcgccggatccccccgcaccccgtgagccgtcggatcagcctgcccggcctcctttgcctccccatccgacgtggttgccacgtcggcgccacctcgacgcgaccgggtcaaaagctgacctcggtcagccgcctccctccgtcccccaccctcgcgcgcggtccacggagagccgacacgctgcgcgtgggcccaccgcacaccgcgtccacccgcgcgccgcgcgtggaccgcctttccccccccgaaccctagcgccgcacccgcgtgcgctctccccaccgtgaacccaaccaccgccatgtgggtcccgcgcggtggaccgcgcccaccccgacgggcctccctctctccccgcgcgccctcatgggccttctcctcgcgcccgcgccggcccatttggttcggccgagccgcgttagcctttgggccgcaccaatgccaccgaacaagtctaatatacatccctctatccttttctttttccagggatttaataaatcctttttcctttgtcccataaatcaattccttattccaaaattccacaaatcatttcctttggtcccgcgcgtcagtgactgtcaataatattcttgagaatattatttctataaaatttcataaaccatttctcctattccagaaactccaattaaacttccaaaattcatatcttctcaaccgctcatccgattgactccgttccacttccagtaattccgtaaaattgagatctatttaatggcactactaattagtctaaataggatctttcttttggtcttttgtttaggttttcgattgtttgcgtatagttgcggttatcggattttcgtcgatcgcaggttttctcgaagattcgtgaagcttcgtgaagaccttgagcaaggcaagtcaccctttgatcaattgctcctataattgaaaaatcattattattttgtttgtaacttgcattattagaatcacacacttaacttgcttggcctcggtttgcg

SEQ ID NO: 11558 - DNA, 1501 bp, Oryza sativa
gtacattgaagctggttggtggaataaatgcagtttccattcaccctgccacctgtcaaagcttttgcttctgaatgttgccagttctatgttgttaatactgcccagagggggtccttgaaggctaagtagccgatccatcatcagggttgatgaaatccctcctcggcattggatcttgtcagcgaagaataagccgattgggagttggcccattccgagttgtctagctgagctcattggatgatagaattcataagaagcttggatgtttcttccttgatgaatgccaacaggaaggatgcatgggctgattgcagccgagaagatttccctggatgattggtatacttcatggttgatgtctttgaatctgaagtccactgggtgttcaagttgtgcagagtcttcataaaggaaccagactctagcatctttttgaaagctttcatagaagctacaaaaccaatccttgagcagttcagccgatagttttgctccggcatcagttggtgtagaagcgtattctccgtatgatgtgcatctccgatgagtacgctcttctccatcatcccctacaatcggctctagtcttgggaactcagcttctgatacggatggccgattgacaaccttcatgactatcaggtttaaccaggtttgtagcagccaccagggtccacctgctccaactactgagccgactgttatcttagccgatgcattgctcaacatctggtatagatagccgaggagaattttgcccaaggggaattgtctctttatttctagagcttcagccagaaattgccagttagttgtggggccgcaacttgatccacagaaaagaaatttttctagccacattaatagaaaggccacatgttctcgaggggtgaccgagccctggcccatgtatgctgctacatagcctgaccaacctcctatgcttttggttttgaagtcatattggttctttgtgttcaaactcatagggttggccgatgaggtgacatccagacctatgatcatactgatatctatgaaggttggagtcatcggcccttgattgaatagaaaggcgttagtagtgtttgaccagaagcaagaagcggctgccattaggggttcatctttggctgagtttgctatagtaaggtcaagtgtttggccgattccaatttcatcctagtgaaccttcttgctagctgatacacgtttgaaccatgtggtccagctcttttctggtggaactttctctagagatggccaagacttgaaagtattcttccagtgatctagatctgggttggttaatctaaaggggattctattggtttcaccaacaataaactcggtggggtcaggattgccgattgggccgagaaaatagtggttttcatgcgtcagactgggaattgcgacttggtgagaaagatgctacaaattcgaagcaaccaaaagaaggaaagcgatatgagataagagaagatcgatctgc

SEQ ID NO: 11559 - DNA, 1501 bp, Oryza sativa
aaccccgtggatgcgttggattggttgcatgccgtggggaaaaagctagacacggtgcagtgcagcgatgaggagaaagtcgtcttcgccgcccatcagctgcaggggcccgcatctctctggtgggaccacttccaggctacgcagccagagggacagccgattacttgggctcgcttcaccgccgctttccgaagaacccatgtgcccgctggagtcgtggcccttaagaaaagggaattccgagagttgaagcaaggcaaccgctccgtgatggagtatttgcatgagttcaataacctggcccgttacgctccggaggatgtgcgggaagatgaggagaagcaagaaaagttcttggcaggaatggaccccgagctgtccgtccgtctagtctctggggactatccggacttccaacgactggtggacaagagcatccgcttggaagccaagcacaaggaactggagtcgcacaagcgtcgcttggcgaatttccgcaatcagcagggtgctaaccaaagggtccgctacaccaatccctatccagggggatcctcctcgcagcagcaacaacaacagcagcagcaacctcgccccgcgcctcgacctcaattcgtggtgcgcgtcccacagctgcagcagcagcagaatcagcaagggactcgtgcgccccgtcctcctacgccaactgtgcagcctgttcaaggccgcagggatgctcaaggtccgcagcgtctgtgcttcaactgcttcgagcccgggccctttgcggataaatgcccgaagccaaggcgtcagcaaggccaagcgcctccccgccccaacaacggtggtaaggacgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgttagacaccaagaacttggatgtgattcttgggatgaattggttggcacaattccaaggagtagtggattgcgcgagacgcactgtcactctgtaccgaggaccggcacaaccggttgttttctttgcacccccaacctctgtcagaagttcagaacttcatcagataggactgtcagaaatccccatcgtcagggagttcggagaagtgtttccggaagaactacctggtatgccgcccaagcgagagattgagttccgaatagatcttgctccaggaaccactcctctgcacaagcgaccctaccgtatggcagcaaatgaactagccgaagtaaagaaacagttggaagaattgaaagaaaagg

SEQ ID NO: 11560 - DNA, 1501 bp, Oryza sativa
cgtagaatcaaattatgagatgaactctaaagcccctcctggtttcggtttggtacaccgtagtactattgctaataaaatcccctcaatcaaacagataatttctatgcttacaaccattccaacagataaagactgcgtcaaaatcttgcttccaacattgaaacagaataatcagactttcatccatcacaccaagagggactgcaattgaaataagaaactgcaaactagccgtaagcaagagaagcctgactgatacgctaatttatgttgacaggctacaatatcaagtaaccagcgatggttataatgggatccatcagctagtcagagtgcgatatatgtacctcacaaccttatgaacatttatcatcagtatgtctaagttactcttattaatgtttactacctagtgcaactgcaagtacaggctatgctgctccaaccaaacttgtgaagttttatctcagcaaataatttgatcatgttaacagtggaacatagatgatagaaaagtttgtcataatctggagtaataaaagacaaattattagagtagaaacttcaagaattattccttgcactagattacggggcatgactgtacgactccagcctcctcacttgttggacagtataaatggttaggcgtattttattgttgcggtataaataagtgactttgaacctcacagataaggacgaatgatactatatttagcaaataaattaaatttgttctctaacacatgcaccaataaaaaaatattgacaatggagaatgagaaaactttaaaatttgaatacaaaatttactgtaaacaaaggatatttgagagaacattatcagtggagacatccaagctttgcatagaactgtttccatacaagcattccaacatggtttaacttatgcacaacatagaatttgcagcatacagaaaactatatattacataaggaattaagcattccaggtagctgtgaactccaatatatctacattgtatcctgtcagctcctggcattcaaatattcaaaactcatacagtgaaaactaatggccatatatgctgtaaatatgtagattcagtatgcaaaactatacttttttgtggtagaaattcctgctttaatctccagattgcaaagaaaaacatcaaaacagtaaggtgtgcagtgaatatgtgcccaacagaatttcatgaatagagaacttttaatgacacttcatttaataaaaaaagcaagcaaccagtcatgcatttgaaatctacatgaagaattcaagcccattttgtaacattgagatgctatgacctatgacctatgtgcatcgaattcatactctaaacaatgacacatgcatgatgatttctcagctgggaccagcattaatagggtagattagttgagtttgctggaaggtagtaacagcctaatcactttctgttttttgctaatagaacatgcaagattgatcagtgagccatacata

SEQ ID NO: 11561 - DNA, 1501 bp, Oryza sativa
gagtaaaaactcgcgttgggagaatgaatacagccacaatgggcgtgggacgaacctgtgagggggtcggttaaacgaccaccttggaggggaaataaggtttccccgggatggttctgtccaccccatcttgcggagccgcttcttcttccgctccccctcgggctgcggcgtcggcgcggccccctccgggcgcctgctgctgacacgcgctgccccgccccctcggggaggagatggggaggaggtaccctcttgcttcctcttccctcgggcgtcggcagggcggctgtcccccgagccctcgtcacggggcccggaagcacgaccccctcctggagtagattgttcgcccctgcgactcccgcccgcgccgtcatggcctcgagaagctcgctcctctgaggccccgaccgtcatcatgatggtcaggatgttgacgcgatctggatcgctgcagagggggaggactccttgggggatgagggatgcctccacggagctgagattcagcacccgttggatcattaccttgaagtcttcagggacccagtcccatttgaccccccggtgggtcctcatacagtcctcggacccggtgtactcccaggcgccccgggcgcgccgctggagtggcgcgatccggcgacgaaggtagtcaccgtacaccatggcccctgtgagcccctgggatcgcaagcccgccaggcggtcgaggacagcgtcgtagccgtctcccagatctaccggcacccgccagctggaggcctgcaccgggggctggctcggaagtcagaggcgcgcttcgtcggcgaggggggtgtagaaccagtcgctcttccagtcatcccacttcttgcggaggacgcagggaatgtagcggttcaacaccggcccccgcggctggaagtagcagccaccgactatcgacggcggcgacaccggctgaacggtgaagaaccaccggaacagccggagagatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccattgcgaaagggaggaagaaaacggaccgccccgggtagtgtggcgccgggcgtccctcacccagcgcgaccacctcctggccggtggcagattccggcatgaagcggcgcggcagcccggcctgcctctcgctcacgatgcgggaaggcggcagcacgctaccgtcaagcggaacggagccccgtgccatgacgccggaagaagatatgtttgagagcgagcgcgtgtggtgagggaagggcacgggaaagaaggagttagggcgcaagcggcgaagacaaggggaataatggcgagaggaaggaagcaaatctcttcctcggcgtctttatacccttgccaaacgctgtgcccggctcctcgcttctcgcgcc

SEQ ID NO: 11562 - DNA, 1501 bp, Oryza sativa
agagtggtatataatttctactgcaccaagcacgaatggttacactaccggaggaatgatctttgcatggtcgcctgatttccacaatagtcccggttctaataaaaaccgagactaaaaattgtttttagtcccggttataaaaattttgatctttagtcctggtttatgccctgtcagttagtctcggttggtagtatcaactaggactaaagattatcactttagtccaggttggtagtaacaaccgggagtaataatcatttagatctttagtcccagttggtactacaaaccgggactaaaaatctatctttagtcctagttggtaagtccaaccgggagtaaatatttctctcctatctctgatcggttaagtcccagaagaaatatttagagataagatcgtctctctccaactcctctcagatatcacccctctccaactccctcagatccgatccaagcctcctcgtcccctcccctctcctcctcctccttctccccttcctcctcctcccctcccatccgggggccgacaggcggccggcagggccaagcccagcggcagcgggcaggcggcgggcagccgtggtgagcggaggcagccggctttgttttctttttttttatataatctgtgattcattgggatgtataatttcgtgattcattgtacatttgtatggatttgagatgtataatatgtgatgtatttgatttgttttgtaatttttttaggatttgtgatgtatttgatttgtgtgtatgagtaactttaagttttgtgatttgtgatgtggatttgggatgttactttgatttggggatttggggtttgatttggggatgtgcatgccactcgattagggagaaaataaaaaagaaaaaaaaaaggggacatctggactgcacgctaccctctctttagtcccggttggtaacaacaaccagaactaaagatccctctctttagtcccggttatttcaaccgggactaaagatgggcatctttagtccggattgctactctcggttggaaacccaggactaaagggggttaccaaccgggagtaaaaaagtttctccaccagtgttaatttttcagcaatatgcttttgattggttggattacaaatatgatcgtcgttaaataacaaatgaaaataaaatttctgaaggtagttatagtctgaaaatacattcaattagcatatgaaattggaagactgttttgagataaatctttagacataaggtgggcagcacaaagaaaatcatggcgagttgggtgaccattagtgaggtactcacggtttatatgacgttgtttcttcaatcatgtagaccatcagcgtgtcaagtctggtatgcttttgtttcgaacaaaataaagtctgtttttctttcaaacagaacattacaaaatgctctaaaagtattaataccgtgctagtgaagtccttttgaagatgaatagtattgcattacgtgttagaga

SEQ ID NO: 11563 - DNA, 1501 bp, Oryza sativa
gaaggaggtggtggcgtattcctcctccgtctccatcttagagttctccggcgatggaagcacttgctactccttgcttttggcatatgcggtccggttgatgttcaccgggttagtcccacgcgccatactacttttcggtgtctgcaacttaaagttctccaatttcttttgagaagaggttgcgccggccgttcacttcttttcggtaaccactcacataagggcggtgttcttctccttgggtttcggtgtcagatttgtaaggggcagctgtgatttgtttctttggccaaggtagcttcaaccaccatagtagaggcctcaactggattcgctccttggctatcttttgccatgttttcctcttcaccgtcgccgttagcacaggccaaatcgccgctcccgtggaagaagcagacaaaggacccaattgcttttgccccgttcttttcaagttcttttctacaaattttcgatgtatgctcaatttggccgttactgaggggcctttctacaaattggatgttcttcccgttgttgtgttttatcatgtgccttttgtatctaaacttttataataaactagataaattgtctgtgcgttgtaatgggtgaacactattttaattttgttattgttatacggtttaattaaggtgaaattcactgtgagaatttgcttggatatattgtttttcttaaaattcatgagctgcaattagtagtccgattatctcaagttagcctgtatgtttttttaaagagatttcttatacgactacttctgtattttaaaaaacgaacaaacttaaaatccgactcaaatacatatatgtatttaaaatcgaacgaacttaaaaaccgactcatacacggatgatataccaaagtaccagaaaaacatctcaaattcttataaagtaaagatatgtatcaaagtaccagaaaaacatctcaaatttttataccagtaacacatgcatgaccttaaaaaaaagaaatgaatgaacattctccaacctttgccacagcagagacgccgtctccaagcgaaatactcctactccgtcgacttatcaacggtctagatcgccttaagattcgtgcgaagaagagaaaaaagaacaccttatccctccctaccctcttcctctgccaccaccactcgaggagcctcctcggtgtctcccgatccgccgccgccgccttctccggcgatccggcagccgcatcctgaacgctcgccttcccgttgcccccgccgcctcgccgcggcgccctcaccgccgcccaggcctgacctccaaacccgggaagccaccctctcctccatccatggcgtccgccgccgccacctcgtcgtcggcgtcccttcgcctcctcaccaagccccccaagcccctcctctccaagccccacctcctcaccctctgcgccccggtctccttccagcgcctcgtcgccaggtccagcgcgtcgccgaccccgtccccctccg

SEQ ID NO: 11564 - DNA, 1501 bp, Oryza sativa
tggcccacatgtcattgactcatgtgggtcctacatgtcattgagataccgatggtatatctcatactttgtaaaattataatggcatggttccaaattacccaaaaatctaagcccatctaaaaaatatgatttttgcaggcggaatcttatgtggtccgccagcaaaaataatgcctacagaaaaaatctaagccctatcccatccttatcctctccacaaccactcattttcctcacccttctctctctcatttccggctccctcccctctcagatccggtggaggggatgggcggcagcgacggcacggacggaggggatcgtcggcagctgctcgggtggagggcgctggccacgcgacgacgacgacgactacagccggccgcatcgcttcccctcccctcccgtcagctcccaaatctggcggaggggaggggcgtcagcggcggcacgggcggaggggtcagcggtggcactctctcatgtccctcagctctactctcctgcgctgccggccacaatgatgatgactaccgcgcgacgacaacggccctaccgcgcgatgacgacgacgactacggtcggccgcgtcgctagctcgctgctcctcccagatatggacagaagaggggggcggagacggcactcccctcgggcattggcggcggatggaggaggagagccatcgaggggaggggaaggccggcggctttttttttttcactgaaaatattttcacaggggtgtggatctaccgcctgtaaaaatgatttttgcaatatataatgtgtactgagaaagtgtggtgattttccttgaagtcttttcattcacgtcgatgtactgaactgtaccgaaatgcttagctagtaaggtttgaggatttaacccttcaaacatacactatgagaagcctaattaaacttctcatagcgtatgaggatttaattaggctaattacacatacactagtgtatgagaaggctaattaggctaattaggccaaacttcaaaaaatccaaaaagaagccttgtaagttgtaacacaagagaaacccaaacatgcatatgttttttggtttttgacgattcttaccacattctgttgcaacgcacccacattcaactagttgcttcatatatcttgaggtctttgaatatcagcgctaaacatatgtttaatactaggctaacacaatactaaaatggtcttaaaggttgtttggttcactgattacttcttctagttcaatcttacccaagaaaatggaattttttttatttataattttttttattaaaagttttacaaaaataattttccattttgaaaattgacggaagtagtcgcctaccgccctctgggacctcccagagggcggcgaaaatgacgtggcagacggccgttcgctctcgggcgacgaccgtcaacgaaatttgcaggcggcccccttgccgccctccgctagggtgattttatactgtgcagggggccgcc

SEQ ID NO: 11565 - DNA, 1501 bp, Oryza sativa
agactttacagattgaaggggagagagggggaagagagttggaggaagaataagggagtccaaattcaaagtgaaaagtttggctttagcctagtccaaattgtaacaatggtaatcaaaggtggctcaaggtgcaattcactctagaaaaatataataaaattttacaaaaaaaagtcatattatggatatatattgaatgttatatctaacaaaacaattttgtgtgatagatgttgttaaattttttatatatatttggtcaaacctaaataattttaattaagaaaaaagttaaaaggacttataatatgaaatagagggagtaactttttagaattatgattattttgctatgtaactattatcctttttctaaattgttagttaaaaatagatttgttatttataaaagcatgcatctaatcattaatcatttatatatttaggcatgggacatgcaatcaagagtccacagccattctcgtgagataaaagtgaagaaattaattattaagtaataaaagaaaaatcttaactaccatacataaaaaaggaaagaaatgagaaggagatgagaacttacgtacggtagtaattgaggaaggatatttttttatgagataaatctaattggcccatcagtttaaattattttttttctaatttattagagtgccacgtggcggcttaggaacgtttataggaatctcacgtggcaacttaagagcgtttgtaggaagtctaatgaacttttagtatataataatagaagatagataatagatagatagatagaagatagatagatagatagatagaagatttgctgttttccaaagagaaggttgggttatccaaattacaacaacgcatccatgcacacaatactaaaaaaaacattttcgtagacgtaatgattttttttctcaggcgggtatcacttttggagctaaataaccgcctacaaaaatataaaccggggtgaagctcgccgtccacctgcgaacatcatttttttcaggcggaccactatacagatccgtgttaaatccgcctgtgaaaatacatttattttcagtggcaaacctcctcttaagtgctccgtctaaaaaatatgatttttgcaggcgaatcttatgtggtccgcctgcaaaaataatgcgtacagaaaaaatctagggaaaattgaaaccatgccattataattttgcaaaatttgagatatgccatcctggcccacatgtcattgactcatgtgggtcctacatgtcattgagataccgatggtatatctcatactttgtaaaattataatggcatggttccaaattacccaaaaatctaagcccatctaaaaaatatgatttttgcaggcggaatcttatgtggtccgccagcaaaaataatgcctacagaaaaaatctaagccctatcccatccttatcctctccacaaccactcattttcctcacccttctctctctcatttccggctccc

SEQ ID NO: 11566 - DNA, 924 bp, Oryza sativa
cccccccccccccccccgccccccgcgccctccttccttggagtaggaaagaacagcaacctcttgcttgtcccaggaggtaatctgcaggaaataggagcatactaaaaagactcggccactacatacctttcttttataaaagaaagggtatggcataagttttatataatacttcgccatttcaatctaaatctatatatgtataatattccatacaaatgtttcttttctgagattaattaatttctttgtgagtttgttagactgataatattatttccactgcaacatgcagccatacagtgcgatattccagccagccccattgcaatgaaccgacagcacagggcaccattaacgccaatattgttatacattttttcctaatgccacttattcctgctgcattgtgttgatcaaccctcttttttttaaccacgttgtttattggcatattatctccgccgcggatgaagaaaggaattataacaatgatatttaagaaggaatgagatgagatataagggagaagttttaacagagtagtagaggtgtggagttttcgatcgatgcttttatcacaggcggcgtttgatcggagctagcacaagaagaagagccctacgtcacaggcgtttgtcagccacgctatagaacgatatcaacttcgcaaccaagataaaatagcacattgatacaataaggcccggtttagttccaaaaatatcccattgaatctttaaacataagtaagaatcattaaatatagattaaaacaactaactgtacagtttgcatagaaatcgtgagacgaatattttgagcctaattagtccataattagctataagtgctacagtaactcacatatactaatgacgaattaattagactcaaaagattcatctcgcggtttccagg

SEQ ID NO: 11567 - DNA, 1501 bp, Oryza sativa
ggcagtcccctctcgtgcctaggtgaatccaaaagccacataggccgtcgcagggcccatccaaactccatcacgctcacccttgcctggatgcgtcagctagaggaaagctacactacaagccaaccagttgcccacgctggcttgtggtaagtacgaggtattcttccagggtttcccgcgaaccggtccttaagtgtcatgggcgcgaccaacaaaaccatgcacccacagcccaccatttagttaattttaatttaccaacaccggagcggtggcaccaaaccaacatcaacactagaacctgaagtccaaacattaatgtgattgcccccattgtgtgctagttgaactaagcatggctaagcaatccctagcccaatatctagtcatgttatatcccaagctaacaaaggagcatggtaaaaatagcatggctataacagtaggtaaacatcccatggtatcattgtaaaacaaagcaatatttgaaggaaaacaatagaacatttgcaatataggatcaacatgttcaagtgacaagcatgacttgccttgctctgctgctggggaaacctcggcgactatctcaaagtataccggagcgtcgggagagccggaatctaagcgacatacaaagtaaacaatacaaacagactatatgactactgaaacagagaacaaaaccatttttaatggattctacgcatttttcttgatttactaagacttgaatgggcttaaacggagctcggatgaattagatatgaattttagaagattcacagtgtttttactataaacaaaaaaatccttaactgatttattgcgcaataaataaaccctgggagagagaggggcggcgccgacatgcgggccccacatggcagtggctgcgggtgctggtccatggtggatcgggtccacggaccgggaaaggggcggcgcaccacgtggtgccgactcggcggccacgcggcagccacgcgggcggacgaacggacagccccgatccacccgagtggatcggacggcggaggaggcggcacgcagccggcgcgcacgggcggttcaagccgacccggcggccgtggcgcgcggcggcacggcgcgacgcgacggcgacgcaaggcggcgagcggccgacggcggggagcggcggctaccgacgacgagcggcggcgcacggcgagcgacggcggcgcaactccgaacggcaaggcagcggcgctaagagggagaggggaaagacgacggggagatgctcaccgtggttcgcccagcacggggcgacggcgaatggcgatgagaaacgaccgggagatgacagtgaacggcggacggtctgtggaaccacctagcgagcaagaagagaggggttagagggagagaggaaaacgcgagagagcgagagcgccgaccgaagacggcggccatggcggtgcacaccggcgcacggcgaggagtggattccggcggcggattccgatggaggggtgga

SEQ ID NO: 11568 - DNA, 1501 bp, Oryza sativa
caccatccagatggacatagagaggatggacataccgggtctgccgttggtgttcgccggagtggaggccccgccgtctgcgccgccccatcaggactccgcgccgcgccgctgctccttcgctcgcttcacctgccgccatcgcgatatggcggccgccgccggcctcctccgtcccttgcttgcccaccgccggctacttcctccccagccatccgcggccctcgcctgcctggccgccgggctccgcggccaccgcgtgcatcctcaccgcccgtcgcccgctcggccgccgccgcccctcacttgcctggccgccgccgcctctcgccagctcgtccgccaccgccccttggctgcacagccgccgccgccgcctctcgccaactcctctgcgcagccactgcctgcaaagagaagtagtactagcggagaatcggagatggtagagaacaagcagtgaggaagtagtactagcagttccctagcgattaaatgaggggagaaaatgtagtaatgttaatttgttgggttatcattttaaatgcttcagtcacccaataaaaatatatctgttaaagtttattcgtttcaaaatattatggtgataaatacaacgttaaaattaagttgttcaaaatatatcccttaaaatataaatgtaaggttagttggaagatattactaaaatataggatgatgggatatggatgatatagtatagatgatgtgttggagttggaagggatatggatgaggaatctttttggatgataatccatatgggcatttgggggatgaaatatagatgagctgctagggatgctcttatgttcattctctgcaagaggttagcaatcccagtactagtggaatacttattattctaacacaaatatgcattgtaagcataactagttctcctttattttggtagtattgacggtcgaaactgatcgctaacgaccgtcaacaaaaccccctaagcttgaacctttgctcgtcacgagtaaaggatgaaaggaaacaaagacttggctgttgatcatgagttgctactatgctgtatatctcaaatgtataggttcaaggcatatgtactctctcttaaatcaaataatctttggcacggtggcttacccttacccctgattcccacgagacattgtctcttcttgccttaagcggttgaaagacagaacaacaattagagtactaatcacccaatcttcattcaacttttattccggaagttttcaaatgatttttgtaaaagaaatccaagttcctcaaatgattcactcggtctctccaagtgtatcaaaatgaattcctcaccattttgcctttttgattcctactctaaggttgatatgtgtagtttggtagggatcaaacatggcatacttgcattcacatttattactaagtcaaaaacatagactaaaatagatgactaaatatactcaagatcaagatcgtgtaaagtgtgtgtgtgtgt

SEQ ID NO: 11569 - DNA, 1501 bp, Oryza sativa
tggtctcgagaaaataccggtgtaaaagcaagagtgaaaccctaataaattaatgcagataataatcggaattggcatgtggaatttttcttgagatctacatgtcgaaatgtgctaacaagatttttagtggaatttccagagctctagaaataattttaaccaattaaaattgagcacaagcaatgtttaatccctggaaattcatttctttctttttctttttctttttcttttttcccccttttcttttcgaatgcgctgccggcccattcttctccccctccccctccccgctgggccagccgaaggccaaggcccagcagccggccacctcctccctcctcccttcgggtcgtcgacaggtggggcccacctgtcgtgcccgtctcccacctccagccggccccgccacatcccgcaaccgccgccccgctcgctcccgcgtctcccgggccacgtcgcctacctcgccacccgcgcccgctttccccgcacccactccctctctctccctcccgcgcccgcactcgagacggccgggattcaatttttgaatcctgcctctctctcctccccacctctccccactccgccggcgaaatcgcggtcaccccggccacgatcgaccctcgtgagtctatgtcacatcctgattttcgtcttacgatttataaattttttaataaatcattattagaatttatattaaatgttcatcaatttacaagtgaagttaaatgtgggaaataaaatttcctaaatataaagcatggatggatttaatttttattaaattctccatggttaattgtactctctggaattttctcggatttttcggagctcaattcctaattttaatcatacaaagaacatttcagtaattatccacatattaaattaatcattaaatggtctgattataatttttttaagtactttgagtgtccaagtattttcaggatttttcttgaaattatttgagcattggaagtatttttaacaattcaaagatcatttcagtgattattttaattgaaaaagttttaaaaaccctccccttggccgttgagccgtttcctgcccaactcctctctcctcgcgcgcgtgctgtgcggcccacgctggcccagtccaagccgccggcctcccccctctcagccagccaaaagtctactttacttccccgaatactgttcatcttcaagcttggacagaagcccgagctgccgtcctgtgccctgtgcagccgccggtttctccaccaaatccgccgcatcccgagctccgtttgcaaaattagttgaggggaaatattcctcttatcctcctctatcctttcccccaagaatcggactttatcccgaagaaatcaacgcggaatcgaattcgttttcgagtttatctctccaactaaccctctgtttttccggctcaaatcctctcggttggagtccgatctcttcaatccaagcctataaatagcatcccctagtcg

SEQ ID NO: 11570 - DNA, 1501 bp, Oryza sativa
ttaacttgaactgcagcgggaacaccactccacaggcatcctcgacggcacggacgaagcctactcctcggagaagccaccatctgacacgtactcaaactccggggttttggggaaaatagagtaaggctgagtacaaccaccgtactcagcaagtcataccaaaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccatccccagcgggcaacgggcagtcccctctcgtgcctaggtgaatccggaaggacagaggccgtcgcagggcccgtcccgctccatcatgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagcaatccctagtccaatatctagtcatgttatatccccaagctaacaaaggagcatggtacaaaaatagcatggctgtaacagtaggtaaagatcccatagtaacattataaaacgatgcagtttttaaaggaaaacgatagagcatttgcaatataggatcaacatgttcaagtgacaagcatgacttgcctcgctctgctgctggaggaacctcggcgactatttcaaagtacaccggagcgtgaggagagccggaatctaagcgacatacaaagcaaacaatacaaacatgctataagactactgaaacagagaacaaaatcatttttaatggattctatgcatttttcttgatttactgagacttgaatgggcttaaacggagctcggatgaattagatatgaattttagaagattcactgtgtttttactacaaacagaaaaaatccttaattgatttattgcgcaatatatcccagggctgacgtcaacaaaggggggcggcgccaacatgcgggccccaca

SEQ ID NO: 11571 - DNA, 574 bp, Oryza sativa
ttataggccgaatagtttgttaagtctgtttttattgagtgatcttttttaagatcatgtttattaggttcgcaacttgtatttaaaggttgttttgggaatttctacttggtaatttcaacttatatttgaaaattttcaattcaaattttttaaaaaaaatcaaatccacccaaaatttgaaaacttcgtatattaccatcgtgacaaagtgaatctcaatgctccctgccatgttgtttgaagtgatcttacgctgaatttctttttcattttcccaacctatctcacttgtttttcacgccaagtttttcaaactactaaacaatatgtttttttaaaaaaaatctatacgaaagttactttaaaaatcatattaatttatttttcaagttttttagattaatacttaattaatcatgcactaatgtgtaatatcgtttttcatgtagagaggcaggggcggagctagaacgaaatggaggagggtcctcttgcttaatttactctaatttagatcaagttttaagctgatatgtgtatgcctaagtttgtattaaggagggtgcacaca

SEQ ID NO: 11572 - DNA, 1501 bp, Oryza sativa
gctagttaattactcctcgtcccaaaatataacaatttttagcacttagagcaattttaatagtatagcccaccgttagctcaaaatcatctatagccaatgtaacagccaattcatacaatagttgcttactatactattaatacctggtcccacctgtcatacacacattatgtcttgtagtccgtgctgcagctggctacagatctgtagcccgctacttttctctctcttcctttatctctttaaaatatgtttatagttgacttatagcctgctattgtacatgctcttaggatttgtcccaaaatataacttcttcatcagcatttccttcctaaccaatcacaacccttcacttttcccacctacctccactgctcaaccaatcacaatctctttctatttaatgctatctatttttttaataaccgtgtccaactctaaaactgtctatattctgtgacggagggactattatatataaaaaaattcagcaacccctctcgggtcatttggttgggggagtttttaggagagattgagagtttagagggatgatgctattaattattctgtttggttgtgttaacaaccaaatttggtaatatcacactggtggagaaaccatctttcgtcggtcggccgatttccacaatagtcccggatgcaataaaaaccggggctaaagatgatctttagtcccggttcaaaagggtaacgggcatatttgatctttagtcccggtttctgttaccaaccgggactaacagatcctcgcgtcgaatgctgtcaggacctgtcaggcccccccgggatctttagtcccggttggtagcaccaaccgggactaaagatcttaactttagtcccggttggtaataccaaccgggactaatgatctcggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcgaggtgcctaaaaggtttgcaacttcatcctccaatgtttttttttgtcatactacatttgcacctatgttttgcacactttttttgtctccaaaatttagttgtaagttgatgagagagaaaatgtatgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 11573 - DNA, 219 bp, Oryza sativa
taagaggcaaaccctacattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagc

SEQ ID NO: 11574 - DNA, 1501 bp, Oryza sativa; identical to SEQ ID NO: 576

SEQ ID NO: 11575 - DNA, 1501 bp, Oryza sativa
gaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccgggggatgcgttgcggcgacagccagggtgaagccgaacggcgaccggaggcggaaaaaggcggccggtagggtggtatggcaggaaggtggttctggtggtggaggggaaaaatggatgggcggccgagcttgccctcgcggtggtaaagctaatggcggccgcggggtggctgagagcagtgaggtgtggccggaggcgacgaccggagtggcggaggatggtaacggcttgggtgggtggtggaggtgatgactcggccacggattggtggaacgaggcagtggccggtgctctgcttggagcggcgaagccgacactggcggtggtgcggcttggcggtggctagcgtggcgaggagagcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtgccggcggtttttcgcgggacggagtgggggaggggagcggggtcgtgggtgacgaggtcccacggtcgggcaggagtggtgcagggtggaggaggtgggcggggaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatga

SEQ ID NO: 11576 - DNA, 1501 bp, Oryza sativa
ttttggtaaaccctagcacgattcatcggcacaattccaaaagcttccctaatgatattcctcacatggtcctccatatttttaggccttggtgaattccgtggcctaaaaggttgtcgtggtgcaatactgttatattggccatatctaacatcttaagggcacccaacattaggatcattataagcattaggtatctatggaggaatatgaggattaaccggagctactagatgattaggtacatgaaaatggtgcaaaatataattattggtgattggatctacttcctgcatgggcagatttgtgctagtctgaccggtcgagaacctagtaggactggtggtcagtggtgcggttggaccaaccaaatggctagtcagatcataggtcgatgtggtcagaccagcttgagggccggtgggaccgttggtcaagattgtcagaccagcgtgtgggctggccaaaccgatgtggggagagtcggtcagaccaaccaggggcgcggtcatactagcctcagagctagggttagctttgctcctggcatattgcgtagtcgctccatcggttttgctatataagtggtgaataggggcttggctagtacttgtaatagaattgtgtggcaaatcggctgtaagagagcttaatttggaactcactaaagattcaattcttttgtcaaaataagaacccatatcatgttcaagtttattattgaaagtagcgttaatggtttcatctacggaacttgctacaagaagacaatcatgatcaggaaacctaaacgccttgcggtgatatagagtcgctaaccactccaaactagcaaaagctagatcaggatgggttttgatggattaaacatgctagcggagccgatttaggtagaacaagttataaataccggtctcatgggcaaaaagaaggtttataaaacaaacctacaaagggatttcgcacactcgcagggaaggtagatgatttacagtgcaaatcgacaaagatggatgaactaggctagaactaggtgaaatattgaaaaagcgattcaattggataaattggattgtgtgtagattgttttatttccaattataccggcctctttcctcatataggggttggtcttgcctccttcgtgtcctcctccactagtggcggacacacccattgggcagggtgggtcgatcgggccagctacggttcgtgtcgccccacacccctcaaacctcattttagtcctatttctaacacattagtcatcagtctactattgaataatcagataaatcaagtattttaagtagaaaccaaaacatttatgaaaattcgtgtataagtagtaccattttgaccgtttctaattttggccatacataaaattcaattttctttctatttctttagcatataatacagtctacagtaaatagttaaattgatatatttataaaaaatccattttattcacttgaactattttggggaagcacct

SEQ ID NO: 11577 - DNA, 1501 bp, Oryza sativa
agtagactgatgactaatgtgttagaaataggactaaaatgaggtttgaggggtgtggggcgacacgaaccgtagctggcccgatcgacccaccctgcccaatgggtgtgtccgccactagtggaggaggacacgaaggaggcaagaccaacccctatatgaggaaagaggccggtataattggaaataaaacaatctacacacaatccaatttatccaattgaatcgctttttcaatatttcacctagttctagcctagttcatccatctttgtcgatttgcactgtaaatcatctaccttccctgcgagtgtgcgaaatccctttgtaggtttgttttataaaccttctttttgcccatgagaccggtatttataacttgttctacctaaatcggctccgctagcatgtttaatccatcaaaacccatcctgatctagcttttgctagtttggagtggttagcgactctatatcaccgcaaggcgtttaggtttcctgatcatgattgtcttcttgtagcaagttccgtagatgaaaccattaacgctactttcaataataaacttgaacatgatatgggttcttattttgacaaaagaattgaatctttagtgagttccaaattaagctctcttacagccgatttgccacacaattctattacaagtactagccaagcccctattcaccacttatatagcaaaaccgatggagcgactacgcaatatgccaggagcaaagctaaccctagctctgaggctagtatgaccgcgcccctggttggtctgaccgactctccccacatcggtttggccagcccacacgctggtctgacaatcttgaccaacggtcccaccggccctcaagctggtctgaccacatcgacctatgatctgactagccatttggttggtccaaccgcaccactgaccaccagtcctactaggttctcgaccggtcagactagcacaaatctgcccatgcaggaagtagatccaatcaccaataattatattttgcaccattttcatgtacctaatcatctagtagctccggttaatcctcatattcctccatagatacctaatgcttataatgatcctaatgttgggtgcccttaagatgttagatatggccaatataacagtattgcaccacgacaaccttttaggccacggaattcaccaaggcctaaaaatatggaggaccatgtgaggaatatcattagggaagcttttggaattgtgccgatgaatcgtgctagggtttaccaaaagtcatatcctgattattttgatgatattccatatccttgtggttttagggttcccgaattcactaaattcaatggtgaggatagtagggaccacatgggaacatataggccaattcttagcataatgtggtgagctagtaacacgtatgctttcaaattgcgtttgttttctttatctttatccggtattgcatttatatggtttacttctttactggcaaat

SEQ ID NO: 11578 - DNA, 1453 bp, Oryza sativa
aagtacactgaacataaagaaagtgaatccaagttgtttgttcgtggtagctattcccagttatgaaccaagtgatatgttcgaagatagtctacagaggtcagattaaaaacacatctaacaacgaagctttagatttggcaggatcacgatcagaccataacaagtctagcagtaaagtcatttggggagacgtcaaagcatgtcaagtgggataagttggttctgttgagaaacatagttcaaaggcaaagttaccgacccttgcatcgaatagcagaagtaactagcacccggagacctggaaagctaatatgatgcagttagtggcaagtcgtcaaacagggtatccttggtaagtgggatatcttagactgaagcatttggtggtaagctggaaggaagctccaagcatggtatcctagtaatgacaagctgatatcgacgcataacatgaagtgggtaacttgtatgaggttgacgccaaagatatgaactatgagaagttctggaactgaagtcccatcttcaagtgccgcaacccagtcaaagtcagctaaaggttcaaccagggacaagtcaggtgaagagaagattccatctgcaacaggagatcgagccaagcagtccagagtggagaagttgtgctaggcaagtttgttatagaagacggaacggaagaagtcaggcaagaagagaagaccgcccaacctatcttcttgctaggctcctcgaatctcagggacgagattcctgtaaggggggtggatttgtcacgtcctgataaattcatcccaaaataaaaatcattttctaaaaggaataatagaattaattaaaattcgaaaagaaattgacaaacactaaaatacatgccagaaaaattcgaatgtggtccggagaatttttgttaaattctccttggtctaaaaggagccctcaaattttacttgaattttcagagcaccaaaaatatttattaaacaacaacaacaattatcagagtttattaaaaagaaaaacctaaaaataaccctctccttccctttgggccaagtctggcccaaggtttctcccctctccctctcggcccccggctgaagtccctctctcctccctctctttctctccctctccttctcttgggcctcctcttcccctcccggcccactccctcctctcctcctccttctgggccgcccctcccctccctccttcccgcccggcccaagccgcgccacccagccacctggcccacaccgagccgttcccgcacgcgcgcagcacgtgcggtcgtcttcctccttccgcacgacctgctctctctctccccggaaacctaacgccaaacctccccaaaatccacgtgattcaaaccgggaattccaaaattgattagggggaattaatcccctttccctcctctctctttcccccttaattcccccttgaa

SEQ ID NO: 11579 - DNA, 1501 bp, Oryza sativa
acatagatggttaaaacgaaagaactcaccgagatcaattgaaacgatgggttgcggccggaaaaactttacagtggcgaagaacagagcagcgtgggggcggcagtgctcggcttggtgcggcgaggtaaaacttgacgtagagcttcgattaggatctagtatgctaaaacatggtaggatataggtgttttaaggggtatttaaggtggaggatggatggaggggtgtggaggtgatcgcgcacaaggtgttcgactgacgggcgagggtggttgatggaatggattggtgaagcagagcttcggagttgcggggctatggttgttgatgatcgatgatgggcaaggaagggattggggtcctatttatagggccaaaagtaaaggatgagctcggacaccatcatcgccatggatgagctcaaggattggatatggcaaaggtggcagaggctgtgagggggcgggcaagatcaatttgagtggcgggaggccatgtttgaatacttacctgtgaaggattggcttgactgcgggtagaaatggctggcgacgtgttggcgccaatccgggcgtgacgcgtggcggcggcgagggttaaaacggccggctcgggtgtgattggtttgaattgtgagaggggaaaccaccttctatcttcaattcaaccttgcggcaagaattggcgcgattcatcccgggtagaatcaaaatcggactcggcggcagcgttggacgggagcgcacggcgtcgagctgtgatttcttgcggcagaggtcgtcctggctttgtcgtcgtcaagattggtgcggcggcggcggtctgagggcgtcggacgggcgatggcgcgcgaaggcagtcgggcacgcacaagcgatctcgaggcctacgcgctgcggcgcagcgcgcggcaagataggacgctaggcagcgcgcgagaaggggaggagaaggccaactaaaccatggtttttgagtgggatgtggtccccaaggtccaaacctaaactttgtgcaaggttggatgggtgttgggctgttctagctgggctgggcatttcatcgagcaccttgagtgcaatgaacagtgtttttcaggacttttgaatattttttctagagaaaattgaatttaaactatgaatttggaaaggttcactagggtttgaagtatataaaattctcaacaatattaggataaactagggaaataatctatagtttgaaatttgagagaatttgctcaaattcactaaggtttggaaattagtagggttctaaagaagtaatacttgaaccatttaagaatcaaataaatttttagaacacactaaattaatgaaaagccagcatgatgcaatcaaattttagtttaaaatttgaggatgttacactatttttccagacgcctcttaagggaccgcatgggaaaatatattttcgtaggaagcccccttaaaaattcccccagaagtctgagttaccgagttaccttctc

SEQ ID NO: 11580 - DNA, 647 bp, Oryza sativa
ggtaaccatgtaaattcccccgtaaaaccaaaaccctaaaggggggagcctgtaataggattataaatagccccctaaggccatgtaatagggggatccaaaaaattttactaagtaatacaattgtctttcttttccaaccactgttgagataaccacgcctttcgatgtgacacagttgtccattcgacaacagctagcgctgaccgtggggagctccgagcgaaaccacagatgccaccgaagaagatcgtcaaggagagagttttcaagcggaaggaaggtggaagcgaaggggagatggtagccgaagaggggtgttaacgaccaaatatggtaatttaggtatcggagatggagataaaatcgaagtagaatccaagatagagattgttccggaaatagagcaagaatcggctaaagtctaaatcggctacgatcaggatcagcagagttcgagtcgaactaggtagctgattgagccgattccgacaatgtgactcggtacacgttgtcgggttgagttaatatgcttcatagggattgccacgcacggattgagtcctgaaaaggcaattgtatctacaaattaggatatttatgtaatttccttagagataagtttgggcaaaagtctgccgcaaaga

SEQ ID NO: 11581 - DNA, 224 bp, Oryza sativa
ttaatttggcccgtttaagtttgtaagcactaaaatgtacaaatgttcaaatattagtcccggttattaaccttagctgggactaaagataaaatttcggaatagcgagaaaatatgttttgtcccggtttatatctttagtcccagttagaaccacgaaccgggactaaagatcccggactataaatatgggtccatcggcttccccgtgcacaacacttagc

SEQ ID NO: 11582 - DNA, 1501 bp, Oryza sativa
agtgtactcggcggagatggcgcgcaaccgagattgagatcgagaaactgctaagtgttgtgcacggggaagccgatggacccatatttatagtccgggatctttagtcccggttcgtggttctaactgggactaaagatataaaccgggacaaaacatattttctcgctattccgaaattttatctttagtcccagctaaggttaataaccgggactaatatttgaacatttgtacattttagtgcttacaaacttaaacgggccaaattaatttcattaaatatagatttaaaacaataataagtaatccattaaacatgtaataaaaccacaaattttatgagaaaacaatttaaatagtttaaaattcctaatacatttcaataatcacatataattaacatatgtcgtattttaaatagtttaaaattcctaatacatttcaataatcacatattaacatatgacctatttaaatagtttaaaattcctattacatttaataatcatatataattaacatatgacctaattaaatagtttaatcttccatgggtgaagttaatatgaaggtcttattatcagtcaaaaactcctcatcagatctttaataagggctctttttggtggagggatataattgctctctctgacttcttcagaggaattgctaaatgtgatctagtttctggaacatctgttctatattgggatgatctttggaatggccgagtgagaagtgtttcccatactcatatttgtgctcatgtttttgataggaatgaatcagttgcagttatctttgccaagctttttgaggattgttttaagttgcctttaacttatgattcttatggggaattcttagaactcagagaggagcttgatgccttgactttgtctggacaatttggggataatttggagcttcatctagaataaagcatgctatacttctaaaagtttttacaagttgaactttgctgccatgcaaccctcaaggccttttagatggatctagaagacaaagtgtgtcatgaagattaaggtgttcatttgtgtaacatcctgaaaattcacgacaataaaaatcactaaaattttgaactttttaaaacttttgcatcatgctggatgttatggttgttattgcttgccaaactataaattgtcacaattgaaaatttagctaaagctgtacaactaagtaatacttataaaattaagatatttattattaaatatttacacacaacaaagcaatacaaagagaaggttaattactaatttaatttataggttaaatattaaatattggaaccatgtgacaagtgtcatgacatctaagtaaccatgaaatagtcgccactacaatgactctgtatatataggagtgttccactagaataattaaattaatatttataacattcatcgagtctctcatggaataaaattgactcgcataaaataattgatcatgtaaatgaattgagctt

SEQ ID NO: 11583 - DNA, 1501 bp, Oryza sativa
tctccctcggattcgtttggaaacccctcccctaaccttgccggcgccattaatggcggccgggtctcccgcgcccgtcccccctcttccggccgccctctctcactcccaaccctatataaaccctccccgcgcctccctcgcccgtttccgcccttgccgcaccgtctcctcgccggaatcgagctcgcgccgtcgctctctctctccgccgtcgccgccgagctccggtccgccgccgtcgtcgccccggaccacctcccacctcggcgccgcctccttcggcttcggcgcatcctcgccgacctcgtccactctccgtttcggtcgctgaccgccggagcaccgtcgcccccgtccacccgagccgcgccgccgcctttttccgctccggtcgccgtttccgccgtcgctgtcgacccagggtgagccgtggaccaccgcttcatttccccctttccctcccctctctcggccgccgctccgccgtgcctatggccgccgccggcgaccataggggcgcgggcgcgccgcctcccgccgctgcgccggcgtggccgctttcgggtgtaccgtgcggctgccgcgtggggcccggccgtcggccgcccgcgtcctggggtgcggctgatgcgtgggacccacggcgccggcaggtgtgagcccgggtgcgcccggtccaccgtggaccgtgaggctgccgcgggggccccactcccgtggacccggtccgagcgcccctcccctcggctgacacaataaacctttttttttaattaaaatttaaatgaagaaatttgcaaatattcatttaaagagcatataaacttcaaatggccatatcttggccatttgaactcggaattggaccgttcaagtctctaatttttccttacgaagtcaagaacccatttttgtgctttgttcctacttgttatatggagtttattagagtaaaaggcttttcttttttcattggtcgtgtagacgctgcagcttaggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttacaactctagactttggaattttctcatcacctggacactatggaatggtttaattattgtggaattggattcacaccgctccctctattcaaaatccccaaaatggttttaggctgggctcggggtgcatggttttgatagtagcatctcggccgtgtaaggaccggt

SEQ ID NO: 11584 - DNA, 1501 bp, Oryza sativa
tgatggatcctatatattcgtgaggggtgtgaccggcggaggcattgcatcacatgagaaaccctagccgtcacttccctccccgagcaaaaccctagccgcgcgcgggtgctagaggcgccgctgtacgtgtggataccggtagaggcgccgctgttttgcggtgctgatcggtgtggcagtacggcgaggagaacgcacgaggaggacaaggtcgagccggtgcgattgactacttcctctacatcgacgcgcgctacttcgcgagagttccttcgacttctcagcgtcttcttttgctgcaccgcgcgtcgagtggtaacaatctatgatctaatacttgcatggttcctggtttacgcgatagaaaattttgatttatgctatcgtagcctacccgtatcccaacatgtccggccggggagcctcgcaatggtgatctctagcggtggtgagaaagtgatcgcaaggtgttcgatgaaatgcattcgagggaaaaaggcagagagggatggggtatttatgggggcttggcttggggataagccaggatggcgtggaggataagatcggcggctggcgcactcgatggctgtctacggcctaggttagggaggttgacgcggctaagtttcctcctctctcactaactcggggatttggggatccatggagtaatggtggcgctagggttgcaggcctcacagctagatggcttgaggagaagccgtttatccgatgggcacgacgagggacgatgtgacacgaggagatgggtgagaggacaatggtgacgaagaggcaacgtggtggccgttatccgtcgtggcgacgcgacggcgacgggatggcgatggcgcagctccgtgtttcctggagggaatctgggagatcggttggaggtgcggcacgggcgtggctggcgctggcggatgcggcgcatgggcatggtagcggtgagacgcgatttagggaatggcgcggcgcagagggatggatgcggcgcggtcggtttggggccagacccaaatcgagcatatggtgggcaatgaatagttctagctagaaaaagagagaaaagagagaaaaaggaaaaaggagggggaggggctaatatgcaaaagtggctgagattggaattgaattgagatgtaacattatacattttttatttgaatatttcatttaaatatttattcatttatttgattatttgttacaccccaactgaatttacttcgcccaaaattatcctatataccatggatgctttgatatttataggaatcactgcacattggttgaatttatttgtatagcaatgtattttacatggacatgtttaatctattattccataaaagtaaattgagacttggtaccatattgatctaaatgtttagttaaacactcacataaatgtattttatatataaagctcaattcatttacatgatcaattattttatgcgagtcaattttattccatgagagactcgat

SEQ ID NO: 11585 - DNA, 1501 bp, Oryza sativa
ttccaaacgaatccgagggagagagggagggaaaaatggggggaaagggggaggggatcccggggaataattcccccctattgattgcgcgcggggacggcgggaggcggcgggattcgcggcggcggcggcgctagggcgcgggcgaggcggcgggagcggcgggaggaaggggatgacgggtgggccccacccgtcagcgagggtggcgggcgagcccgcccgtcagcggcgcgcgcgcggggagggggccgaatgggccgcggggagaggaaagggagggggaaggagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatcacgatgcgagcgacgtcgtttctgttatctggctcacaggatcacagtggaaatagcaaatactcaacgtgaagacacagtggaagcagaggatttggtgctgcgaaaacttgctgcagcttttctgaactttgttcaaaatataaagaacagacgcggccgggcttctcgccacgaacctcaacaagtgcgccacgatcagtttgcaacatgtgccatcccacacgtccttttcgctacacacgacgcgcacgaacactcaaccacgcagggaggtgccggctcagatcctaaaaaccagctaacaagctaactgaaaaaaacagaaacgctgaagaaacgaaaacagctagacacgctacaggatacagagtaactgatttcatgaaaaagcttcaggattatccaacgatgccaacattgctcctcctaatcctgatgtttgggtttttacctcaacgactccacttgtgtcacgcagttcttggaacactgcacgacccagcggcttcgtgagaacgtccgccagctgatcaccggtggggaagaaatccacttcaattcggccatcctcgatgcagtcacggatgaaatgatacttagtatcaatatgtttacttccctcatgcagcattgggttcttgcacagagagattgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 11586 - DNA, 174 bp, Oryza sativa
attccacacatgtcgccatgccccgaagtatcaccatgatactgcaaagggggaaatcgtgacaagaccctccacataaccctcccctaaccatccacaccactctaaggtttcacccccacccctcaaaaggcagtgggcggtcccctcttgcgccgcggtgaatccggcagc

SEQ ID NO: 11587 - DNA, 1299 bp, Oryza sativa
gcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcctaatttttaatcatacaagagcatttcagtaattaaccacatattaaattaatcattaaatggtctaattgtaattttgttaagtactttgagtgtccaagtattttcatgattcttcttgaaattatttgagcattggaagtatttttaataattcaaagatcatttaactgattattttaatcgggaaattaataaaaatcctcctcctccacttgggccattttcagcccattccttcctcttctctctcccttgcgcgcatactgtacagcccaagcctactccaattcaagtgctctgttctgttctcatccaaccgaaaaaagtctagtttgcctccctggcactgttcatcttacagctctggacagatcccgagccagccgagcctgtgcacagtgccgccttcttccaccaaatccggacctcctcattgctcctccttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagt

SEQ ID NO: 11588 - DNA, 1501 bp, Oryza sativa
gcaggaggcacggagccggacggggaggggaccgcgcgatgcccgcggccgcggcgccggccatgcgcatgtggtcgatcgatcgcgcgtttaatttacggggcttattacgcgcggtccacgcgccacgggggtacacgtcgggacgtccccggccgtaggggagcgccgcgcgccaagcgatcgagccgcgcatccgtagcccgtgcgcgaggacgagactacgagagtggcttttacaaccgttggatggtgcgccacattactgatcgatggcgtactacgtattggcatatcgcggccgatggttaattaccttgtgttgtcagcggtgactttgaactagaaacgggccagctgagctgactttaataatctttccacaccactccggcggccactacctagctcggtttactttctgattgggtcgtctctaatgttggactttttttgtgtgtgactgtgagactgcggggtaaaatgggagaagaccgttatggctgattctaagagcagatataatagcaaattataagccagctgtaaacatatttcgagaagataagaaaagagagagaagagcagcaggctacagatttgtagctagctgtagcacggactacaagatacatgtgtatatgataggtgggaccataattgtgtttatatgtatatatgtaattggtgtatgaattagctattaaattaactataaatgatttggagtcaatagttggctataatgacctaatccagctgaggcatttacaaggttgtatgaccttgtccgggtgttagcttcttcgtttactacatgttcaaggtcaagacttattaattggccgtttttcccttttgtctcgggtaggaatttttcctcgtctaattgtcaacacgaaactgctgctgcagatacccacgcggcgacgaacgacaggttttttccgtttttcacttggtcgttacgtgcgaccgagggtatctactatcttagccattccaacgccgtctttcctcggtcctctctctacttggcaaatggcaaacacaggtggggacatcgtatggtgacaatgagtcaatgacatatcaagttttttttttttttttttgaaaaatgacatatcaagttgaatccagttgagatagtccacttgacaactcacacggcgagagagtccattgctcgatcaaatcagggcccaactcctgcggctcagttaatcggcctacttagtctcgcgcacagccggtttttgtacggcccagtgggtagagcagcccatgtaaacgcgagacgacgcgagacgccctgcgactgcagtgcaggctgctcccacgccgcggctccgccgcacttgctcggccgtccacgccggcacggcgtgcctgaggccaccgcaccacccccgaggagggaggccggtgggtctcctcgccccccccccgtcggctgcgcgccttctccgactctcgctgcgccgcgcgggtggcgtgg

SEQ ID NO: 11589 - DNA, 1501 bp, Oryza sativa
tctttgctttgggcctaccagattcatcaaccagcgcaacatcttcttgtttctgctgaggttctgctatggtatgattttgactattgactggtcggcttgtatggatacagcaatatatttgaaggttataactttgccacccactgaagaacccaacatctcggtgaaaaaccttgtgggaagtataactacaacagaatcagaactttgaaaaacaaaagagcatatagactcaaactgaaccacaatacgttaaaccccccaagtgtaaaaagcataatcatgagaacagtgaattgtgcaaatgttcccgttgcggcatttcatcaaacacttgacagtttcagcgagccactaaagtttcatcaaatacctgcaggccgacctacagcagcaatgattggaagcgcaaaactcaggtatccaaatcctcctacccctgatacgcacttaatacattcccatcgagaccgctgaatgtgaatcagagacagaggaaggggatcgatgggtgtttgttttcgtctcttacgatggtgagcaccgccgaggcgcgcgcagctcatggggaggcgccacgctggtagaaccgggggagggataaagcgcccgggacatcggccgccaccccttctccatcctccggagcaagagcacccggctgcccatggcccacgccacccgcgcggcgcagcgagagtcggagaaggcgcgcagccgacggggggggggcgaggagacccaccggcctccctcctcgggggtggtgcggtggcctcaggcacgccgtgccggcgtggacggccgagcaagtgcggcggagccgcggcgtgggagcagcctgcactgcagtcgcagggcgtctcgcgtcgtctcgcgtttacatgggctgctctacccactgggccgtacaaaaaccggctgtgcgcgagactaagtaggccgattaactgagccgcaggagttgggccctgatttgatcgagcaatggactctctcgccgtgtgagttgtcaagtggactatctcaactggattcaacttgatatgtcatttttcaaaaaaaaaaaaaaaaaacttgatatgtcattgactcattgtcaccatacgatgtccccacctgtgtttgccatttgccaagtagagagaggaccgaggaaagacggcgttggaatggctaagatagtagataccctcggtcgcacgtaacgaccaagtgaaaaacggaaaaaacctgtcgttcgtcgccgcgtgggtatctgcagcagcagtttcgtgttgacaattagacgaggaaaaattcctacccgagacaaaagggaaaaacggccaattaataagtcttgaccttgaacatgtagtaaacgaagaagctaacacccggacaaggtcatacaaccttgtaaatgcctcagctggattaggtcattatagccaactattgactccaaatcatttatagttaatttaatagctaattcatacaccaattacatata

SEQ ID NO: 11590 - DNA, 1501 bp, Oryza sativa
aatcaccctaaaaggatgcatcatgatatttacagaaaaactactgaaatggcgccgtaagaagataaacaatagaaaacgaataatgcaaactcacattttgtttgacagttgatgaatattcaatgcaaataaaacagttacctgaagaaagcgataaggaattgaatggccaactgctcttcgatgaacccatgatacttcataacgcttaaaggataatatctgtaaatgagttgtgtaaagtagttgctcatcagaattgttcttagcgccatcctttttcaagcacgcaaataaaggcagaagcgggaaagacacagatgttttcagagaacgcccaaaaaaaagctcatgaaatggcaaattggcaaattcagtgaatatccctgggatacagtggagtaccgaacaacttaaaaggcatatgtagcatatgtaaaacttgcacatgactgcattatcatttggaaccaataattaaaaatggtaatgtacccaaattgaacattgaatcttcattagcttttatctagcacatacaacagtcaacacctgaatgcaaataagcacggaagcaccacactgaaaatgttatctacttcataatggtggtgaactggttagtgctagcttggtaggttttgccatctcaaatcttatgtggaggaatctataaatacatatatgtgtttactatagtgccttttgtaaatgattgcacttcccagttatgtgtatatgtatgtggctgtttaatcatatgtgagttatctttgcaataattgagacctagggttcagttattttatttctatctttgaagtttacaagttgtgatttgttgattcgacatctgatgcaagcacaggtaccgtgtcaagtagatacagaaaattttagtgacaattgggaatatctccaactaaataactatgtttaataaaatgttggataagtctttgtggtccttggtcgtgattcttctttttgcttttgggtagtttcacctttttcaggatagcatctaccctttagcatatttttcagttgctaggacagctgcggttagtaggacagcagcagttagcatctcctttatgcctcctttatgctttattcagtttggatgccctctaggacaacatctcattcaaatttcaaattttagactaggagggtgcagcaataggctagcagccagctatggctatatatatgcatccaacctccctcgggtaggtatggcttttgtgttttatgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgcca

SEQ ID NO: 11591 - DNA, 1501 bp, Oryza sativa
cctgctgctgctgcttcttcttgctccccgctcccgctcccgctcccggcggtgacatcttcttgggaggaggaggagacgctggcggctcaggcggcatggttgtcgtcgtcgtcgaagaagcctcgcaggtggaggcggcgccgcgcgcgactgggaggatggaggagaggttggcggggaggtaggagaggaggccgcgcgggaggagtgggaacttaacgaccggcgaggcgggcaccgtggggacctggcaactcatgaggtcgatcgctttgcttcgctgtggtgtggtgtggtggcgagcagatggccgcaacctttatcttcagctagcttccgccagtgaccatcaaccatggccgtatttatagctagctatacgacctttctcactctattagagcaagttaaatagtatagccaacgaccagctccaattcatctacagccaatctaatagctcatttatacaatagttatatactacagtattaatacttagtcctacctgtcatgcaaacacggtgtcttggagtccgtgctacagctggctacaaatttatagcctgctgtccttctctcttctcatttatctcattaaaatatgtttgtatctgacttataggctgctattgtacctactcttatacggagtactactacttttcttgctttttaacggaaggagagaatggacggacttgtacttcatgtcaagggagaccttttcttttttatttcgatctaacatgtcgaattgacttttgaataaagtaggtttgtgtaatagcattagggatagatatatcaaattgaacaaaatgaaaatgcatttgtttgaaaggatgctggattgctgggtagtggaaagccaggacggtagatgatccaaaaaaaaatcatgtacaaattaaaagagagggagggttcaaaggagaaattaggggacttggtggcacgttgaaattcattgacttcacctacaggaaacaattaattaagagaaagaagttatgcttacttgactatttccatagtgtaatttggtcaggttgtctatatatctattcagactcatactaaaaacatgccgtcacgtataagccatgaaatagaaagaaagaaaaagagtggggaatgcactcacaaatagtccaattagaaagaatagttaatttacactcgatttatttaaaaatggacatcttgtcacgtctggtgctcaaaaaaattttaaaccctgcaaaacgtacttgtattaaggagtatgtaaaaaactttacatgtaaatagtgaggattgtctacggtactgctaatgtagtagtagaccctatgctgcagaagatgtgcatcggcttacaaagcctcgtaaagaacaaaagaagaagcaagaaaacagctccaaaatgaaaagcaaacataatttctgagctcttgccgtcgtattcattccgttcttaaatactacatccgtctcaacctcgtaattgcatagg

SEQ ID NO: 11592 - DNA, 721 bp, Oryza sativa
ctcctgcatttgcttagctgtataaattaaggaactcggttgctacagatgtgatatgtagcttctaatatgtcatctcagcaccatttctactttcaatggctgggccttggattttgtgtcctttcttcccagttgtgattcttaatattcacgttcagaagaacacacttcttaatgtgtgcaatcgcatactatgtacagatgtagcatttcatgagatgtcgagtatgcatcagatcatttatccttttcttttgtcagtcagatcatttatccttttcttttggcagtccacaaattttatgttgtatttctcccaagctatatatagtactgctgaatatagctgatgttatttggtatcatatcttgtaggctccctgggtgggttcaggcaaagtacaacaaacaactgatgtagacgtgaaagttaagcttgacaatggttcttaccatggagttgcttacatgcataactcatttgacctgtatagtcaattatatgatggaggtagttggagcatgcaaggtccagatccagcaactgatagtgctgggaaaattgttggttctcaagtcaaatctaatcttaaaagcaagaggaagacaattattgaaaaatcccgtgtttcttctgatgaggttaatgttgcaaagggtttattaccggataatgctggtcagaaaaatataatgaagcatgatgttattcgggaga

SEQ ID NO: 11593 - DNA, 1501 bp, Oryza sativa
ggcagaagcggcgaagcttccacgggtctccgcctatatatccccacccccaagcccgcgccttgccgacctttactcctcctaggcgtgtggcgggtttgactttctgactttgggagggagatttgtccaagaagaattccgttggaggaggattcggagagctccattggtctgtgggtcggtcggtccagcttgctggagaataagaagggggtgttgttgcgttgcgggcgagggaaggaggggaggagaggaggcgtcttgccgttggggttctgatccctcttggggctcccgtcgaggaggtaatctcggctttctctgcttcggttcgtggtagattcggtttcacggggggagattttttgcagagggacagggtgggggaaaataaaaggaggaagtttttcttgagattttcgtcgggtgctttggtttgattagctgtcgtcagtcgtcgccttgtttagttttacgggttgatctgaaggaaatcgtctggataggttgtggattcaggcggctactgcctcatgagtaagttctcatggcatgtgatgtgtcatgtgtgtcttctagccggaaaagaaattgtagaacagctttttggctttcttcatgttgcatccactgcttcatgtggcatggggagaggcagcgtggagaatccagctctttcatgggggtttagggatcaaagttgtgatttagctgtgtcggtagcctgaatttctggtggatttagttcagatgttgtataactgcagcgtgtggatgggggctggtgaaaaggaggtagctttgctccgtgcgttcttgatttcacacctgcaaatccatgtgtttaggcaatctttttcatcttatttctgccatatttcctactgggaggtgatagaaggcgacagatttgcacaggctaggagtatttttcgggtgttctatggatgtgtggggtttagattctactaagttcgaaaaacaataggagtggctttcttaattgtgtactttttaaaggcacctttatggatttggaagtagcagagtctccatatcctgtccacattcaggcatatagttaacattattgattttacaatagcgaattgtgcttagcaatcttctggttcttagtcacagcttgtgatgttgggttttttactcatcagtatgtatgtaggttattagacttatgttcaaatgatataagttttcttcagaaatcagccatgtacacaagggttagggaatgccagttcccacccagaaccttgtactttattttaaaatacaaaatatgaaaattacaaaagaggaaaattgagtctgttgtagtgactccatttttctcttttgtatattagtttaagatggtgttcatattgaaaatttgtgattctcatgtttggtacagtccaatcatctaattttttcttccttcaatacaaaattaatttcaactgttgttaataactgaagttaacaggtggcacga

SEQ ID NO: 11594 - DNA, 1501 bp, Oryza sativa
acaaaaaaaatgatgcacaattgtgggatttgaggagaatagacgttgggataaatagcaaacaggaggaagatgtagaataaaggttttaggtgataaattgattttgacaattgatttgttgtttttctaatcaaccttcgtcctcatatttatagaaaggtggatttgctttccaggatccaattaggctaaagaaatcaaactcaagaaatctcggtataaaataaggaaacgcaagaaattccttacttggactcggactctatgctgaaggcctgaccacatcatatttgtttggtctgactgattacacagtgacggttaaaactggccttcatgggaaagtcttagtgtttttcaaatttggccgttcttgctgccctgttacagaaaacagagcaatagccatatctccggaacaagcattagtatttttcaaggcttagtataatttgaaaaatactaaggcttgttcttgtcaaatttgtctgttccaaatttggttatcaacataaataacaaaaaagagtgatacaaacccttaatcttataaggcttgttcaggagatattcttgtaacaggattgcgactgcgctatagcaaccgaaggcacaaaaaactgttttgtgctggtttgtaactgcaagagagccaaacaaggccataaacgaaataccagtacaatggtcatcaataaggagcttttagccttactaattggaactattcgttcatatagaagacaaagattataggagagaaacattgttggccggttaacaatgcctcaaaacgactcttggcaccagtaaaataaaaagcactttgccatatatgatgataaagagaatacttgttgatactaagggtgtgttcggaacccagagttcccaattcacccctctctttttccgcgtgcacgtttttcaaactactaaacgatgtgtttttttgcaaaaaagtttttatacaaaagttgcttaaaaaaaccatattgatctatttttgaaaaaaaataataaatacttaattaatcacgcgctaatggactggtctgttttctgtgcggggagtttagttcccaactccccatatccgaacagggctgtgtttgaggagaaggagatagagaagattgggaagatacgcaaaatgaggtgagccattatcgcatgattaattgattattaactattttaaacttgaaaaatggattaatatgattttttaagcagctttctataattttttttttgcaaaacacacaccgtttagtagtttgggaagcgtgcgcgcggaaaacgaaacaaactcacacacaatcacccaggaaagaacacagataaatatattttttaaagatatatacaagatatgagaaaataaattgttgctacggttaaatggttcaacaacgatctttagcatatataaaataaacacttttgttgtataagggtgtaaacgaaagaaaaataccaatttttttaatggtta

SEQ ID NO: 11595 - DNA, 1501 bp, Oryza sativa
ttatatccgcagacattgagcaaatttaaaaaaaaaacgtatatatacataactttttcatacggaatcagatggagacaaactttatatcaacattgtagagctcgatgagatctacaactttcttattgattattttattatttgaggtcatttaaggagtctaaatattcattataatataccatattaatttttacaagatctcagaactgcaattcaaacaacaacatctgatggagatgtgttccatatcaaagttgtagaactcaacgggatctaccactttgtagtttataacagttgtatttgaaagcatttaaagtataaaacaaacattacaagtttcgaagatgtgaagtaaaataaataacatctccaatttatacaatggtaagtaagttatacatctagtaaaaggtcttgagaatagaaaatgataatcatatttgcatatggatctctaagagcaatagccatgaaaatcgattttcacatagggttgtgggatcgtctataaaattgacgatataaatgttggagatgttgaactaaaataataagcgatatcttttccttaatcaagaaactcaatttgaggggttttttatatactggtaaatattcgctatcgtattcgttccgtctcgtattcgctccgtatctgtattcgataatattcgatttcatttccgtatccgagttttcgattccgatttcaattcaaaaaaaataaaaacaaatatgataattccatccgttttcgatccgatttcattcctaatttcaaccaaacacgacctgagttcaggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggggtccggtcagatttggtgggagcgaagggca

SEQ ID NO: 11596 - DNA, 753 bp, Oryza sativa
gagagcgctctagccagctccactccaatttagatgaaactttttttgtttggttaggcttaagatccaagagagatgttgctatatctggagctgcaccaaatatgcccatagtaataactaggtgaaaccccgcgcattgctgcgggaatttaatatgataacaaaaaaaataacgtgtaaaataactagataacatcagattaagtaaattaatgtggtttatgataatttaaatttaaatagtatgtagaatggttattcaaacgtaaaaagtaaggtggtatgactttatgaaagaagaaaagtagggagatagtttggaccgtaaattaatcatctaaaggctaaaaataattgatgtgatatgacttaattagaggaaaaaaggagaaagataatttggaccatagattaatcatttaagcactaactaagtgaggatgaactatataagtatataggatatcataaaacataataaaaatatacattgaaacattatgtgaattgtgttgaatgataatttaacatgtttgtatttgaaaagctcttaaattataaaaactataaatatatagcatgtttgcatgatgtttaaatgtgatgattgttagtggatgatgatgtgacatcttgttaattagtggattagtagatgatgatgtggcatctttgcatgttaagcttaaggagttagtgggggataactttatagtaagataggataaatgggttttgtagtttcagaca

SEQ ID NO: 11597 - DNA, 1048 bp, Oryza sativa
acggcggtgtcggtgcggggttgccctaggcacggtggtggcgaaagagatcgatccgagatcgaaaaatgtctaagtgttggtggagaagacgagggcgcaccggcaatatatatacccccggatctttagtcccggttggtgagaacaaccgggagtaaaaatatctttactcccggttcgtaacaacaaccgggactaaagatcttttcccgctatttccaaattctttttaaacccggttagggttaggaaccgggactaaagataatagcagctgtgtcttgaatttcattgcatatgtgtttctaaaatagtaaataatgcattacaattatttaaagtcgaacaattaatgataaaaccttcgaaaaattattgttgtatgtactagaatacgtggattatatataataagcacatgaatgatttaaaattgttacaaattctaataatcatatataattagcatatgcatgatattaaattgtcaaaaattctaattaacatatgtaaatagcacatgcatgatttaaaattaatacaaaatataataatcatatataattagcatatcatgatattaaattgttgaaaattctaattaacatatgtaattaccacatgcatgattttaataaaaaatctaataatcatatataactagcatatcatgatattaaattgttgaaaattataattaacatatgtaaataccacgtgcatgatttaaaacctttaaaaattctaataatcatatataactagcatatggatgatttcaatttgattaaaattctaataatcatacataattaataaaaaatataataatcatatataactagcatatggatgatttcaatttgataaaaattctaataatcatacatatttaacatataccatacaacaattgatttgtatggatattcaatacatccaacatagtttacatcgtgtacagaacaattacggcaatacatcggcggtgacggttgaccgcacgtactttctcctcactattgttccttccttgtgatcgcta

SEQ ID NO: 11598 - DNA, 659 bp, Oryza sativa
ctcaactgcttagtttgtactagctattttcctagcttttgttactgtcttatttccttcaggttcgggtcgcagatatttggtagacgtttgctgactaatttgcctgaggaacggaagttggtgatcgatattatcgtattcgttcatatatcgtatggcatttcaaggtgtggtatatttttggcatttgttggtaccattatcaacatattgtaatatatttccctatttactttactagaaaaaatacccgtgcatgtaatgggtgaaggctattttattttattttatacggtttagttaaggtgaaagtcactgtgagaatttgcttggatatatatatttatagaaaatcataagttgtaattagagtccaatcattttaagttagcatgtatttttttaagagattttttatatgactcctgtatttccaaaaacgagcgaatttaaaactcaactcaaatacatatatgtatttctaaaagcgagcaaacttaaaaaccgatttatatatggaggatgtaccaaagtaccgataaaaacatcttcaattttatattaaggtgaaatatgccaatagtaccatagcacgtaaggtttgtaagttgttcaaaggagatctttttgtagtctgaataattggcttcttatac

SEQ ID NO: 11599 - DNA, 1501 bp, Oryza sativa
atggtatttttcttgtatatatataaataccccaaacactgaggtggtgtttatatcatggactaaattttagtctctgtcacattggatgtttggaactaattagaagtattaaacgtagactaataaaaaattaattgcataaataagagctaattcgcgaaacaaattttttaagcctaattaatctataattaggttatatttactgtagcatcatatatgctaatcatggattaattagactcaatagatttatatggggatgactagggatcggtcgcccgatcaaaatcttcaaaaatcgggcgctcgatttatgtgcgaaactactttaaactggtttttctctcagattacttatccaaatcatgattcgattacaccattaaattcgttgcaattaaatcttcaaaacaagaccacacatggatatattccgatgaaaaaaaattagcttattattgaattatttttaaatgttgcacgatgttccactaggtatattggaattgtttcactgagtagattgaaaatgtttcactcgtttaaatcgggtgttgtttcaccttatataaaaacaatgttttagcaaatagcgaaagaatatttcagttcactgcaacatttgatctatacatagtgaaacattataagtacactaggtgaaatatttttcagtggaacaaaaaataaaacgaattcccttaatagggggtttcaaaatatgtggttatttttgttgtaatggagtatttcagttcactgcaaattagatctatatatagtgaaacattgtgagaacactaggtgaaacatttttggtggaacaaaaaaataaaccgaattctcttaatagaggggttccaaaatatgtgagtaatttgttgcaatgacatatagtagcagagatgtggtggggcccagatctgcacgtgcggggaggggcgcgcggggggagcgcccgatccggctcccccgcactgggcgacggataataagcattatccgatttatatcacgaattaatccacggttatggaatgagttttgtcattagtttacgtttaatacttttaaccagtatctaaacatttgatttgatgtgagatgactaatatttagtcgggcattacggcaaggtatctctctcccgctgacaacccggtcacaccgaaccaacggtccagatcttcccttctccagatccaacggcggacacgcgctcccacctcctcatgagggcagggaccaccgaccgcgtccgaaacccagacctccccaccttcgtccgtctccgtcctgggcacccaacgcccaagggccaaggccataccatcgtcctctcccccaacctccttcccgcgccagatcagatccaccgccctctctctctctctctctctctctctctctctctctctcctccgctcgcctcagcggctaggggtttcgcctgccgctgccgccgccgccgccgctgggggacggctagcgaaga

SEQ ID NO: 11600 - DNA, 1501 bp, Oryza sativa
aaaaaaacaatctcaatgcacgatattatatgaacaatatcctatcatgatgcaatctaaaacatgccaacaagcactagtcataagctcacaattcatcatccatttaccaaaagtttaaatagaagaggcactcagaaatacctcaagattttagctgtcaacaatacatcacatgaaagaactagtgtggatagatagacatgtagtgatgtagaaactgcaaaacaaatggaaaagattgattagtatactatataattgagaattgagattaataagataaagagtaattgagattgactctgcctgctccctgctgcccctgcctgcgggcagctctacctgattgctagctagccgcctgcctcccgcggccgccacgcagctgcctgcctggccggctggccgccgcctgcctccccacgccggcacatcgccgcgccgctgcctggccgccgcggcgccgcctgcctccccgcgcggcctcaccctgccggcttccacgcccctcctcgagcagtgcccccaccgaccaccgcagcgccgccgctagcccccgtcggccgtcgcttgccctcagtcagattgaggatttggggggattgggaaattttggagttagggtttcatggtcaacaaatcaaaagccccatttaacacaaaaaaaaaaaggcccaatgggcctaattaggtggccagtggcctgttcgcacgcacgcaggcacgcggcttccgtcttgcatttgcaggcagcgatgccgccatcgccatgccggagttgtcgccgtcatgccgcctgggaggctgggattcgccgcgggggggaggggcggggggtccggcgggagagcaaggtatggcaaacgccacacctcggcctaccgagccctccgcccctgattatccctaaaaatcatataaaatctatagtttttgccgttgcaaccacagccgtccgacattgtacgctactgttttactggttcactgttgcattatgccaggaactgttcgattgtttgcttgactagatccggccgttcgttttttccttctttgcagccgctaccagcttccagatattcctctggtcgttcgcatgtacgccgccgccgcggcttgcccttgattccccatccgctcctgcgagttccttcgcatctccgccatcgacgctccaccgtgctcgcctccatctctaccacgccacctcgaccttgctcctcgatgacctctaccacaccattgctcatcctactgaggaagcggtggcagggccgcgccgccgccaacacccggcgcccatgggtgcacgccgcgccgtcacgaacgcgggacgtcgttcctcgcatcgcctcaacacctcgcggggagccagcgatggtggccggctctctccgctctctggccgggcggccggcggcagtccggctctccgcgactccgcctgtccgccattcggacgaggcggcaactccgtgttgacggtcgttgttat

SEQ ID NO: 11601 - DNA, 1303 bp, Oryza sativa
atctttatctagcaatctcagtgcttgtcctacttgatcttgcttgttcttcgattgcttgcaggatgagtgccctcatggccgggttgacgcgtaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcatgtcaacacctgggacaaatgctctacggcattcctctcgaaattcttcctgatgggcaaaaccaatgcccttcgtggaaggatttccagttgccagcagacaagggacgagtccattctagaagcatgggaatgactacaggagtacgtggccacctatcctcatcatgggatggataactggttgatcctgcagaatttttacaatggactcaccccaatctcccgcgatcacctggacacggtagctggaggagccttcttctctaaaacggttcaaggagccgttgaactaatatagaagatggtttccaatatgggttggagagagaaacgactccagacccgacagcgaggcatgcacaccatcaaggagacggaattacttgctgccaagctggacctcctcatgaaacgcttggacgaccacaagaaaaggtcacaaggcaccgtcaaggccttggactctcatgtcacgtgtgaggtctgcagcaacacggatcattctgggaatgactgccagaaaacccgtgaggaggcgatgtacatgggcaacaacaacgggtactgtccacaaggaggtcaggggtggaaccaaccacgcccatattatcaaggaggtaacaataactgtaacttttctaaccagccctccttgaaggatctcgtttttgcgcaagctaaaactactgatgcattaagcaaaaagcttgctgctaatgaaaaggtcctagaaaacatcaatgtcaaactagatggctttgcttctgcttttcaaaatcagctgagctttaataaaatgatagagacccagttagctcaggttgcatccttagtccctgcaaatgaaactaggaggatcccggggcaacccgacccctcaggtgaaaatgttaaggtgatcacgacgaggggaggtaagtccctcgtgatccgccatatcctaaccctgcaggaaccaatgggatgtcaaaagaagcgtcatctaatgactcggctgacaaagaggttcagccagaaaagactctgccgcaggagtactacgac

SEQ ID NO: 11602 - DNA, 1501 bp, Oryza sativa
cagcgggtcaagggaatcggtccaccgtggaccgggaccacggggtggcgcggctgagcacgggcacggctcaggctggcccggccgagcgacggctcgcggcggcgcggcctcctgcggcgacggccggtgcacgcgagaaagcggcggtgaggcgcggcaaggggatccgggcggcccaggcgagcggggcggtggcaagccggccggccgacctaacggcagcggcgcacggcccggtgggcgccggcggcggccaccggcgcggcagcgcgcacgggagacagaggagggaggcaaggagggagaggaggagctcaccaaggacgcggcgacgaggggcggggaaaggcgggggggggggggggtggagcttggcgtcggtgctcctcgggatgaaggcggaacggcggcccggcggcgttccgcaagcgggaaccggcggacggcggccggaaggacctgggaggatgggggagaggttaggagggggagagagggctcccagcggcatgaatcgctggtcggaggggagaacgggcggcggatgctcaccggcgcgaggggaaccgtgttccggcgggatcccggccgtgaaaagcggcggccgaggtgctcctcggcgctgcgaagcgagcagcggcgatagcgcgacttggggtggctagaagcggcgccaagcggcggctggagtcggcggcggcggtggatggaggcggtgcttcggaggcggggaggggaaatggagcggacgccggggtgcggcacgacgcggcgaagccgctggtggcggtcgtgcggaacgacggtggtgggagcggctgtggcgaccggctggagggtcgtcggccagcggcggtgggaggtgcgatggtggcggggttgttttcgtgcacgggagggctcgggagagaggggaaaatggagagggaggtgcggggaatgtttttataggggaggggaggcgggatcgagctcgagagaggtagaaaccggccggagacctgggaggagagagagatgctggaggcggcgacgtggccggattttgcgggagagcggggggaaaccgagcggacgtgggcgacaaccgcgtccacgcacgcgcgggagagggagtcccgcaagagaagccgcgacgtgggaggattggcggccatggcggcggttggggattgagctagaggtaggagatgacaggtggggcccacctatcggagagagggggagaggaaaacgggctagggaggatatgtagacttgagggagagagagagccgattgtgccgaggaagggaagcccggcctaggaaggaggaggggaggaatttgggccgagcccgaaaggaaggaaggggaagattattttcttttctttttattcttattggttaaatgaactttgtgctatttaaaattatttcttgagctccgaaaattcacgggaaatttcagagagtattttagggcacaaagaatattgcaaaatattcccggccaa

SEQ ID NO: 11603 - DNA, 1501 bp, Oryza sativa
tggggcgtggagcggcggccgaatgcgccgccccctcgcctcgccatgccatgttggatccgccgacgcctcgccttcccgggcaggattatccccggatccatcatcacgccggatacgccctaccatggccggatccgcgcgcgtggggcgtagatcggcggctgggtgcgccgcctcgtcgcctcctacacgccgtcaaccgtcgcctccacgcctgccgccgtgtcgtaccggatccgtcgacgtcgcgcccgccgccgctcggcagtggaggtggcgctcgacgtcgcgccgccagccgtgtcgtgccggatccgcccaatgccgccaccactcgccgccacgcccgctcgccgctctcatctccgaaaaaataggatctacatatgtggttggttacggggtggatgtacaacactggtatatatatacactaaaagttgagtaacatcaagttaaattttaactcaaatacgtggtggtgggtggggggaaggtgggacagggtggtggtgcggctgtgtcaggcgccatctaatacgtggcgcctgtagcgccatatagtagttctatatgtatgtatatgtatatatatgtatgtatatgtatgtatatatatgtgtatatatgtatatatatatgtatatatatatgtatatatatatatgtatgtatgtatgtatgtatgtacgtgattgaaaatgtgtcatttcatatatatcaacaatatactgaaataatggagaattattttatttgatgataagctgctttagcagattatgtatgcctcactgacatgtagtagatgctaccataacatattaaatcaacgtaaagagtggatttgaatctttttagacctacatgacacccaagacaaattcgagaatttagaaatacattttgagagtgatatctagatgacacactcgcataagtttaggatagtccttatacttatcagcctcatcttttcgcttatgcttattcttatcagccaaaattcgaattttcaactttaaatttggagttgattttgaggtttttgttactgggattttgaggttttttcatcggagtttatttttcagcttttgcttttagatcactaagaacacgtatatatatataaaagttttattcacagattaattttcgtttgcatatatgccgtttcccttattcccggaataagcgaaatgatggagcacttcactcttgttttttattttggccggtttcaattctggaacgggcagaacatctttcagagaaatcatcatcgatcagcctaaaatcaaccagggactgttcaccgactttacaatatatttcttctgaggaataggtacaatcggggactgttcatcgcctttacaatcggtacatactatgctgcaggcaacagctcaggctgcatttagttcgacgtaaagtttagattttggttgaaattggagatgatgtgactgaaaagttgtgtgtgcatgacagg

SEQ ID NO: 11604 - DNA, 519 bp, Oryza sativa
gggggggtgtcaataagggaataaaaacaaaattgcacccaataaagttcttttctagcattttacatgtgctaaggttgctgagcagtaatctactttgacagcggtgcattttatttggcagatttggattagttttattgtactgaagttgtaacttgactgttagagcgatgtggagcacggcgtccagaatgtatgctgatcactgttgtgtggttatatatagtgtgacgtgcattatagttattctttgatcatctgttattaacttactgtacattgttataggcatgattgaactcatgttcttgaatgtctgctctgcacctgcagcagtgttagccgtgttttagatatgctactttagctgcctttctagtttaccatggtatataaattaatttgattacacttgtgtcacaatcatttgctgtactaaactgaactcttcatgtgccgtagatttcactgcaagcagtttgttcctgaaatgagattatgtgcttgatgttttgc

SEQ ID NO: 11605 - DNA, 1501 bp, Oryza sativa
tgaaagtaacatattgttgtgaacttaatattggttttgtaaacttaatttagcataaattgatagtttaaaagtttagtaaaatttcactttgggtcaccttttattaccggtatttctctttggatcactatttaaccaatgttttcactttggatcgagtaatattacttttgctgcattttggattgcccttactctctttcaagcatacgaatgattttgagtacgccaactctgattcgtcagtgaactcccaccgctttatatagacaatttatttgacaaatgacaaatttaatgtagatggataaaagagttgatggtgatccaaagtgacacaaagtaagattacccggtttaaagtgaaaacattagttaaagagtaatgtaaagtgaaacaatcgtaataaaaggtggtccaaagtgaaacttatttagtgaatattatcctgcacttgagattaaaaagtgtcatgcagggaaaacactagttatatggtgatagagtcgtaggcgtatgactccaccattcaccagggttcaaaatcttgataccacgaatattatattttgcctacacatataggtgaactttcaacaaaattttagtgagatgagtgatgtgccattgatttttgtctctttttttagaagtacaaactcaggcgctcacataatgcgtgagcgtgtgtgagtatggtgttacatgtttaatagtgtgtgtgggtgtgtgtctaatgtgtaattgaataaaaaaaatcatacaagtcatatgttttctaatttaatgagttgttacatatccaattggcatgtaggaccaaaatatcatcaatttcaatgctacagaaaaataattttttaaaaaagatgccgctgcaaaatcatcatcatttacttattttgtcaccacatcactctaaatcaattagattactcttatcctatggccttatccaaaatactccaatttacctatcctaaaatcggtcataaggattctaacggatcaacccatgaatctatttgtaggcaaaattagtttgttaaaccgtggattgactcatgacttatctactaattcaagctataaatagatttatggattgatccacttacatttttaaggcgtggaaagcggcaagggaattcataggttatcaactagtttcgcggatggacccgtttgtatacggccctattccaatcaaaaaaaaagaaaaaaaaagaaaagaaaaccaaagaacaccgacgcgggcaagaaatggagtttccagttccaaccgcaaattttttgcgaaccttgaacgtaacaacgttgaccccaaggggacaagcttttttttcttcttccttttcaacccccacaaaaaatttggcttttttcttcttccttttccttttctttctttcaaatcttttcaaccggcggcccgatctcttccccccacccccacctcgtcaccggcggggaggagggcccggccgccggcagcca

SEQ ID NO: 11606 - DNA, 1501 bp, Oryza sativa
gtcaataccaccacatacgcccacgcaaccccgattttctcggtgcatcaacgaaccatcacaaaccatctactgcaatcgccagaacagccaggcaagagaattcacccaatccgaacccggaccagcacccccagccgaggaccgcgtcgaaatcccccccgcgcgcgcgcgcacagggagtaccatagcaagcaatggagggagagagagagagagatcgggagtggaggggacctgtagaagtcgacggacttgagcttactgaaggagatcatggctgccggcggccgggccctcctccccgccggtgacgaggtgggggtggggggaagagatcgggccgccggttgaaaagatttgaaagaaagaaaaggaaaaggaagaagaaaaaagccaaattttttgtgggggttgaaaaggaagaagaaaaaaaagcttgtccccttggggtcaacgttgttacgttcaaggttcgcaaaaaatttgcggttggaactggaaactccatttcttgcccgcgtcggtgttctttggttttcttttctttttttttctttttttttgattggaatagggccgtatacaaacgggtccatccgcgaaactagttgataacctatgaattcccttgccgctttccacgccttaaaaatgtaagtggatcaatccataaatctatttatagcttgaattagtagataagtcatgagtcaatccacggtttaacaaactaattttgcctacaaatagattcatgggttgatccgttagaatccttatgaccgattttaggataggtaaattggagtattttggataaggccataggataagagtaatctaattgatttagagtgatgtggtgacaaaataagtaaatgatgatgattttgcagcggcatcttttttaaaaaattatttttctgtagcattgaaattgatgatattttggtcctacatgccaattggatatgtaacaactcattaaattagaaaacatatgacttgtatgattttttttattcaattacacattagacacacacccacacacactattaaacatgtaacaccatactcacacacgctcacgcattatgtgagcgcctgagtttgtacttctaaaaaaagagacaaaaatcaatggcacatcactcatctcactaaaattttgttgaaagttcacctatatgtgtaggcaaaatataatattcgtggtatcaagattttgaaccctggtgaatggtggagtcatacgcctacgactctatcaccatataactagtgttttccctgcatgacactttttaatctcaagtgcaggataatattcactaaataagtttcactttggaccaccttttattacgattgtttcactttacattactctttaactaatgttttcactttaaaccgggtaatcttactttgtgtcactttggatcaccatcaactcttttatccatctacattaaatttgtcatttgtcaaataa

SEQ ID NO: 11607 - DNA, 1501 bp, Oryza sativa
cttccctgaaaatgctaggcaaattctcttcacaattttaaacgtgcgtaaaatatacgttattagtactacatgttcacaactgtaacgatacgtagcccatacgcaacatgaaaaatatgcatttctcgaaaaaatattaattaatatacaaaatcacttactaacaattaaaatgtagttgtcgatgtttttctattttgaatgtagaaataatcattgagctatttcaacatcatacacacaacgaacaaagaattgaggaatcaactgttatatgtaccaaaccatgaataaattggtatggtaaaaatagatatgtgcaaatgaatgtgttgatttagtattagaaaaattcctgtcattattttatcagaaaagagaaaatatttcataaatgaatacctgagatgtgctaagatttgatcattctgtttcatgcattctagcaaaaacggattctcaaacagtaaagatgaaacatatacagatgaacatttccatacattagatactactttgtgcagcaatttagttagggcttgttcggaacggagggattacacaggattttgtaggattggcaaatcctttggatttggccatgttcatgcattcggttcataggaagcacgtgtaggaattttgtaggaatactatagcaaccctgtgaaaatgcgggaattccataggattctgaacatccactcacacctcatttttttcattagctaccacagggtagatgctaatcacgttggagtgactagatgggaactaatattttattgcttaattatactataattatactataatatatgagatcaatattaattagaacatttctatggtttatatattcatgtattccgaacgcttcatatcatcaaattccattgtttttcaattatacgttttgcatatgcaatcctatattattcctgtgttttcctattcctatgtttttcctatcctgtgatccgaacaagcccttagcaggcacaaatcatggaagcactagccttttcttaacataatgcatagtatttatgtcctcccaatatggttatagctgaatttaatcgtgcatggtggatcgatagtgcattatatacaattaaccgagcattatgtataaaacatgaccataaattaatcgcaaataattgtaatatcgaaaaacgacacagcggacaaactgtatataaaaaagaaagaaatgcacattttaagaagaaaaaagaaaggcaataattcagaggcagcaaaaatcaaaaacctcactacggtgagaaagatgccatggctggcgacatacatgcacaaaaccggctcccttcttcttcgcgcgctccctataaataccttccttcccccaacaccttccccctacccatcgccgccatagacgtacggacggccggctacaacacaacacagtaactgtaactgaagaagccggcgccaccattcccgccggcaatatgctcgccggcgc

SEQ ID NO: 11608 - DNA, 1501 bp, Oryza sativa
tctagagaagactccatttgtactggattatagtggaagcttggagtggaccgttggtcccgtggttttttactcctcacaccgaggggatttttccacgtaaatcactgtgtcttgagggctgatcactgttatccgctgatgattatacaagctaagctcaactagctatcgatagcggccgatcgaagccatgatgtagcgcccgttccatcgtggcgcctagcgggaaaatttaaattctaaaaaccctaattgcgaaaattgtttctttgcttgttgtcagtctccgtgccaattccaaatctcaaatccccaatccatcgtcaaattcaaatccctaatatcaatccttctcgaaaagtctattttgcctcccttaggtccggtgggccgattccctctcggcccatctttctctctctctctctctctcccctccctcactctgcccgtgcgccgcacgcgcacgcgcgtgcacgtgcgcgagagccgcgccgagcgcctctccctccctctccgctctcgctgccgttcccgccgacgccgcccaaatcgccgcgccgcccgttgcttcccgcgcgcgcgcgccgtggtggccaaccggccagtcgccgccgcagtcagccctctgccgcgcctgagcccgggcctgccgcccgtgtcaccgctccgttccaaaccgcccccgccgtcatcgccgttgtcacgacccggccccgccactccgcgcgctagcttccaagggatggaggcagagctcctcctccctctgccgcgtcgccctttctccctccgccttttcccaaagtggcaaagggcaagcccccctttctctcctcctttttccctcttctcttccgccggcgtcacccccctccccgacgccgttttggccgcgaccgccgagctctagctctctcccttgaccgccctaggtcggttcccaaaccgacatcgcctcctatttaaccaaggcaccctcccatcgattcctcctcccgtttcgctcgccaccaccgcgccattgccgcccctctgtctcgcctccgccgttcatcgccaagcaccgggagagccggtgcgtgcgaaggacgcgtgaaggggacttcgggcgcatcgtcttcctccgcttccccagcctgaggccggagagatcactcccgtgccatcggcccatcgtcactgcgcctcgtcccgcatggtagtgcatctccccgttctccctcttcgttccccctcttccccttagctttcgatagaagcttgtgtagcctccccgtagctagctggcgccgccccaagccttgccgctgcccactgtgtgctcgccgccgtcaccgcccgagctcggtagcgcctctcgtcgccggcctccctcggtgcgttccctcctaatccggcgcaaggaatggattcccggagtcgcgttgatgctctagctcgcccgaattgatctcccgtcgcgccgtcgccgtttccctcttctctcgccgccgga

SEQ ID NO: 11609 - DNA, 1501 bp, Oryza sativa
gtgagtcagctagctgtggagagtttttcttttgttacgatacaatgtactagttacacacacatatactatcagtataaatgattcaaaatatttaaattggtttgttgtttgacttaaatagaatgtaatataaaattgaatgaggtaaaattgtcttttagtcctaccacatgaagggcgattcgattgcatgcggatgatcaatattcatatcggggtatatatatgtgaacatgtgatggatgcttgacatgcatatatgtgcagcagttgatactactccagttatctcgatctactaattgatcaatcaattattgttccgcttacacatacacgtatatatgtgtgtgtacaacgtgtttgttcactgatagtgtcgtgtgaggatcaaaaggaccacgtaaccaacacgtggccggccggccagtagcaatatatatatatagagtagaacttaaagagttgaaaatatcatgtacaatcatcgatcatgcgtatatattcctgcatgcatatagagttggatcgatcgaattcgatcagcacatgaactactctcttgttatacatccactcatatttttatactcaatcactcctgtatgtacctgctgcctgctgcaggttccatcgtgtcctagaagtagatgagatggatgttcctgtcaacaaacaagcccaataagagacaagatgggctggtcatcgcatccagtgttctatgggccgtatcttggaatcgggtacggctatgcggattgggccggcccatttacatggaatatcatataagcgtgcatgtgatcgtacaaagcaaaagttttggcctggccctcaaaaaagagagaagaaaaacagagaggttaggttagtttggagaaagttcctagccaggaacaggaaggaagaaggcacatgcagcagttcaaaattattagaggctgcacatcgcactctatcttgtgcaagactcgtgaccatcaaatcccaatctaacaattgtgattcaacgtatgtgtggacaacatatatacatagcaaaagaaattaaagaaaatgtgtgtgaccacacatacatcttgttcaattatttttctcgtgaaaaacaaaatcaatggacggccatgggaaaaagagataccagatctgaatcctgaaggtacatgtgattggctcacaaattattttttttaaaaaaaaaagctcaaaaaaagttaaggggtgaagaagaaaccaaaaaagaaaagcaaggcgaccacccccaagacggccggacagcatcggcgatgtgcatcgtgtggtggtcgttgccccatccactcccccgcagataagccaaccagtcgccgctcgccacgtggcacccttccacttccttcttattgcctcagcctccttcaacctcacgctcacattcttgctagctcactcctctcctcctcgtctaccttacctagcagcagcagctagctagcttaattagctatagcagcca

SEQ ID NO: 11610 - DNA, 1385 bp, Oryza sativa
ctaaaaccaaaggtcatgcttacacacacagggtttcaccaccctacctgcccactccttttgtctttcttaggaatatattaactccatacccacaaagcaagtctgcacgcaccatttctccattaccttatacacaaaaaaagactgtccttttgcaattaacacatgttcatgttatatcgccatgcttttcttccaactctggtgcctgcagacaaaatcaaactggctcctttttcaactcttctttttttcccttttagatatctggatcccttttcacttcatgttagatgtcttccctttgcctccgggcttgtgctaccaaatcacaccttattggatattaaggtcaatatccaagacaaacacacaatacagattttaaatttaaagtttacatgtatggagcttcttgcaatgacattttccatacaaagactatgaataattcgaggttaattaaagaagggagtaaacaaagaagaattaacaactagctacagcttatgcatccattttctgtgtcttagttgcctgtggttggcccatttaccagctttggcacaattctggctttcaataaatactgctgaaagatacaacagattaatggttgtttgacttaaattttcctcacatgctgcaacttatgacacggttttctattttttctttgttttctttttttgcggtgttcaccatgggaatgacttgatgcaacttaagcatgttttcacattcttatattgtttattgcctcttcaaaataactaaatcttcaaaccgtggtgatgctcaatgtgtttaaaagcgaaagagattcttgaaggtagcgattgacaagtagactttgttgtaatcatatctggttctggtactaagctgtgaagatatcgattgctttggtcttaagaaaacaaaggggccatactcactcagtttatcataccatatcatcttacttttttctttttaattggcgttctaaagtaggaagttcttataccaaagtttataaatacagttgttgtatttaaaagtgtaaacttgatgcagctcctttttctcatcacacttcagaattaagccactcctcaacagtgacggctgaggattttctactcgtatgtctttgagggtggaaaatccacaaacatgttccagactctgtgtgcactcttatggtttctttaaaaaagctggtcgcaagccttttctcaaaaaaaaaaaaaaatccaccaaacccacctaaaaatactgtggcctattttgcagctactgaataaattcatttttttaccacaaagatacaaacctgtatcttgtggttgtccattcacactctgaattttgacttgttatttgttattaaaaaaatt

SEQ ID NO: 11611 - DNA, 1501 bp, Oryza sativa
actagttgttaccagataatttttaactataagtctatggtaatagtagtatttgtttaggtttatacataaaagttgatgtattttggattggaggttgtatgtcacagaataaaaattaagatatgtcatgacattatatatacggagaatgataattagaccccaaatccaaccactgcgatacttcacaaaaaaatacgttaagtatacatgtgtgtgtatatatataaacattggacatgtttgggagcttctgatggctgtattttctcctaaaatccgaacctcccacaacaatacaaacaactctaaagctatagaccggcatgtatttatttactattctttgtctagatttattatcttagaagaggtcatatattcccttaattaaattaagttctgtaacgcattgtaaatgcagtcatcaaattaataatggttcctagttttctccgtacgttgaaatctctgtcccaaccatactagtagctgctaggtcgctaattaattaactaaactgtctcaagtttatcgagttgttaaattgttaagtgaacttggggttttcaccactgcgtgctcttcggtctaggaatctactgtaagcaagttactaataattaatactccatcgttctttacatcgtacgtgtttgataaagctcctaacttagcttcgtaaattcatacatctatgggcctgttcactttaatgtcaaaaaaaactttatatagttaccaaaattttgacaggatttcttatatagttatcaaaatttgacagcaaactaaatatagccacttttttttacaactttaacaagattgaaaatgacatcaaaatgaacaggccctataatccagagctccaagatctaaatatgtaattatgttgataatatttaaatacatcatttttttattttcaataaaacataaaatattaattactatttcctccgtaaaaaaatcaatctaggagagggtaacaaactacgagagccagtatatatgagagaaactacgagaggcagtatatatatatatgagagaaaataaactcttaggttacatttttatcatatatttttaatacaaagtatagtgataagaagcgtacgtcacgagtgagtcaccttgtttgtggagttttttttttgtctttataattatttttaatatagaagaggaagaaactgcggtcagagtcacgcctttctgtgggccccacccccaaccaaaccctcaaagtcgcagcttgcgtcatccaggtcccaacccggtgggccccaccgcatccgcatccacccgcggtgtgggggaaaatcccagccgtccgcagttaccatccgcaccgtccatccctctacgcagatccgatccctttccgctccggataagagatgccacgcgtcgtgtccccattggctggaccgctacgtgtccccattgttcacacggccacggcagatcggaatattctgaaaaggaaata

SEQ ID NO: 11612 - DNA, 1501 bp, Oryza sativa
atttttttttaatacacaatgtttaagagaaacaaaattaaaagtaattaatcaactgcctagaagatatgatatgagagatagttatatactaaaatgagagagagagggagggttgaaatgaactagacaaaagtgtcaccatatttttggtaaaaaaatgttttgtttccctcaagggctcatttgctttgtaggattttcacaacatagaaatagaaaaaaaagtaggaatatatgataatacatgtgtttaagagaaacaaaattaaaagtaattaatcaactgcctagaagatatgatatgagagatagttatatactaaaatgagagagagagagagattacatatatagggctgaaatgaacaaaagtgtcaccacatttttggtaaaaaaaaagttttgtttccctcaagggctcatttgctttgtaggattttcacaacataaaaatagaaaaaaaagtaggaatatatgataatacatgtgcaaacctaagggttgaaaacatagtaaacttttctatggttgttcggtaaacagtacaaaggattgaaaacattatgttgaggtggattttttttcctcctaaagtagagggatatgaaatttgcctttcgtgagtttctttaaaacaaatgggcagtttagtgttaaaggatgacatatttcagtacttttccattacaatttctttagaaggaacaagccctaaacctcgtaaacaatgtaggagaataattgaagagggagcaaacagatttgaagcggtgcgtacagttggacttggaaggtcgaaccatctgacgaaagaggcctagctattatcattctataaactaatgggccgtctcaagtgggctctaacgaatattatttgtataaataagtttacagagataattagcaacaataatggttccatggtgtagtggttagcactccagactttgaatctggcgacctgggttcgaatcccggtgggaccttttttttttctttaatttttttttctcttggcattcttcccttgagcatcttgtgttgtccggttccaaaattgtgtgtatttatactacaatagaaatcttctatttcaaaattacttttcaaaattgtgtgtattttttttgatacattgcatcacccataaaaatgtgatgtctcggaaagggcatgttcattttgatgccattttcaaccatattattttttataaagctgccaaataaaatttatgtttagtttgttactaaatttgataaatatataagaaatcgtactaaaattttagtaatattgccatcttgctaaaaattagtaaggtttattttagctacaatctgaacaggcttaaagtttatctctttgtttttttctaagataagaaaaatgttgttgaccaggaaaaaggaaaagttaatgagttatgttaccgggagttattacaagtagagtgagaggagacggcgcggcggcggcggcggcggcgggatgg

SEQ ID NO: 11613 - DNA, 1501 bp, Oryza sativa
cgctactcgatcgagcgatgatgtaccatgcatatcctcatctttgcacagcccaggcactcataagctcgctttttctcatgtataaatagctcacaaagctcccttagcttagataccaactaaattccttgccatcatcgatccatcttttgatctcatctcatctatagctagctacacagccaccatatataatatatacagtgttcattatagttgggatcgacttgggagaagatctccttctggctgctgctgtagcgctgtacttcatgcatatggttatctaattaggtgagtgcacgcgcacttcgtcatatatatatgccaattaaactaaggatcgagtacatatttcttgcatgcatgatcttaattaaatttgttggtatgtcgtacctatatatgcacgagtcgttgttacatacctgcgcatgcagtattatgttagattcgcatataatttttgtgtggagaaatattgaagatgtgaccaggagctcaacaagcagcaggctttaggtaagattgggaaaggaggagctagtactagtactatatggctgtatggtaagagagagggttgtatggatggtggatatgagccctgaagtgcactccaagctaggaagacaaatattgcacacattattattattgtagatctctctctaccctccaaaaagcctctcatactgtccacaagccagtactactactttccagttctcatctctcctagctagcatgcatgcagcagaagcccaactttggtgtgttacaagctgagcagctagcttaaggaaggtacccttagtttcagctgcatatatatgctatagtccatgcatgcctgcctgtccctaatcaaactgctagtactaattaattagtaggtacaggcgtgtgtgtacagcttgctagctgctgactgtccgtgttcttaattagttctaatattcatctgatgcatgaagctagtctccccggtcgacctagctagcttcagaatattgattggtttaaaggtatacttactagtatgtatgtacgactaggttgtataggtatggtgcaactactggctggctgattaggtcatgttccattgcatgagtggccgtgtctgtcctatttctaggagcttttccagccttggacccatccagatgcgcttgcacttgcacttgcatgcagttcattgctctagctataggctatagctactatacactcatgagaatctgagattgggctgaaaattgatgagcatcgatctgaagaagacatatatatagctgatgatgatatagctttttctgcatatgcttgttttgatctgcagccaatcgatcgaggcatagagagtcaccaggcaatcaaattccaaccatccatcagctagatatatatacagcaaagatcacgatactcctagctagctagctagaagaattgatcggtcgatcggaggaaatagcaatggatcggcatgagg

SEQ ID NO: 11614 - DNA, 1501 bp, Oryza sativa
gtaaaaaacaaataagattgcctgataagaaaggaaggaagggatgatacatgcattgtatggccaaagttgtctaccatatccatttttccgccgttatattgagcttcaagggtagcttttgctacttagaacagacgctagctcgatctagctaggttgttcttcctgtacagtatacatatataattaatcattgatttgttttgacagggaagggcatgatcatatgtgtgcgtgtggagcccacaaatcatacgctagctagctaggtatggtacgatgtatcgatcgagcaataatactggcctgcagctactacatataatatgaatgatcgatatatatcatcctatatcttggccgggatcgagggaagcacactacataaaatacatatatacgcatcattgcttgtgttgcatgcttgcattgctattctcgtctctggccggccatgacaataatatttgtatttacactaacactagtgctttgttctagcttatttaagtttggtggttgtcactgtctggcttggtgaatgcacgtaatgtctggctccacactcaaatgatcagataaagacggctctagattcacgagatctctacatgatgtatcaaattcatggtaattaataatcaagtcatataacccatatttggaagctaggagttctctagaccgacctgctgcaccgtaattaaatggtaattaattaatcaataactaaaagagatcaagctaagtgtgttcatatatatataaatcaaacttatcgtgtcctctatagatcatagtagccaacctgcccccactaacaataaccaaccaatcaacagtagctatatagcttcatcagtattatattttcctatagtttcttttttgcttctgttccaaggtttagtgtggatagagttgatgtacaatagctagtaccgattgacccttcttaccatcagttcgatctgatcacattatgctagagtactatatatatattccatatccattaattgctggaggtaagttaataatttcatatatattccatacccctcgctcttggtagcatttgtttgcagacagattaaacatgtaaagtacaaggaatgcatcatccatgatatatatgcagaattgtcactactatatacaaacatttatttgatagtgtaattaaaagaagagaaagagtaatatgtactggtgattaaatgttactacatattcacatttcatgtgcctttggcagctaatgataaacacatactaggatgagatatgaagtttcccagtatgtccagcagattcattttacaaggaaatgttacatcctgtcctatgttgattttttatgggacggtaggagttgtataatatagtttgtttttcttgtaagattgttatgtatgataagcgtgtgcacattttatcaagatcaatatcgctcattcagtcacaagtccaaaaaagaacaccatagaagtagagt

SEQ ID NO: 11615 - DNA, 1501 bp, Oryza sativa
gaaatctagacactcccttttagtaacttactaaattgttttatgtttaacaaaaacatttatttattcaggaatgaaatctttgaaactctaccaaattaaaagaaaaccaattcattcctgctagcaatcatgaaacaaattattgtagtctaatttaggaaaaggtttttctgatttatgggaaacagtccattatattagtcaggattaacttaattagttagtttgcatgtgcgatcttcttaagaaagccctttatagtccctgcagaaggggggaaaaaaggagaaacataatgtttgtagagatgttttgtagtaagggcccctttgatttagaagaaaaatataggaattttggaggatttcaatcctatagaaaaatttcctatgaagccttttgatacaaaagattgaatcctatttaatcctttgaaattcctgtggaatggacaatcctatagagattttgtaggaaatttagcaagagcttcaacctcttggtaacggatccgttaagtctacctctctcatccaattcctgtgtttttcctgcagttcaatcaaacatccattcctgtgttttttctacgttttgcaatcctctgttttacacttacattcatatcaaaatcctatatttttcctattcctacgttttctcaatcatgcgatttaaaggggccctaacaatatgtatggttgtgtttacatccagggatgaaaatttttaccgtgtcacatcggatatacggacacacatttgaagtattaaacgtaatctaataacaaaacaaattacagaatccgcatgtaaactgtgagacaaatttattaagcctaattaatccgtcattagcaaatatttactgtagcaccatattgtcaaatcatagaacaattgggcttaaaagattcgtcttgcaatttacacacaatctgtataattagttattttttagcctatatttaatacttcatataagtgttcaaacgttcgatgtgatagggtgtaaattttttatgtgggaactaaacaagacctatataggctgtgtttagttcacactaaaattaaaaattttattgaaattagaacgatgtgatggaaaagttaaaagttggaagaaagattttagaactaaacacggcgacagtcatacttttagtagccaagagaagttaaaaaatgctgcttacatgttgggatagattggcctaactggcatgtgactcaaccccaagaccactccgcagctagcttgcactgctgcacgctgattcgtacagtgagaaatgtcaaggcccaagggcgatcgatctacatgtgtccacactctacactgcctccgcgcgcaggggcgcggccgcgacgactctagcaacagatcgacgtacactttatctctatctcgcaaaagtactggacgagttggtaccaacgagcgaataccctaaaattaattagcaagcaaagcgtgcagccgtggctgtaatca

SEQ ID NO: 11616 - DNA, 1236 bp, Oryza sativa
cgcgtagaacgggtgcgcggccggcggcggctgctgctgccatagctggaacccgccacgggacgcggtgctcgggtacaggaacgcggcggcggagtcggtgggttaacgggaggtcggtggtggtcgtcgcggccgtgcctccctccgccgcctcctaacgggaatcccgccatgcgcccagatccatagggtcgatcaatccgccggctcccccactctcgttccctccatgccgcttccgcctccgcctccgccgccgccgccgccccgcagcatcagcatgcagccgccgcgtggcgatcgaccgaccgatctgggatagaaaaacaaaatccacgagctcctaaagctgcctcctcttgctgctggtggtggtggtggtggtggtggtgggaaattttggcttgtgtgcggcgcggcgcggggggtgagagagagaggaggaggaggaggacgcggcggaggcagctttttgggcggcgagtgatgaggtgggggggtggagttaatactactgggatgggatgctagggagaggaggaagaggagacagagagagagagaggaggaggaggaaggagggtgagatttttactgtgttgcgttgcgttgggatctttgtttgcacgcaaaagcacaaaggcgcagccggcgccctgcctcccgctgcaacgccaactgaataaaaacaaggcactacctgcactgcactgcactgcactgcatgcagctagctgatgcaggggctgcatgccttccttcgccctcttgcttcgataaccaaaccaaaatactactagtgagttgtgatggaatcatattacaaaaagttttagaccctctcataaaaattttagtccctcctatagaagttgtgatggaatcattgtgcttttattagagggactaaaatttagtcattcattcccaaacacattaaccccccccacccccacccccaacacacccaagtatagctgtcgaccgaattaccttcctaaattaacaacaaaactagatatttgacatcctcaaatctctaaaccggacaaataacccccatcaatcctgtagaaggtggttttaatcctgcatggcatcaacgagcgtgataatgtattaatccattcaggaacatttcaataaaataaatattctaaaattagatggtcccacatgccatgctcatgccttttcctttcttccaccttccctctcttcgtcctctccagg

SEQ ID NO: 11617 - DNA, 1501 bp, Oryza sativa
acagagtttcttggttcttgtatccaagccggctgtaaatttacagctcgtttctcctctcttttctcctccgactcagcatttagccagcttataccctactattatacttgctctaataacaatacaaatactaatcataaaagaaatttaaataaaagggacgatcaaagttaaacacgaaaactcatggttgtatttaaaatataacggatgttgtatttatattgagacggatggattactcttggtttaagtgcctgattccatgacttgtttattcgcacgagggcatgcacgagctacactacacctgagtacctgacatgacagggcaacccacaataatttacccccattttcgtttattcgtcagcaatcatggtataatttccttgaacaaaaatatccagatgaggctgtgagaaaacataacaagattcttctagattggtagtacttcctccgttacacattctagtattttctatatttatattaatgttaataaatccagatagatagatatgtctagatttattaacattaacatgaatatgaaaaatgttaaaatgacttatattataaaacggagagagtagatgtcactggccagtgccccctgtccatttctcttcctcctacgtccctccttgtttttggcgcgagaagtcgatcgagaacgaaacaaactcggcatctccatcgtgccatccaccgcgcgcttccgtccactcgcactgatccttccggcggagcaatccatgaaatcctcgtcgtcttgccgtgtttggttgggattgcatttgatcaagaggatttatatatgtggatttgcagctagcttagcttagggcatgttattttcttccctttcctaacttctatccattcgtttttcgaataagccaattctcaaacagttaaacgattgtgttttgaaaatacaattatagaaaaattgcttgaaaaccatattaatctatttatactataaggctgtgttcgggtatcctggttcccatccggaatacttcctccgtatttgaatatatgacgccgttgactttttaactaatgtttaaccattcattttattcaattttttatgtaaatataaaaatacttatatcatgcttaaaaaatatttgatgataaataaagtcacaataaaataaatgataattatataaattttttgaataagacgaaaggtcaaacgttagttaaaaagtcaacggcgtcatccattaaaatacgaagggagttgtaattatggaaaacggagcgatccatttagcgcgtgattaattatatctattttttttcaaaaatagattaatttgatttttaaagaaattttttatatttttgcaaaaaacgtatcatttagcagtttaaaaagtgtgcgcgtgaaaaattgagagagaggggttgagaaaagagggtgccgaatacaccctaaataggttgatggattagctccattttccacctaaga

SEQ ID NO: 11618 - DNA, 1501 bp, Oryza sativa
gcagcagagttgacaaaatacatgcaagttgcagcttctacagtgcaatagaagagaactacaggtgcagattatcaataacagaaaaacaaaagtttatatgccactaatcaaacaactttaataacttttgaagagaaaaatgtactcacataagaatgcctttaaaaacttttgaaaccgtgcttaacacttaaaatatgagatgcagatgacaatcaaaatacacaaatgattaaatagctagagacgatttactacggataaagagttaaagacctatagccaacactacaacaataaaatttgaggtgcagatgaaaaccaatatacaaatgctgaaatagctggagatgatttatgagattacagatccaagccataccaattgctatgatcactccaggcaccaataagtatcatctttaagatggaagcaaacacaataaaaccaatcccatccatcccactctattttaggttcatgactgcatttatagtctcagccgattgtaacaaagattcagggaactattaatctttgcaccaaattgagtcatatggaacttaacgaagataacgatgttcaatcgtaggcgggcatcttacaaattactgaaccagtcaacataagcaacacaaattagtgaattacttttgagtatctgtcttcagaagcacagttactgattcagtggtagtggatcaaagctagaggtagttttaactagtaaaattattcagtgtgaagtgtatatatatacctcaaggagggctcggatggcaagcttgatggtctccttgccggaggtgtccttgtaattcttctcgaggaactcgcgcatggagttggagttgcggccggtggcgttggccttccaggcggagaaggtgccggatgggtcggtctggtagagggcgggcttctcggtgtaggggtcgaagccgacgatgagggtggagaggccgaaggggcgcaccccgccgctctgggtgtacttctgctgcagtccggcgatgtagcgcgtgatgtactcgacggtgacggggtcctcgacggtgaggcggtggctctggcactcgacgcgcgcccggttgatgagcacgcgggcgtccgccttgagccccgcgcaggcaagcgcgatgtgggtgtcgaggctggcgatcttgcgcatggacctggatttgggggggagatcgatccgcgggtgagatccggcgaaggggagggggcgggttgaaggatttacctggagtcctggagcttgggggtggatttcttctcgacgccgaggacgacggtgtcggtgccgcggacgccgacggcggcgttgcccttgcggacggcctcgagggcgtactccacctggaagaggtggccgtcgggggagaagacggtgatcgcgcggtcgtaccgggccatccctgcctgctggtggtggtggtgtcgccgccggcgaggttttcctgctctcgctttgcttttccttgtcggttgcgc

SEQ ID NO: 11619 - DNA, 1501 bp, Oryza sativa
gacgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagtaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 11620 - DNA, 474 bp, Oryza sativa
gtcaacataacactgtgggtgtgtttcaataatgggaaatggagggtgagattgagattaggaaatgaatgaaaggttaggattaaatagatgagggagaatgaatggttaggatttaaagatgtgttggaaatcatttccctttcccatttgccaaacaccacctataagaataagattctctaaagattcttcagggcagacagtgtagtgttacgttttctgaatggttgcctgccctgcccggaagaacatcaacacagacaggttgatgtttttccatggaacacaagcttaagacaatttgaaggcgccatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctaga

SEQ ID NO: 11621 - DNA, 1501 bp, Oryza sativa
aactttcagtatgcaatttaatgtgtaagatatggacttatagtataagatttaattttttctaaaaatgccgcatcacagtagataggtagttaaccgaacaaccataaaaaaacagagacaatccattgtgtcactgattttgtccctgctctgcaatatgtcattgggtttgtcaagttctaatatggcatcgcattttgcttaacttctataatataacatcgtcgtctagttagcctccgttagcattgtacaattttataatacagattgtaaaacttaaagagtttgagatggacaacttctctgcctaatttataatatgatattttagaatttttagccaaattttgaaaatttttgtcctagggatatttcaatcattaggacaaaattatacagtactaacgggatctaaatggacagcgatagtgtcacgcccagaaatttagcccaaatttctagactattttgtgtattaaatccctgtccaggaccagccagggtacacaaaacgacaagtaataaacaaatccaaacgtaaataaagcgtacatacttacagaagaggcacctagtccttacaccgaaaagaaaatagcagcagcggaaaaaggcgatcctagcagggcttcagctccactccataggcaaaactcaactggggtctgagccttggtcttctaacttcgtcttcagctcagaagcactacacttatgaaaagggggaaatagcaaggctgagtacaaccatcgtactcagcaagccacaccaacgatgcagacatgcaaggggacacaaagggaggtttgtggctatttgcataaaggcggttgtaaaacatttattgcgcaaaacagtaaaacagttaagtaattaaggtaatattaaatctccactgatcaacgctacaccacgttgaacaggcccaaccaaccctcctgaactacagtacattgggtcaatttattaagtgtgagactaatcacggtgaatccggtcgatcgcccataaccgcgggcacggctattcgaatagttttactctggccagaggtgcacaactatacccacaaaacacaatccaccggcatgtcaccgtgcctgcgcagacacgtcaccatgtcgagtgattgtgacaagaccctccgcataaccctcccctaaccatccacaccacgctaaggtttcacccccaccccctaccccggaggtgggcagtcccctcgtgcgccacggtgaatccgtcagctggacaaccggataccccggccgacccaactccatcacgcccaccctcgccaccggtgcctaggaaagggtcgagctatacttcaaatcaagtagttacccactcccgcttgtggcaagcgcggtaagtcttccagggtttcccgtgaaccggtccttaaatgccatgggtgcgactcgcaaaaccacgcacccacagcccaccattcagtcgtattttagttggatagttacgaccaatgaaaca

SEQ ID NO: 11622 - DNA, 1501 bp, Oryza sativa
ctgtggataaccgcggtaaacgtgaaaaacaggaaaaaaaataccaaaaaaaaataatttttgtttaaatatttttgaacttggtggggttattgggcccttaccgttaccggaccctggcggtcagggaaaccatgggatccgctctgttattggttgttgccccttgctggctacggtgctctgcgttagttccctgtgagacctttgatctcgacaccaagtcctcatggtctcgtgcagcagagtcatgctgaatcggtcgatagatgcagtcatgaagagagtagatagaaagagagcatggggggaggggattagctaggccatatactgttgaacactaggggaattggagttcgccctaggagattgataaattggtccatccttcccgactgcacaagtgcattacctgatgggaattggagaatacgatttgagatggatatatactatacctagtcttctgtcgaaaatattgggggtgcagtactacatagctctgcccctgctaccaaatatattgacactgactttttgtgaaaccaatgatgatggtggaaatactgccgatgactcctaaacagcatcaaacactaaatctctcttgtagaacaaggtgatgcgattgtgtcttgcaggtaggtaggaggaatatagaataattggcgaaggattgtagtgggtctacctaaggatttaattctggaaaaccatctggtaggatccgaaagaggaacacctagaccttcttctgagcaaagttttccatgaccaacccattctgtggattatgtggcaatcggtaccatcgttgaagttgatgatgttgctagccatcacacatgccagtctgagatgcccagagggtttgacctagactttgtcgagaaattgaatcttctctcataccatgcgagtgagcctcagtggacaaaagtttgctctttatcctgttgttcaggatctcgcaaatagccccagtgataaggtcagctaggcagatttcagggggcctatctcctgttatgaaacctgactttgaggtgtagagaaccataaagagctatgttatatatgatttcttaataaataagtcagtagtgtagtatcatcaatgtgatatctaagacagcattatatgtgcttatgaataagttacagcatactaaactctgaaaatttctgcttgcacactgcatttacttagctggtcatggtgcaatggtgttaagtgatcatatccattacattcagtcattggcttaattgtatgaaatagatcattgatgaaaagatcgctagtgtttgttttttaattgtgcaaaagtttacatacaactatctgatgcaaatgtttttttttctcacaaaaagaagaatttccaccgttatgcatcctaaattctctaatatttttatcttgcaattaattagacatacttctctaacatccgtttttgattttcagaagtgatgaacggcgagcttaaactta

SEQ ID NO: 11623 - DNA, 1501 bp, Oryza sativa
aattagccaatcacccatcacctaatgttacgagagtctaagatattgagctcactcctaagctcgcaaaatcttttctcatctaaaggcttggtgaaaatgtcggctaattggctttcggttctcacatgggtaaggcatatgtctcctttagtctcatgatccctcaagaagtggtggcgaatgtctatgtgtttggttcgagagtgttgaacgggattaatggctattttgatggcactctcattgtcacataggagtgggatcttggtgaagttgtagccaaagtcttttagagtttgtttcatccaaaggagttgggcacaacaagaaccggcggcgacatattcggcttcagcggtggataatgcaatggaattttgcttcttggaggaccaagaaacaagggaccgcccaagaaattggcaagtcccggttgtgctttttctatcaaccttacacccggcataatccgaatcggaatagcccaaaagcttaaagtcacaacccttaggataccacaagccaagattaggagtatgaactaaatatcttagaattctcttgacggcaatcaaatggcactctttaggctccgcttgaaagcgagcacacatgcaaacactaagcatgatatcgggacgagatgcacatcagtaaagcaaagatcctatcatggagcgatataccttttggtccacacatttaccattatcgtcgaggtctaggtggccattagtaggcatgggcgtcttgataggtttggcaccctccatcccaaacttcttgagtatgtctttcacgtacttggtttgagagatgaaggtgccctcttgtgcttgcttcacttgtagcccgaggaagaaggtcaactcgcccatcatagacatctcgaaccttttagtcatgatactactaattcttcacaaaaagagacattagtagaaccaaatattatgacatcgacataaatttggcaaatgaataaatcactcttaaattttttagtgaagagagtagtatccgcctttccaatttcaaaactatttttcaaaagaaaatctcggagacattcataccaagctttaggggcttgtttgagcccgtagagcgccttgtggagcttgtacacatggtttggcaactttggatcctttaaccccggtggttgctccacatagactaactccgagataggtccattgagaaaggcactcttgacatccatttggaataacctgaaatcatggtgagcggcataggctaaaagaattctaattgactcaaggcgagtgataggtgcgaaggtttcaccaaaatcgagaccctcgacttggatgaacccttgcgcaactaaccaggctttgttccttacaaccaccccatgttcatcttgcttgttgcgaaagatccacttggtgccgatggcattttgcttgggtctctccaccaaagtccacacttgattgcgagcgaagttattcaattcctcttgtatagt

SEQ ID NO: 11624 - DNA, 806 bp, Oryza sativa
cttgtccgcgttggctttttgtggcaatagccgcatcatatcgtcgtcctggtggcccaagctctcttctccgtaccacttgtaatatgagtctactttctcgatcctataaaaataaatattgtacaagatatgatatattctagtactataaatttaaataagctattcagattcatatagtactagtatatgccatatcacgtatatattatttttgtttttatagaacggggagagtatataggtagtttaattactgaacttcccaacctagtggtaggcatgagacgtcactagtcagatcatttaggccacaacagaagtttcatgtttcttcttgtcatgttttctggatatgctaaatagttccaagagcgtaaaaaagaaaagaaagagtaaaataattaaatagtgttgtctgatatcattgtagtggacacaacagttatggctttgctagtctcgcctaatttcagtaccctacggccctaccacaaccctcctaaactagcacgaaccactgtctcctacttcaaaacattctgaaccaaagtccagcttctagatttttcacttttgatctttttaaaattttattttacaaatagatccatcataacttattatgagaatggatcatttttatggcatcaacatcattagcgtcatggtccaatataacggcgcaatgacagtgatgccatcccctagcttccttgcaaaacctatgggtatgtttccgaagcttaagattttgagaagctgtgggttggtagtcagcttctaagaatttagaaaagcta

SEQ ID NO: 11625 - DNA, 1501 bp, Oryza sativa
ccgaacctgctgttgccgctgacctgtagcggctggcggcgcatggctggatggagtcgtggaggcgcacagggggggcgcggccgcggcggcgagcggcgacggcgagaggcgcagctcggcgggccggtgacggcgtcgagccggctgggagggcacgaggacgcggcggcgagcggcgacggcgggaggcgcagctcggcgggccagcgacggcgtcgagctggctgggcggggacgcgttcgcggccaggcacgcagggagcggcgaggcggagggcggcggccacacgaagtgacgaggggggatttgtaaaaaatgaggttagcatcggatgagtgcgggcggttaagtgtaaaagtaattcacctttgttcctagccatcggatgagcctgtcgtgttgattaagagtttccaaggttgccaaccatggtttgcaccagatgcggtgcctttctatagggggacaaaatgggttcacaccagatggcctgcataaccagcacgaatcttgaaggatctgatagccataaattcggctgatgaaaacgaaaaaaaacagccggcacaattcccatgtaaaagggatattgagataagggcggagtaatcgagtatcgcgtaaaagaagaaatctcccgtctcgttctcgttctcctccgctccttgcgccgccgccaagacgagcggagggccgggcggcgatctccatctggcaagcagagcagcggaggggaggaggggatcctggtgcgtcctctttctgatccatctctctctctctctctctctctctctcccaccccaccgggacctggaatttgcttgcgttcgtgaatttgatagccttaaacctctcttatttcaagtaataacagtttgtttgtttacctaaaagttcgggggttcaaccgaacccccatgccccaagttggatccgcccctggtttgaattgctgaaacataatttcgagctagttaaacgaagagacaacatgcctggaaatgtaaaaaaaaagtatgctgatttgaatttgattgttggaactgccctatagaaactggtaaattttagaacaaaaaaccttgcttatagtaaaatcgtgaatggatgatatgcaaagacatggtgagaaatattcactcgctcatactacaactacttaagaggaccatatttgctcactctggaatagctgctgacctgctgtgaccatcatacaccccctcaccgcaatgcaggttccatttgaagtaatcggagaatggtatgttgagaattagattaaagcttccattttaaaattgtaattgtttgggctgtcagctatttgccattattcacaagtgataattgtgaccctacaacgaagaggctaacagtaggttttagaatttcagtaatgttatatctcaaaagccaactattacatttgcagggaaggatattagtgattttctactgctgtttcgtcagaaggacaagaactgaagaatt

SEQ ID NO: 11626 - DNA, 1501 bp, Oryza sativa
tccgtgggcaaggtcctccttttatatctcaaggggataccacatgcaccacctctacctatctctctttttggtggggacttatcctatctttactcaaacttggcttgccttctctagaaagctaaaaacactgcttgtttttgagtgtggccacgcgtccttactcatctgacctcggggatcaccctgtcacctcttcataaatgggcggagacatgcaatggttgccgtccgaatgaccttctgatgggacggcccatacctacctccacttccgccggaagcaggtgcgacgtgggaacatggctgtctgcctacgacatgaccggtgtcagaccggtcacaaatcggtcattcttgcccaccacgtgtcagtttatcgatctgcatgttcgcccttcttcatacaatattttacttgtaatggttgggatgaagcctggcatatatctaaccgggaccaacgtgccatctccaggagctaacacgccggctccggctagggacgagtgcttggaggctctcatcctgacgggatggggcgaggcgtgtgtcagaccgcctgttgccacctaacccacaatctgaccggtctgtcacagaccggatagacgagcgcgctgcactgcgttacatgcggcgtgacgcgctcgtccaaaccgcaataaatgcggttaggtgagccccgttgtgctcacctaacccatacacgcggcgcaaaacccacaaggggtcggggcgcctcagccctcggggccgaaacgggagcggtccgacccctcggggagacaaagaggggggcggccacatcaccctcgggcccggccccccccccccccgagggggtcaggccacgtgggtgattgctcctgctcaagcctctagtcatgatactcccgatcccatgtcaccgacagtagcccccggcgttatgccagggcgatcgccctcctcgagggaagcggtcgggcgtgacgccactttctaaggcctggtgacaggtggggctggtctccacagttgggcagaaacccagcagtcgcaaatcgcgcacatcggcaatggtaactcggctgtcaataatgagcggtctcttcaagactgccatattactcgagtagcacgcgaatcgggacgagccggttcgttttgcctggagatatggtgatggcgcttcggtcggcgagcgtaattaatgcgcgcacgatatgtaccatctcgaccgccacaaccgcatatccacctcgtgcgccgcaaacgggcgagtgggattagtggaagcgtgggcgcgggaagcgagggggcgagatagtgggcgcgggaagcgaggaaccgggcacagcgttggcaagggtataaagacgctaaggaagagatttgcttccttcctttcgccattattccccttgtcttcgccgcttgcgccctaactccttctttcctgtgccctaccttcgccacacgcgctcgctctcaaacatctcttcttccggcgtca

SEQ ID NO: 11627 - DNA, 1501 bp, Oryza sativa
cagccacagccttccccatggctcctgcgcgacgcgtgtcccccaactccagcgcgacaggctgtgcgtccggcccacggtggatgaggacgaggcgatgagcatcgacaacctccgcctttttcgacgtcaacgtcgacaagtggaatggagccttctacgtgcgctcgccttcctgttcctgtgttcgtaatctgcacactgagacgctgactgtgcttgtgttctgctcatcagcatattgatgcgcatgggattagcacgcggctgtcagtgagcacctatatatggcgaggacgacctcatcaacctcctgcagtcgtataatattcaattaacacatttagcccttttcccagtcttacttcaagtattccacgtttacaacatcttctttaccattactagtaatcaagttcagtattttggccgtttgattgtgcccattgttcctaacgatgtgtttacatattgtgaatttccaggttgtatatcaagcaagcttcttctcagatatcaattgtagatgaggaggattctgaaccagagtgggcagagtacaaaatcaaagagacaaacatgttcacagtagataactatcaacagctgcactgaagtttgatgatctcttggcctcttcagacatttttttaaaaaaaaattgtgtatttctgagtatttttaacgagtggtgttttttagtatacagatcggattctttcatgatgagaaggcatttactgtgatgggatcgatatagtgcgattagccttgtggttggtttgcaccggatccagtcagattgaactatattgagtgtttctctctccaatttcttcgaaaataataaaataagttggattgaaataagttcgatcacaggcaaacttgtctttattgagtgtttctctcttcaattccttcgaaaataataaaataagactgcgagtgtccaacagctaattaccagttttttgtgattccgatagcatattcgtgttcttgcgatgtccaccagctaatcacacgttttttgaatgccatgagtaaccaatactcgatttgatttggatatgtactcggacactgcacgttggaattgtatccaaggtggcctattgggccaagtccgtatggagaagcaaggcaatcgtggacagccatccaatggccaatgtgcaaccgcacatgcgaggcacaatcttgcctaggagctgacatatccaccaatcacagatagcacactaccttcctggtacgtggcgtgaagcctaggcaaccagtcgtcttacccaggaggtagatccacccctgacttaggagtaataagagatagaaaaagaaactaaacatattcattgttggatagagatcacgagaaaggtagtggcagaggacgaaaaaaatagcgaaaatcttctctctcccctcaactactcctggcgagcagctaggagttgagctttgatttcgagtcttcgacctcgccggccattatatt

SEQ ID NO: 11628 - DNA, 1501 bp, Oryza sativa
atttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgttaattgcgggttggacgagcgccccacgccgcatttaatgcagcgcagcacactcgttcggtccgtgacaggtcacagtgtgtgaccggtcacagaccggtcagatcgcgggttaggtggcaacaggcggcctgacacacgtctcgccctgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccat

SEQ ID NO: 11629 - DNA, 1501 bp, Oryza sativa
agcaaggcgtacgatccctcccttcggcccttccagagccttcccgggggcaaaagcttccaggcctggagtccggacagcgaactcctcccgttttcccgtccccgcatccgcaaatcaacggggataaaaatcccggggccctaaccgccccgccccccgacgccaccgcccacgtgtcctctccttccacccgccacgcgccacctcgggtcgctgccctccccggtggcgtcctcctcccctacaagaacccgagccctcctcccctcccaacccagccgccagttcacaactgcggcaaaaaccaaaaacaaaattctcccccgggttatcgactgcctcatctagagtttcttctttcttcgcgtgttcttggaggaggagcgaggactaggtgagtaagaaaggaagtttcacgtcttatgggggtgaattcttttgcgggatttcttggcctttgtgtctgggattcgtggtagatgctgatgaggagatcgccatctctcgtggtttggatcccatgtagttttcttggatgctgtatgaatctttgagctttactctgcatttcgggaggagctgttttgtttgtgtggctggctgtgcgcgaaagctactgcgatccttagcgatggagttgttttcttctttttcctccctttcttgaagatatttagaccaggtcactatcagtcttgaacggatgttatctgcgttggagattgactccgttatcattcgctcattcatctcgcctccaaatgatttgagctttttcttggtgaattttcctggattagcttctcgtggcccggaatcatctgaaagcctagctttgttgcctacttgcctcttgttgattgggatttgcggtgccggccacgcctctggtgttttagcgacagaagggattgaatttttcggccaaatcaaaggctgggcagcttgcgcctcgcctcctccttgcttgccgtctcatctgcatttgggtttaatgcggttctgacctttacaaggagctcccttttttatacaaaagggaaaaaaaaaagttcggtttctgctcaaattgccacttgcagagaatacgtgcttttttaggagctcctttgaggtacctttctgtgtgttccctataagtttctctaggagatttttatgataatattctcatctagatggtgtagaattgttgatagtaaggttgctctttctgaattatctctccattcttagctctatttcggttcttttgaagatttgagttgttcagttgcaaaacgactttatgattgctcccatctgttttgttgagtttttctgggattaatttgctatattctggtagcatcaagttcagattgggatttgacatcagtgcagagtccctgataacttcactgttgcttgcaggttagctgtattcggagcttcagattatccaaaaaaaaaaaaagaatggacggtgagcagctgatgagtggtgaattggacaatt

SEQ ID NO: 11630 - DNA, 1501 bp, Oryza sativa
agggttgattagaccgatggtgtgggcccaatttgaccgacggtatgtggccggtcataccagcagattcgacttcgagcccaatttgtgggttattagtttccttattttgttccaaggtttctatagtccaaattattctctaagcctaataggatgtggagaaggccctacggagacaagaccaacctcttcataagggcaatggatggttcgattctaaacccctgaccaccatccatcgaatcgttcttttacatttacttctcagccatgtatttttactttatcctatagtttcatccatctttgtcgatttgcgccatatatcatccgccttcgctgcgagagtgcaataccctttgaaggtttgcctcgtaaaccttccgtttcacccatgagactggttgttattttcaaatcgatctaaatcagcctagacgttggtttgatctctgaatcagttccgctagttagttttattcttttctaaacccatctttgttaagagcttttctactccgaggtggctggcgaccctgttaacaccgtaaatttttaggtgaacccatgttggtcagaaaaagcaccaacacaggaataccatttgctaaatgagatttaaaatatttatatttgaagtccaataatttgatttttttttattctcaaacttaatcttggaattcaagtgttttctattgaactccatgtttctgattttaatgtaactaaaagataaagttccacaattttgaaacttgaagttggaatagctaagcctttatttctacagaagaataatcaaagaaccaaatccaaataatactagagatctaatacatgtagataaatattgcaaaaggtacttctgtctacttacaattttttatgggtgtaagatattgatgtagaagctttccatgtcctagttgtcttcgtgtttgcctcctcgatcttgtatttatgtttgttttcaatgatgtcctcaagccttgaattgattgcttttattttcctagacagcttgtgtcgaatgtgtgcctgtgttgtaaaggtcgtgacaagttttgcggtgggacgaatccacaatgggtacctgaatacatgtacataaaactattagagcaatttttttttaaaactagaccatcaagagcagatatctcaaaacaagaccatatattcaactttgttgaagcatagaagcattattcattattagatcatctattaatcaagtggttgatcctttttttagaccattagaccagtactgacaattgatctctactttcgacgcaaatccccactaagtaatagttgctaaaataaaaaaatttataatctagatagaccaaaagcatatgtataagtatcatataaatacatacaaagctaaactaaactatagttgtactaaaacttaaggaaaaatattctatggaacttattggtaaaacaaagatggctgattttgttgccaaagtttaccctaatt

SEQ ID NO: 11631 - DNA, 1501 bp, Oryza sativa
tctaaagttgtgggtccggttgggcctgtggtggagcaggcccaatgtgacctgggtgacccacagttggtgggctgggctgcgtactctaacaagtggtatcagttcccaaggtttggaacccgaaacaatttttatgggtcacatggtgggaaggccgggtaacaagtcttcggggtcacatgggttgatgtgacgggggagattattgggtttagtcccacatcggtaattgatgatggatgagcacgacttaaaaggtgggggtagtcctcacccatcagactgttttttgggttatgtaggcttaggaccttaagttgtggctctggtttggcctatgggggagaatgcccaatgtgacctggatggcccacggttcgtgggccgggctgcacactttaacaagtttcctcttaatcatgtagcaatgtaaattatcatttttcataaatgagatggaaggtagagttggctctaccttcttatgtgtgaaaaaaaaatatttcaggtcttttctcattgtttgcttgttagtttatcaaccacagtaaaaacttaaattttggagttctttcatcgtaatctattttacagcattaacttcccataactttttttttcaatagttttctacagcttttcaaccataaaccattagagttggccattctcaactctcataaaattttggtatcagagttgtgtgcaattaaaggtggatgaattcaatttagctgatcgatcgaccgcgccttcatactctcagacacggctctgctttgagaaagcggagctaacactttcacgtggctagctagctagcttacagtacaccatgcagcctggaaaatattagcacatcaagttaccccatatatcttggacgatatgcaagtgtcggacggaaagcaccatcacgcaaacaagctggagtaagaaacgaaccggtgctattccccttcagtcttgacgttcaattagcagacatgctgtgttcgattacagaggttgggaacacatgctctgtacacgaaaaacggagtggtctattagtacgtgattaattaagtattagctaatttttttttcaaaaatagattaatatgattttcttcaagcaactttcgtatataaactttttttaaaaaaaaacaccgtttagcaatttaaaaaacgtgcgcgcggaatacgagggagaggggttgggaacccagtgatctaaacacagcacacaagcatcaatccttgcctgaactaggactcaaagcaaacatttatgtagctatagctagctactagctactatggatcaaacgttaacgtgtgttgtctctctctatatatacacatatgtttatatgcatgcttgtgatatccggccattgctgcaagaagactacgagcaagcagtatagctagctaggaagctagcgtcgttgttgcccggccggcgccggagaagaaggagaaggagaaggcggaggtaggtcgagatcaa

SEQ ID NO: 11632 - DNA, 1501 bp, Oryza sativa
taattagagagactctaataaatttgtaaaaaatagttattacttttcaaaaattggaacaaccattgtatgttccattgccataaccatgtttaagtgcttagatattaatggtcttccatctatcctataccctggaattatgagtttctccaattattgcatatataagatatactaaggtagcaagatgtagaagtacgtagttggttaaaaagttatatatatgctactattaacattatatttagaactcatgttgactaggtatattttaaaaaaataaattataaatcacatatataacagtgaaacgaggtgtacaatatatatctcctatgtatttattgaaacactctttctagaaaataaagaagattattgataattgcttatagtaatgaattaaatattatatagttcaaaacttacaaatatcttgtaaaaaaattatctaagcaatgtccacgaagaaaattttcaaagaaatagtacttttcaaacatagcaggtgtcatctcattgatattccaccttacaagttactcaagcgtaacttacattacattctcgtgcgaatgcgtgggctaccttcctagttgtttacatggccaacaggttagcccaattttccaagccaaccaacaatacccttatgtgtttgttttcaagctaacttcttaaaaaaaagattggctgaattcgttattaggccaattccgtcctagtttgcatgacctggtaaaatcacactaggttgttagctagtctagttttcattccttttttaggggtgggagagggggggggttgattggggtagaaattaaacccattttcatacttaggctatgttcgtaacttggggttgggaacccatctcctccacatggaaaaggaagcagtccattagcacatgattaattaagtattagctaattttttttacaaatgaattaatttgattttttaagcaactttcgtattgaaactttttgcaaaaaacaaaccgtttagtagtttgaaaagcgtacgcgcgaaaaacgagggagaggggttgggaacccagagcaccgaacacagccttaggggtaaacaaaacacctactataatacatcaagtggttgtagactttttcctttaaggaacccacgaggctctacacctaatagtttcatgttttcagatctctttgaaatatttgaaaggtacaaagagatactgctacttacaagtcagaaggcaaagaaaaaaattaactcttttagtgaactacatttgtggcacaactaggatatagttatcacttattaaaattatacgtactattactgataataacggtatacttatgatttgaccacagggaatatttgcatgagtcagacgtgccgattcatgtggaagagcgaaaaaaactagagaaagtccttcttactacacctgaagatctacatggcaaagaacacaatccagtcataatctctgtgtttggaaaaa

SEQ ID NO: 11633 - DNA, 1501 bp, Oryza sativa
gtgatagtcccatatttaaggtccaattttataagaaaccgtctgcaatagttgatatttataggaattttttttggtgagaactgcctatgactatttaaaaagtacacctataaaaatcattttattggtggttctttaagattttgtcctgcaaaaactttttctttattctttgataatgactaaatttaaaaaattatagagaactaattttagctttaattaaggtgaatcaaagttttatatgagacttacaatattttatttaatatggcaaggcccatcttcttaaaatatttctttcaatatgattatttacttacgtagactatgattcgatatgttatacaacctgatattagtgaatcactatatataagaaatattctaagaaaattctaattatgtcatattaaaggaaatactacaatgatctctctctctcacacacacatatatgaatattttaccttgatggggcttgcgaatttgcaagaaattttcaaagtttgaactttgtaaagaatcccaaaatagatacaagagcttgtaatgactatactttttaagacaccaaaatgatctaaatatcaaacctttctagtataaagttgtacattgcgtagagctctacagtgttaatatagaacttgtctacatctaaggttgtttaaaaaaataagaaaacattttaaaaaatagatttaagagctttaacacatattttggcccctcaatgatcgcaaataaaaaaaactttcaactgtaaagtttcatcgagagctataatttcatataaaatttttcatcatctgacttcatgtaaaaaagatacaccatccgtctaaaaatataacaacttctaacattcagaatctgtcccaagtataacaacttcttcaccaacattctctttcgaaccaatcacaactttccaccatttaattttttcacctacctctatttctcaaccaataacaacctccctccattaaattctatccactttcttaatgaccgtgttcaaccttaaaacttttaatattctaggacaaaggtagtattttctcttgaaataggttcgctcctatttttatgggtggtaaccgtccaaataaattgatttttacataccttattttcttaaaataatcacctataaatcattctatttttataggtcataccttttttttgaaagaatttataggtggtaccttaggaaaatcgccagtgaaaatattaatagaacttttttttatggttttcttaagtaatagcctgtagaattaggctttcacagctagacggtctgtggccctgagatggcctacgttctttttacatttggtccgcttgcagaagaatgccgaggtccacaaaaatctttttttttatagtgttgttacgtttcaaataataagatgggcgaaaaaatggttggaaacggcaggaacaaattaacgtatacggtcgatgtgcatgcgtgcttacagat

SEQ ID NO: 11634 - DNA, 1501 bp, Oryza sativa
gttgcatttcatgccttttcaaatcatgaaatttgactcagttcagggcaaaaggtttcccccgaacccccttccaaaaggtaaatgaaaggttgagaaacttcgtgggatgccattggccgagcaagtagctaaaacgtaggtgtccagcatgttagcggttgaggagcactggtatggtggtgtatatgccaatctcctgtagtgggaatgtgttggagtccatatggtggggcctgggtagatgagggcctgagcctggcctgatgcttggtggagagattccacccaactgtgggacatgtggtatttatgggttggttatggaaaagccttgtagtgaactcccctttgtcatccatgtctgatccacaagtgatcgtaatgtgaagcgttcactacgtgtgggtaaagcgtgcaacctctgcaaagtttagtcaaactgtttaaacagccgtcccacggtcatgggcatatgtgaggtgtttctcatagtgtagtgtttgttttaaacttattaaattgattcttgggatgggaatcgttaccagagtttgcctttgtggcagacgaccatccttcgtggttgggaacgagcctatgtggttcgggatgccgattggcaccaaggtgtggtttagggctaagaccaccgtggtagagtggctgagatggccgagttgtgttgagatggcacggtgtttgtattttactcattactacagtgacaggtgcaaagcaacctgtggaatggagtgtggtgtgagccttactctgaaactaaaacttgacactctagaggtttgcaactaaattatttaaaaaccttgggttttccaaatgaaactgttccactccttgttttaaccttgcatgtcatatttttccctgacttgctgagtacactgagtacttgcccttgttgatatttatatttatagagttagaagaaggatacctcaacccttctgccgaggcctactttcaggagcaggccaagtacgatttctcatggtttcaagcctagttcccaaacatagcttttggatttatggttgtcatcctgcttttatgctttcgcccacgtgtaccttatctttctagtgtttctacccgtctagggtttgtccatgacggtagtagtttgagacctccaccaatgttgtaataaaactttgttatttctggattccactattattctgtgaatactagcttgtgtatactgggactggtactgtaatcacaggtaatgttgtgacccccagcctatgccggtttatattcttgactggcatagtttggggcgccacaccccgttaggatttagtgcctaattggtaagtatttgtgttttatttatgtttgtatctgcatattaatttttcattttgcatatcttgacttggttcctgcatagagatttaatatacacaaaatgatctaaaattgacttttttttaatatgtcaccggggggtgaaatgcccacctgaaaataa

SEQ ID NO: 11635 - DNA, 1435 bp, Oryza sativa
aattcggaattaaaaataaacgttcgctgtgggggttagaaattcccacattaatcggagaaaaagaaaaaaaaagagtcaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaataggtgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatcaaaaactagaaaaaaaaaataaaagagagttcaggtagaaatacaattttgaaacaactgaaattgaaaataaaaaataaaaacattaaaagaacacaatacggtattaactatttttttaaaaaaataaattctgaaattagaaaaagaaaaataagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggtttgtaacttctaaaaggtaaaaaaaatgataatcatgttcaatttaaaaatctcaa

SEQ ID NO: 11636 - DNA, 1501 bp, Oryza sativa
ctaaaccaattaaccagagttagagatgaattaggctataatacacatatataaataaagcagcgggcaacgaaccactatagaacagtaatttggatgcgtttttgttgatatgaagatagatgctagcagcgagcgacggaaatccgaagcagcgggtcaagccgtgcggctgcacagtgagccgtatttgggtgatgcacacgtcagcaaccagaatagcatgatggcatgtgcacggatttttatttgattttgaaataacacaataaaaaatgaaagaagagttcatgtagaacacaattaaagattaattgaaatccataataaaaaataaaatagatttagaaactagaaaaatcaaatataagagttcaataagagttcaagtaaaaatacattttacgaacaactgaaattaggaataaaaaataagaaatattagaagaataattcatatagacatagtatgagattaataaaaaaaatatgagattaataaggaatattaaaagaagagtgcatataagaactcaatatgagattaataaaaatttggaataaaaataaataaatccgaaattagcaaaagaaaataaaagaagagttcaagtaggaatataatttaaaattagctgaaattcggaattaaaaataagcaatatttaaagaagaatccatataagaacccaatacgagattaattaaaatttaggataaaaaataaaataatatccaaaattagaaaatttaaaagagagttcaagtaggaatacaattttgaaacaactgaaattgaaaataaaaaataaaaacattaaaagaacacaatacggtaataactatttttttaaaaaaaattctgaaattagaaaaagaaaaataagatttcaattaggaatacaatttataaataactaaaatttttgataaaaataaagattattgaaataagagaccatctaaaacacatgatgagataaattaagtaacatgcctataaaaaagtagagtggtggcggttgatacgacatataaaaattgttaataaaacaccaaatagaatcctaatgacgattaaaaggagggacatcaggcaggccgtgaagcaaacgagtaaggcggttaccgggacttctagaaagtaaaaaaaaaaaaataaaccccattgataatcatattcgatttttaaatctcaatgacaataaaaaggagaagcagcgggcggggtgcacaagagtatagttgcagagccgtcgacggctgacgggacttatagaaaataaaaaatgaattccaacggtatttatgttcgatttttagaatcacaatgataataaacagtagacggcggacgggctgtagaggggcatagtggcatcgtttgatgggacttctaaaaaatataaaaaatggaactacaagtccaatttttaaatgttcgaaacttctaaaaagtaaaaaaaaccactaataatcatgttcgattttaaaatctcaa

SEQ ID NO: 11637 - DNA, 1501 bp, Oryza sativa; identical to SEQ ID NO: 356

SEQ ID NO: 11638 - DNA, 1501 bp, Oryza sativa
gcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttg

SEQ ID NO: 11639 - DNA, 1501 bp, Oryza sativa
taggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaagcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcaca

SEQ ID NO: 11640 - DNA, 1501 bp, Oryza sativa
gcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 11641 - DNA, 479 bp, Oryza sativa
attatccccagacatcaacatgacaaaacagttgttggctgtgtacacccccaaggtgtaaaggccgggttaatataatcctttatcttaacaaaagaacatgacaaaacagaggattttaatcaggcggccactgttatacagtagcttgcgagttgttgtctatgaaaacgagacgtaggtacgtccaaacttaaaagaggccgagacagtgagacataagtaaaataggcgaagttggtaatgtcttctgtttgagcaatactctcacatcactgtatcacaaaataaattcattttttatctattctatacataccaatagaaaaaaagaactataatattctcactttatcaaattgtaatagaattattctatactctagctatctgtttccaatgtgtttataaatttattttagaataaataggaagagaaaaaaaataatctttttttttctgagatactatagtagaca

SEQ ID NO: 11642 - DNA, 1501 bp, Oryza sativa; identical to SEQ ID NO: 354

SEQ ID NO: 11643 - DNA, 1501 bp, Oryza sativa
tcttcattcttctacacaagattggctacataggcatcgagaaatataaatattaatgaatcatttgtttacgaggaatgactagtagcatgtttaaatggatgataagtagaattatttatccttggtctgtgtgccaagatgaaatatgactatcaaaagtagatggagtgagtatttattatggtgattcaaactagaagatgataataattgtttcttggtctttgggttaagagtggctgtgtcttatattttagaacggaggaaatagtcttcaaatatgtcgtttaactcgagcacataagtaggtgcctgttttcttagggggacttgtcctttttttacatagtaatttgcttgcgttcttagcttagtcgagtgctagtttatttttctgaagaaacacaagacaaaattaaagctctgacttatttcattatcttttcgagttacttatggagctgtcagttaatacctaatttgcttgcgttcttagcttagttcagctcgttgtcaaaatcaatctcactaagatttgacattgccaaatattggcacactttggtgtcatcaaagttggtattgttgaatgttttcagtttgtaacttaccaaattttgaaagttctcttattggaagaaacttttagaaatatcaaaatttggtaaggtgacaatgaagaagagtgtttagtttatggtattactccctccatctacttttgatagtcatattttcaaatctaaaaattttatttttgataggcatatttcaatccaacaacctatcatcttaatgatttttttaaatttaatgcgtgactctccattcttcaacacatgattggctacatgggtattgagaaatgtaaatattaatgaatcgcttgtttacgaggaatgactagtagcatatttaaatagatgataagtagaattatttatccttggtctgtgtgtcaagatgaaatatgactatcaaaagtagatggagagagtaccaaatttgataacataaaaaatgataaggttaaaagtggtaataaactgaacaagcatttatattgaccaaggtggcacgatggaacggactaattaaggtataaattccccccctcccttctttttttcatttgaggccacctgtacaattgtttgcatgtttgggctaggtttattctgtggaataagttcactttatgaccctcaaaagtgatcgaaatctaatccatgaccctaaaccacaaaaccggatatctcgacccccaactcttaaaaccggtgcaatttgactcccttggtggttttggaggacagtttcgctgacgtggcgcttacatgtcagtattgactcggtcttctgtccacatggtgttgacgtggcgcttaggtggcattagaaataaaaaaaatatacgtgggacccatttgtcattcaccaaaagtataggtgggacccactgacatgtggggcccacataaatcatatcctcccctct

SEQ ID NO: 11644 - DNA, 398 bp, Oryza sativa
cgaattcgagctcggtacccattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggtgaaatcgtgacaagaccctccacataaccctcccctaaccatccacaccacgctaaggtttcacccccacccctcaaaaggcagtgggcggtcccctcttgcgccgcagtgaatccggcag

SEQ ID NO: 11645 - DNA, 867 bp, Oryza sativa
agacctaagtcataacattgagcaattctatttaagtactaagtaaatttctacgtgcttccatccttgcgttgcagaaattgggtctcgatacaagtgaaattctaccacacgtcttcaaagctctcactgacgagttttgcgggttcatccgtcatcatgtcgtggcgaatacaacatcaacaaggccccacaacgagtgcaatcttctgcccctccccctcggcaccaagccgcgaagaaattagctcctaggaaaaaaaaacctactagctagatttatgtgaaaaaaatgtatttaattagtgtttatgcatgaactatggaagtgtactttatgtgtaatgcatttgaatatttgctattattatggattctattctatgttttctattacatgctcgatgacttgaggatgagaaactcttaaaatcataggctcaccccatgttggaggtaaaatacaatcgcatttatatttttgcacttatgaattcttaaatattgcagacttaggaatttttcatattaatgttcataatctagacataggaatttttcgacctaaaaatttagacttacaatcttttgacttaggaattttaaactacgcatattttgagttaggatatatatgcaaatgtttaggatttatatgcaaatgtttaggatatatattttgagtttggatttacgaattttgacttaggcttgtaggtttttatatgttgtgatgaatggcttgtaggtttttatttgttgtgatgaatgtgaatgtgaatgtgaatgtgaattgtgaaatgtgaatgtgaaatgtgatgtggatgtggaatgtggaatgtagaatgtggatgtgaatgtgaaata

SEQ ID NO: 11646 - DNA, 1501 bp, Oryza sativa
catagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattgtaatttttttaagtactttgagtgtccaagtattttcaggatttttcttcaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgc

SEQ ID NO: 11647 - DNA, 1501 bp, Oryza sativa
cctctaaccaagcacaccacacctcaggtttcacccccactccttgcaaggcagcgggcagtcccctctcgtgccttggtgaatccggaagccgcataggccatcgcagggcccatccaaactccatcacgcccacccttgcctggatgcatcaactagaggaaagctatactacaagcccagccgttgcccacgctggcttgtggtaagtacgaggaattcttccagggtttcccgcgaaccggtccttaattgccatgggtgcgactagcaaaaccatgcacccatagcccaccatttaacatattttaatgaagcgacaccaggacggtggctctaatccaacatcaacactagaacctgaagtctatacattaaatataattttccccattctgtgctagttgaactaagcatggctaagcaacccctagttcaatatgtagtcatgttatatcccaggctaacaaaggaacatggtacaaaaataacatggctataacagtaggtaaacatcccatggtaataatataaaacaatgcagcatttgaaggaaaacaatagagcatttgcaatataggatcaacatgatcaagtgacaagcatgttttgccttgctctgccgctggaggaatctcggagactatttcaaactacaccggagcatcgggagagccggaatctaagcgacatacaaagcaaacaatacaaacaggctataagactactgaaacagagaacaaaaccatttttaatggattctatgcatttttcttgatttactgagacttgaatgggcttaaacggagctcagatgaattagatatgaattttagaagattcactgtgtttttactataacagaaaaatccttaattgatttattgcgcaatacataaatcccgagagagagaggggcggcgccgacatgcgggtcccacatggcagtgactcggggagggcggtccatggtggactgggtccacggaccgggaaggagcggtgcgccacgtggtgcactcgtggcgccgacgcggtgcacacgcggcagccacgcgggcagccgaaccgacagccccgatccactcggggtggatcggacggcggagggggcggtacgcggccggcgcagcgcggcgcaaggcagtgaccggcggcgaccggccggcggcggagagcaatggcgtcgcagcgacgtggatggcgacagcggcggctaagcggttggccggtggcgtggtggctagtcggcgcgggagagagggagaaaggggaggagggtcctcaccgacgacgatcgacgacggcgagcgacggagggcgatggtgacggcgagacgagctccggaaccatctaacgaagaagaggagaggggttagagggagagaggaaaatccaagagggcgagagcgccggccgaggacggcggccatggcggtgctcaccggcgcacggcaaggagtgaattccggcggtggattccgacggaggaggggtgga

SEQ ID NO: 11648 - DNA, 1501 bp, Oryza sativa
gcaacagatcctttaacagctcaaggagttctgtaaaactcttgtccgaccagccattactagccttaagcttcatcagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcaagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgcagggagttcggtagattagcgtgtcattagtgtgctaattggagtcaaagacgcagctgcatgctgatttgttcaggacgtgcatgtaggaaggatgagtgaagtctgaactacatgcgcacactgaaattagttggtgagtggagaaattagtgcgtgcatgcaggattagtggaggtgatcctgctgcatattcgtggagtctgttgtgtaactgattgaccgggttgtgtggctaaacgtggctaagtgtgtgtgtgtgcgtgtggggctatttaagccatgtaattagcctgttaatcagagtgtggtgaata

SEQ ID NO: 11649 - DNA, 541 bp, Oryza sativa
tgttacactctgaaaaataagtttggatactcccaccggttttataataattctcgttgttttggacaataataacacggcatattcactacatgacaagtaaaaatcatgtgattggttgacggacatcgcaaaaatgtagtttattgaatgcgtggtactccctccttccctaaatgtttgacgccgttgatttttgtaaacatgtttgactattcgtcttatttaaaaacttttatgaaatatgtaaaactatatgtatacataaaagtatatttaacaatgaaacaaatggtaggaaaataattaataattgcttaaattttttgaataagacgaacggtcaaacatatttaaaaaagtcaacggtgtctaacatttagggatggagggagtatatgcttagagctaactattgtatgcgtggattattagattggctataaatgatacgccaattttgacagctagaaactggtattaaatcaacacataactatgacctaaattaatcaaattttgggaactactcctacataga

SEQ ID NO: 11650 - DNA, 254 bp, Oryza sativa
gatcccctaattattttccattgttaaatatacttttatgtatacatatagttttacatatttcataaaagtttttaaataagacgaatagtcaaacatgtttacaaaaatcaacggcgtcaaacatttagggaaggagggagtaccacgcattcaataaactacatttttgcgatgtccgtcaaccaatcacatgatttttacttgtcatgtagtgaatatgccgtgttattattgtccaaaacaacgagaat

SEQ ID NO: 11651 - DNA, 1501 bp, Oryza sativa
gacggagacaattagacgtttgcgggcgttcgaggagtcctccaaggggcgacgtcgtgaaaacgcaggggaggagcagctgcttattgcaggggctgagcaacggctcacacgcactgagtgggaggccattgttgctaaagagaagaagagtgatgaggcctctggcaatggtgagaagaagttccgcggcaagttcaacaaatcgaagattgagtgccgcaggtgtggcaagttcggacacttcgctgacgagtgtgatgagccgcggaagatggccaaggcagtgacgcagcttgtcatcgcggacgcggatgatgagccaacgttgctgtgaaaccggttgtggaggtggagaataaaatccaacaagattagagggtgattgttagagttaatcttgttgtttatgttttcattatattcagtcatgtatacgtagtggtctgagtccaaattagctagtgtgttgcgtggcatggtgagctgatcagccgttagtgaaagcacaaagtggtgcagcactacactggccaaggtcacctgtgacgggcccaaaccctcatctttgacgacttcgcgcatggtcagtgatcagtggtcactggtgagtccagtcacctttgacgggtggccggccgtcacaggtgacacccacctctgacgggcaagttactagaaggccgtcagaggtgttggtctccgctagccttgagcgagttaggacccgtcacaggtgactcatctctgacggccctttaaataaaggccgtcagaggttggggtctccgtagttagaagctgtcacaggtgatctacctgtgacggccccaaaagtaaaggcccgtcacaggtaggtcacctctgacgggcctttatttgctagtccgtcacaggttatgttacctttgacggatttttgttccgacccgtcactgatgagttaattccagaaaaaaaataaatgctaaatattggctagcctcaggatttgctagccatgccctctgaaaaatagaaacatcacagatatattccagtcacagatccatcacagatacatcacccccccaatataacatcacagatccccaacaacacatatatgcagttcaaatgccacaattttgcacagcaaattcacaccccttgaaagccacaatttcgatcgttgctcatagaaccgcatatatacttaccaaatggattaaagccataatgtcatcgacctgcacaacctgtcaataaggaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaa

SEQ ID NO: 11652 - DNA, 964 bp, Oryza sativa
ggggggggggggttggtgcagcactgtagtagcaaatttttttctcaagctatattatagtaaattataatgttttcatgtattatcaccatcaatggttcaacataagtaacaatggagttaggttaataatatcgagtagaatacttccttttattttagtcatgaatatttagtgtctaggataatacattcagtcaaaattgtatgttttgaccataaaatttctgaaatacttaactaaaaaataaaataaatggtcgatttgtctggaaaattataatcatccttgagctttatcatgcctaatatgcttacttttttttgcatttctagtattaaccagagttttttttaaagaaattctccataaatgcacatctcatttttagtcatgcaacaatatttagataaaataaaagacagtaactatacatactatcctaccatggttacattgcatcacagcatgtatatatttttttctctccaacgacaactattatcacacaattcaaaacttatctttcaccggagttcttccaatgaatcaaattaacttgtaaagaattagaaaaggagaagaaaagatagaggagactgcaaactgcaatgtaactcatggacaaaaagaaaggacaaagacatgcgtgcatacagctgtactcataaataactgcagactgcaacataactcatgctgtgtttatgggccgctcgtgtgtctcctgtggtctggtttctgatgtagggggtacactaagctgggagaaggggggtgcccatacggtaagtaagggtgttaagcactaatttttcttttttagccgggtgcccaggaaccccgcaggctgtacttagcttcgagcctctcaagcactgatgcactcaccatctcaaattatcaatgcatcaaccgtacaacaatgaatccatgctattagaaagtttaggaagaaattgc

SEQ ID NO: 11653 - DNA, 736 bp, Oryza sativa
  unsure (1)..(736): unsure at all n locations
tttcaccaaatgttgtaaatatcccggtatagaatgaaagagtggtggcgggtatatcgaactcaaaaggagtggcgtcttttatttttcgtttttaagggggaatcggtatctatatcgaacttttttttccgtttttgagagggaatcggataggagtcgaacttttttttattatttttttcgctttttttttctttcatccgtttttttgatcggacaattatttttgggaatcagacaaattcattttttccccgatttttcttttaccgcgtcatatttggtttttcttttcttttttcgcacgttttcttccgcccggtttttttggatcggacaattttagtttttttcgccggtcttttctcgcccctttttctggataggacagatttgcagatttagtttttctttttttcgcacgttttcttttgcccggtttttttatcggacaattttggttttttttcgccggtttttttgcctcttttttctggacgttttctttcgctcagttttttagatcggataaatttggtttttttcgcccgatttttttgacggacaatggaagcacctcttatgttttaagtagtagagatagagatatgttaattttgattaatccagatcgaattaattaacatatttaaatatatgtaatgcatgccacgtactgcagattatnggacggtttggattatcatcagcacaaaaaaatgcctactgcagc

SEQ ID NO: 11654 - DNA, 899 bp, Oryza sativa
  unsure (1)..(899): unsure at all n locations
atgcacgtgtgcagccactactacttaaaaaaaataaggatctttcatgacccttaagatttattttcactagcggccataaaaaacctcgcttgtaaaataaaaacagacctgaaaacttggtcccaccaataaaaatggatttccacaagcagagtcttaagagcactacttgaaaaaaataaccccacatatgaaaatccatttttactagcggagtctaagggttaccaccaacaaaaagatcataggagaagggcgtgtggatcaagtcgtccttatcccatccctcaactatctctttttcttttccatcagccacttcctcaaccacttcctagatatcccctccctcatccatttcctctcctctccctctcttgcttcgatggcttgatggcggcgacggcggcaagaaaagccatggctgggctcggtggtggcagcatagggaggagacttcatggtggaggaaggaccaacaacggccaggcttcgcagtggaaaggggaaccgtggcgggctcagcggtggcaaggagaaagtagtgatggtggaggagcangacacctgatccggtgatgacaagttcgtctatggcggttgaaggggagtgctgcctccaccatcaatccctactcgagaagagctcaaccacacggcgaaaggggagggcggtagtagtagagcaagggagtccctagcttgtggatccagtggtggtaggcatcgagagctctagttccagtggtgctggtctttgggatctctgaatctgctggtggctacaggttagcgataataagacaaatggcttagagaaatcgaccaagacctccttcctcatctttcccgaccagatctgagctggcctgacctcctttctttgaaccggcagc

SEQ ID NO: 11655 - DNA, 335 bp, Oryza sativa
  unsure (1)..(335): unsure at all n locations
ccgccgcccaccgtgccatcgnctatacatacccaccccccacccacctccttgtaagttgcaacctcccgcctcacccgccgccattgacgaccaccgcgctcgtcccatcccatgcctgcggccgtgaccgcgaggttgtgaggagaagagagtcccaagagaggaggatcgatgcggcagcggcaggccggcgagcaggaggcggagctgttcgtccagtggaggccctgcgacaagaagcggtcctagtcgcccgccgccgctcgcccactcggcggcgtcgtcgatctgagagggacaggggaagaggaagaagcagaggaggaggagga

SEQ ID NO: 11656 - DNA, 415 bp, Oryza sativa
  unsure (1)..(415): unsure at all n locations
catatgccgcgctaacaaagagccatacttggcatgaaaaagaaaaaggaaaaaagagtagtcataacagaaagagatttgaaggaaaaacctaggatccaacgggcaacgggcaacggcaacggtgctgtatctgtgggtgcaccggcccacgtgcagttgcagcggggcgctaaatggcacagcaggggggcaatttggtcacgagaataataataaaattgtaaaaggaattaaagaaagcccagtggatatgaaaggacctggcttgttgtggggcccattcgtgtggttctactagtacttctcctgggcctttcgctttgcgagagagaaagccacgtggcgggggaagcctgggctgccgacaccccgcccacatgtcgtncaaccgcccgctcacacgcgccgcgca

SEQ ID NO: 11657 - DNA, 1501 bp, Oryza sativa
acacatgttacttttacttatcgttatcgtagtatacttctacagcaacgcacggggtttcacctatagttggccataaggcccgacagcccggcccaggcacggcatggcctgatcgctgtcgggcccgtgccggcacggcccggttgttgggccatgcctgggcctatgccttggcacggtgggccggactggcacggcacaaactttagggaggtgaaataaacttattttaaaccacctataagacaaggcacaaagaatagggaggataaatagacgtattatttggcacggcccaaagtgtagggacattaaatagacttgttttagttatatatatgtcacaacctaaagaggagggaggggaaacaaacttatttcaaagaaagcacaatggactatccgtgccttcgggctggtccggcacggcccgacccttattgggccgtgcctggtccacaggtggagcacatgggccggcccggcaaatcttggcccgggcaagaccgggaccaactatagtttcacctagtatatatagtatatataaaaggtgactgtccaaacataccggaacgtgtctccgtcaccggcggaggcggcggtgggctcgatggcgccgttgagttgatctccgacagtgacccgatcttcagcttgggctccccgccgtagaacttgtacgtgtcgtacctgtaaccgcaacgggcgccgatgttgcgcacgccggagaccgagccgttgaaggtggtgttgccgacgaggtcctgcaggcactgccggcagtcgccgccggacatgtccggcgtgcactgcatcagcgagaacagcggcggcgtgacgacgtccatccgcaccgtggtgtaccacctcacggcggcggccccgccgcccgtggaattgtacggcacggcccactgcatcgtgtagctcaggagcgccctcacgagggtgacgaagtcggcgccgccgccgccacgccgggtggagcgatcgacgtcgtagagcctcacctgggccgggttggccggagaggagaggaagtcgtcgccggagaagtagaggaggcaggggtcgtagtagacggccacctccttgctgtaggggcacacgctctgcgcgtcgcggaaggcgcgggaggcgcagtcggcgcacgacgacgacgaggcgttggcggaggcggtgtcgcctctgcagagggtcagggcgaacaccctgtcgggctcggcgtcgccgccgccggcggcgtccttggcgaagagtgcgggggaggaagacgacgcggtcgacgggagggtcgcggcgagggcctgcaggttggcctggtatttgctcccggccgtgtagttgccgctgcttccgcagtagtgctgccatggtgggtcgccggatgcaattgcagccaacggaagcagcagcatcaccaagaccagcggtagaacggtcaaaatggccattgcacagtgaccgacacactatattactctatagttggcca

SEQ ID NO: 11658 - DNA, 1501 bp, Oryza sativa
ggaagcagacgatgatctacttttggatcatgaaaatttttgtaactgggttaatctagcagtagcatagctagttgattttgaaagcttttgtgtcagtggatgcatgacacccaatttaagcgaaaatagttagggtgtgtttagttcacgaaaagaaaatttttgagtgtcacatcggacatttgaccatatatcggaaggggttttcggacacgaatgaaaaaattaatttcataactcacctgaaaaccgtgagacgaatttattaagcctaattaattcgtgattagcacatatgggttactgtagctgtcggtgacatgggatcaggagtatcatgactagaggtttgaggcagacgcaatcgcccacgtggcctggcaccctcgggggacgtcgggcccgagggtgatgtgttcgacctcctcttagtccccccgagggggtcggaccgcacccgcctcggccccgagggccgaggcgccccgacccctcgtgggttttttctccgcgtgtatgggttaggtgagcacagcggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcttatcagaaggtcattcggacggcaactatacaaatctccgtccatttatgaaaagggagggtaagtccccacagaaaagagggagatggtgcatgtggtatccccttaagatataaaaggaggaccttgcccacttagaggggggactggactggactggactggactttccgggattcggaacccagaacaagggagaggctggctcatactttgtagctccttcagacacagatccaccaaaaacacaggagtagggtattacgcttctcagcggcccgaacctgtatacatcgcccgtgtcttgtgctctttcgattgtcgcaatccttccacacatcaagagcttagaatttcacccagagtccccggccgaaccggcaaaggggggcctgcgcggtctcccggtgaggagccacaagctccgtcatctggcgcgccaggtagggggctcagcgtgtgtcttctgagctctcgcactcttccgtgtgcgccaagcttttcctgttcagcctga

SEQ ID NO: 11659 - DNA, 717 bp, Oryza sativa
acaaaacttgctttgcgcaaaagaaccatagccatcctttgaattcctctgtcatgtgcatcattgctgtggtggcttgctgagtacggttggtactcacccttgcaaatataaaattaatcagaagcaggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttgggatgtattccggaccgctcggtccgatgatttaagactacgcctgcgggcttatgatgtaataattcgtattagacactcgtgtatgtgcacttggtatttcagctatgaattcgtgtgtaccagactacgtgatccagggaaatggtactgtttacacgattgattcctgttataaaaacgggggtccacagagctggtatcagagccatatgactgtaggaaaagaccaaaaggcgccccaccccttttctaagttggccaagggagaaattcccatttagtaatactttcaaaaataaaaacgctatatttacaaaactcggtacaattttcatcttactcttaactattttcttcacaaaacaagttttactctcaattgactttgggtttttcttaaaattagatggcagattcggattcacccgctacctgagagt

SEQ ID NO: 11660 - DNA, 746 bp, Oryza sativa
gtcaacattgtcgtttgtgtaccccggctggtcctggacggggaatttaatgcacattctgcttgaaattctattcgggaatttctgggcgtgacaatagctttcctctggctaacgttcttaggctagggtgggcgtgatgaagttgggtcggctggggtgttcggttgatcggcttccggattcactgtggcacgagggggggctgcccgttgcctgctgggggcgggggcgaaacctgaggtgtggtgcgattggttagagggggttatatgaagggtcttctcacaatcactcgacgtggtgacctgttcatcatgggcacatgatgacactgtgacatgccggtggattgtgtcttgtgggtacagttgtgcacctctggccagagtaaaactattcgaatagccatgcccgcggttatgggagatcgaccagattcaccgtgattagtctcacccctagtaaatcgactcaatgcacttattagttcaggtgggaatggttgggcctgttcaacatggtgtagcattgttcagtggagatttaatattaccttaattactctattgttttactgttttgctcaataaaatgctttacaactgcctttatgcaaatagccacaagccgtccttgtatgcccttgcacgtctgcatcattagtgtggcttgctgagtacggtggttgtacttagtcttgctatggttcccccttttcagaagtgtagtgcttctgagctgaa

SEQ ID NO: 11661 - DNA, 1501 bp, Oryza sativa
gacatgcaatttttatttgcaaacgataaaacatttataaattaggatgaaaatgctcaaggagaatgtgtgacttgccttgcttcttcactttgatcttctgaactattttcctcacaaccgcgatctttcaaaacgacggaaactactcgctggcacgcaaaacgaggaaaaaactctaataaaaaccaagtaaacagtacataaaaagtaaacaaacatgtagagctcaattttagatgaattttgcaagttgaatggtttaatttggagtttgtatgaattagatatggattttagaagtttcgagccatttaaatgaatttctagaattattattgatttattgcgcaattattatatatttttcttaaaggaaaacaaaagttattggctcagcagtggggcgggcgtggaccgagtccaccaaaggtgggccccacacgtcagccaaaaggggaggggcggcgcaccatggaccaagaccacggggtggtccacaggctaccaacacgagcggcatggcaagggtgcgggttggctcgccgaccaactcgaggcggcggcgcgtggccaaatggcgaccgccggcgacgacactagcaccgagcggcggcacgggaaacggggaaggaggggaataaatggagaggaggaggagggagggcggttcaccgaaaggcgcggcgacggagggagtcggccaacggagctcagggcagagggaggcggcggcgcttcagtgactaactgcgacggcggagggacggccgaggggcagtggggcgcggtggagatgatggtggtggaggcgctacgtggcaacggctatggcggcggtggtgtgctaccggagtcgtcaaagcggtggtagagctcgggttcacagtgaaatggtggttccggcgaggatacagggaaatggagtaaaggccggtgtccgcgaggggtggcggagctagtggtgccggtggtgcaaagcggcagcgattggagcggcggtagcggccaggactagcatacgattgaaattttaatgttatggttaatgagattattccatgtatgccacagactaacgactggtattactctctttggttcatattataattcgatttaattatttttccagttaaattgttttatgtttaattaagtttttaataaatatagtagtattttaaaaaaacgaatatgttgttaaaatatattcaaagcaattataatatggagtaaaaggagtactaatttagaaaaaaacgaaggacagaaaagaaaggaaaggaaaagtaaaagcaaacgacgattcagacagacaggctcccttccatgcctccccattgctcctactctcccttgaggccttgacccacccccaggaaaagcaagggaagcatgcccagcaaaatcgaacccacaaaacctcaggaattaccatcgcctagcaaggaatcaacaatccgtggtcaatccatggcagatcaggatgtggccgagc

SEQ ID NO: 11662 - DNA, 1501 bp, Oryza sativa
catttatctcaatcgtgttctcctttccatcttcaggggcagcagcgaagcatggagcatgaatcggtttttgcaaaatcctcgggtttgaggcaaattcctgaaaaccgccatgacagcctcaagactgtgaagatctctggtttctgctctgcaaagagcttggttgagctaacttgttatattctgaagaacgtggtgtcactcgagtctcttacattggacaccattcatggtgattgtaggtgttacctaaaaacttctccattttgtaatcacatagaggaggatattctcatggaagcccctagagcgctctcagctattaggaggtacattgaaaagatagtcccaactacagttaagttaactgttctggagccctgcagtaggtgccatgcaaaaggtttacagcgtatatcatgctaattatgctgtgtctcatcatgtggggccttcagtatcagcgccgtcgccgggaaaagaaaaaacaggcaaacaccacaggaactaagatggcgcaggattagtttggataagttagcttcagatttatctctttagtttcagtgtctatctagtaagcttgttactatacattcttaattgacattcttgtggctggctcgagcatcatatatagacatataggcagaggtgtaaacaagcctgtctatttcagtgctcacgtcatatcatattaaatccttagttttcgtaacccacttccggtgaaccacagcacagctagcctttgctacagggtaacagtaccagcgtatgcatgcaccgtgcgatctcgccatcttgattccatccggccgtccatcagcacgttgtggctccgaaagattctctctcccattccccattccccacctttccccacccatgctactcccaaatccccaatccccatcccaaaatcctcgccacctccgccccaaaaatcctcgccgccgaccggcgccgccgtcttctcgcggagcaagcagcgagcactacagcctccatgtcgccgagccagccagccaacattgtcgtcttctcgccttacttgccggcgaccccgtgtcgcttcgtcatcgtcgagccagctgtgccgctcccttcccttggagccactgttctgcgccaccccctgtggagccaacatccgccgtcgtcttctcgtggagccaatggtcagcactgccaccaaacatctcgtccatggccatctcctcgcttcctgtgactgctgcttgtcggctcctccacacctctccaattggtactgccatcctctaccactctgtatgcactaatacttattaggttcattttgttttcctcgtattgttgatctgcataactgttcttttctgcagtaggtattttactactcagattacctttgctttgctctctatataggtatgattcctactaatccataaatatttcttctgatatgtttgctacctgtacaatcggcctaaaatgcaaacaacaataaggt

SEQ ID NO: 11663 - DNA, 1372 bp, Oryza sativa
ccatggtgaagaacataatgctaatgtttatttagatggttttgtgatggccagcgttgttttattgatattattggccggagaataatcatggttatggcgggaagtactaaaaaactaaatattttcctctaaatctatatgattaagatagttgattagaagaagagtaggtgccatgatcccagccgtagaagtcagaagaacggttaagattgagccaaatctaccggtggagttggccccaactccaggggatctggacccctaactagtttacgaagagattatgcagggctcaagaaaaggatatggatacaaatacaaaaggctaaggggcgattgatcgcccctagcgatcagccgatcccccctccctcaacgtggttttcttttttggcaccgcattatttttctattttagtaaatttatacacctaaaatttgtacccctaaagtttacacatcaaatgtttagaaacccaaggtttataagtcaaaagtctatatatccgatttaaatttaaatttaaattcaaatattttttaatatagtatttctatacatctaaagtttatacacctaaaatttataaaacctaaagtttataagttaaaattttacatacccgtttcaaatttgaatttgaattcaaatattagtttgtagacccaaagtttataagtcaaaattttacatacccgttttaaatttgaatttgaattcaaatattatttatagacccaaagtttataagtcaaaagtttgcatacccgttcaaatttgaatttgaatttaaatattagtttatagacccagagtttataagtcaaaagtttacatacatgtttcaaatttgaatttgaatttaaatattagtttatagacctaaagtttataagtcaaaagtttacacacccatttcaaatctgaatttgaattcaaatatcaaatattttttatatatagtatttctatacataattttttttaactttgtttttttattttttaaaaaatttatgatgtaataggaagagaagaaggggaggaggaaaggggagaggaggagcatataggagggatggggggtgatcgctccgcctattagccacgcccgatacaaataccattgtccgaaacattgaatttctcctttccggagtactggggtcagtgcatgtagaaaatccgcgttgccctctcatagcatctccatgcaaggtgctacataataaaagcatctttataaatatcctcttctccaatttagaaattcatataccttatggaatattcttttatctaagagccgtgggatcgctgagaaattagggccgccacgtcagcgtattagtctaacagcgatca

SEQ ID NO: 11664 - DNA, 1501 bp, Oryza sativa
  unsure (1)..(1501): unsure at all n locations
ttataattagaggtaacctcctaaaaatttgtttgtataagccctctctttgacattttagttcttctctgatcttcatttaaattgagttatttcttgatttggttttattactttctttcgattaaaattccttgttgcaaatctattaaaaacccgttttacttttatgaattattggtccaagaaatcctccaatattgtccttaatcctaaaccagaggaattccaattggaattatttctttaccaaacccttgatctaggtttacctctaaaaatccttaattcttctccatccgaaatattctatcatttattctttactcaagctcctattttgatctaacctcccgttccaatttccataatctaatacttctcggcacaagattagcaatattataaatattagaatgattgctcttgtgctaagaaaattccaatttatactcctcatccaaaattcaaatctcctattagccacaaaatatttctctaaatccataccacccatttgtggggataaaatcctatttatcttcattcatgtattttctaccacgttcccaaaaatatatccaaattagaagccctattatttatagtgcaaaatattcctatttcttatttgagtgcttctaaatatattccacctccaaaaaatcactctcatataaattagaaactttatcttttgaaaatctcctccaaattcaaattgtgttcaaacctaatcatctaaatcttcaacaaaaatttaaaaaatatttttatttcagttgtgggccgaaacctctcagcagaggcagccgctcctcctccctgtcccgtgggcgccgtcgccaacataccatgggcgccgtcgcatcgagttggagccgccgtcgccgctgcttcgccaagccagaggcgccatcgccgtgccgtgctcctcctcctccacctccgcccgcagctttgcgtcactaccctgatctcagccgctacgtcaaacagacgcggtcgaccaatcggagacaaagccgtcagccgttttctctttccccactccgccgatgccgtgtttcccttcctctcttcctctgcgaaccgcctcttgacgcctataaatagacggcgaaaagctcgcccctcccctccacacaaccgagctctctgagctctcctcttctctctctctcccatgctagccatcggttgatctccctcaccggagcattgccgaccaaatactcgcgccaatagcttcgcctcaatgaagtgaatccattttcctactttcccctcttccctacccattccatgatcaagccaccacagctacctcttttgctgccggagtgagctcttgccctcgccgttccggcctnctctctcagtgcttgtgtatgaagccaccctccctagatgcgcgtcgctcgggaacatcatctgccgncgacgctacctttccctgtccaccggagcaccagcgcccttctctccctcctctcagttc

SEQ ID NO: 11665 - DNA, 1501 bp, Oryza sativa
tatttcaaaagtagctctataaatccaatagaatagttggtaaacaaaacgtattgtacgcttgcaactaaatgattatatgtaaattagaataatactatactctagagcctgacaaagggaactattaagattgcaggaatctaaatgatgagccaataacagtgttaaggatctttctgtaaagtcaacatatgcattatgaccaatcactggataaacagcaaggatgcacacatgacattcatcctttttcaaaattaataactgagctatcccaaagaaattaaacaattgctaaaataatttgaatataatttgtgctcataattacaaatggtgctaccgcggataaatgtgttcttttcttcagatagaagaacttggaagacttgcggtagtttactcccttgctgataaacatcagttactgaaagaaaatgcagaaatgttagaacaaatttaattattaccttgatggttattatgaattgaagcctcatggtgataaactgttcatatggcctcatttgcacataacagcagagtttgtactatgcaaaatgaagaaatgccatcaacttatgtgtattcactcaaatgaaggccctcatcatcccataaatgctacaaaagcatatgcaaagccatggaacctacaaaagcaaggtgttacacatgcagttcaacaaatatatcactcactgaagaccatgaacctgacagtccatacataggccttgtaatgtaagcaatcatggcatcatactacagcaagcggttgcgatcaagttgaattgtgtgccttctgtactaaacatcaagattatctatgaaatagtaaattatcttctagcttgaatcaacacttcattcttctcatttgtatcgccatgaagccaattaggaacactgaagcaggtagcaaaaaaaacaatcttatgtacaccaaagcagtaactaattattcctatgcatgcacaaatagaacatgtgcaatcggacaagtagcacaatgattttttataggtttacccttcatggtgcattgttttgtggcatcctgcactaaccataggtatatggtcacatcgtacaattacatagggaaaaaaatcaggccaatatctctttgtgcatgctattttgctgtgtgtaaaaaaatgaaaatatgtgctataaccacattgctgttaaacaaatggaatcccagcaatatatataaaactatcatgcatccctgaaacaatggggaatcatgtattatgaaagaaataggataaccttattgttgtttgcattttaggccgattgtacaggtagcaaacatatcagaagaaatatttatggattagtaggaatcatacctatatagagagcaaagcaaaggtaatctgagtagtaaaatacctactgcagaaaagaacagttatgcagatcaacaatacgaggaaaacaaaatgaacctaataagtattagtgcatacagagtggtagagga

SEQ ID NO: 11666 - DNA, 254 bp, Oryza sativa
gtgtgtttttcgcatcaacaaaccacctattcagcccccctctagtcggcctccttgatcctatagctccgccctctttcctttgcacgccttcctctgcacatcgccacagctgcgcccccgcccagtccgccgccaaatttgcccctcaagccacagcgtccttgcccagatcggcgccggcaccgacctaacgctcgcctttgcgcatttatcaacaccaccatctgcccaccgcaccaactcgccctagc

SEQ ID NO: 11667 - DNA, 1450 bp, Oryza sativa
atcggactttctttttagttttttttcgctgttttttttatttgtgacggacaaaggaaacatctcttaaaaaacttattttttaagtagtactagaaaataggcccgtacgttacaacgggtgaagactattttaatcatattattgttagattttttctgaaaagtatatgggatttttatttgatagtattgatatctaatttagcacccttatttgggatgatggtcatatcatgtacgatgctttcttatgctctaacaagaattctgaagcaattaggagtataactcccgtcccaagttagatgcgagtttttaaaaggaattgttgtacgactccttatgtatttttaaaaacagataaacttaaaaaccgacttaaatacgaatgacgttgcaaggtatcaacagaaacatgtacattttttataaaaatagagatttccgtttgatttgagttttgtgctgtatattttcttattggtgaaaaaaaaagttcgttggagcaatttatgtggtatacttacatacatgcaacattccttgctgttgctggcccgttggatacgtgggcaactataaagagtgaaattcacggcgcccatgaagaatggatatagatataatagtcggatgataaaattaaaaaccaattcaaatacggatgatgtatcaaaattctgacgaaaacatctttagttttataatagaagagatagaaatatagtcatatagagataaaggtgtagaatattcaatttcggtgcagataatatcttaattcaatccatatgcagattccatgatttctctcgataatctataggaaagggaaacaattttatccaaagagaattacaatcattaatcgatagggagcagaaaatctccttgtattagtagcaccaactaatagcagtgcagcatgtatcaacaccgatccgtgccattacgtgactgattaattaaatgcaaccgtaatcaatcaagtctctggttacgaagtaaatccatgcggacgcgcgacgccaaccaacacaggagacgacgcatcgtcgcacgcagaggcgatacgtacgaaaatcaggcaaaaacatcttaaaattttataatagataaagataagtagacagatttattttagttagtaaccaggattaatttgcatatatcacgtttgccatttcatctaacgccatctgaattgatttccctgctatgctgtgttccatacggtgcaggatacaataccacgagctgattatccctcctgacttattcctgggctagctacgaacaaagattctataaagatgtatttgctattaatgtaagcgaacgcccagcttttctatattggtgagaggtgaatcagcaatgtgtgccttagtgcaccatttacctctacataagggtggaaacgagcctggctcggctcggcttgtaa

SEQ ID NO: 11668 - DNA, 1501 bp, Oryza sativa
tataacctattgatcaaattgttaagagcttgaagagatgatgttatgataataaatatccaaggaaatgttggcataccaaaagcagatggaagcttgatgtcgacatcaggcatgaaatttgctagtagagtttaattggtctcaaacagatcaaagctgaaatttcacaaataccgtgttaagagtcagaaattagaaagtgctttcctcatgaattttcaaaaatagggattttttggcatcttattatagctcgcaattgactaagtccatcattacatgaaatcatcaaataattaaccattattactataaaatcctggtagacaaagaccagatatcatcagtacaagtaaacacaaattaaggcatgtatcacatttctatagagaaaaggtgattatttacaaacaaaaagcctttttacaggcctcgaagatgtacatagtatcatacctcctggatgatagcagataccacaaatttaaaccagatgtgtagctctacaagaaccgtaaaaaggatcttttttttaaccatccttgaggaggtggctatacattctcaccttgctaggtagcaatagttatttattgcaaggtgataatttgaaaacatgattgtttcaaaacacagttcataaatgtcttaaaaactacattgatatgtacaagtcttacataagtgtatatcatgaagccgatgatcttgtacaaaattattaatgcatcataattgtaggtttgagcaacacaaaacaatctttaaataaattgagttagattacatccttatatgaatcgctttataagttgacttatttaattattagtgtaaaattttaataccaacaggtagttccctaatgttgagttgaagaaaaaataatctaagaaaaaaggcaaccatgctgttactgtgatgtatttagtttgggacaaaatatacttcctgtatttcagaatatatatatatattttaaaataaagacaataaaaggccatagggtcatatctacattaacccaatattaagcctaagtaagcaaccaaccaattgcgctacttctcaacaggagcatcgacaccacaccgaacagtatgggcgcgatggcgaggtagatttataatcgaagtccacatggcaggcagtatgcctgtgatggcgaggtggtttcgtactccaaatctggttgtgtcattcaaagcagtaaagcaattaacaatcaacgatgaagagagtttgaagatttatttacatggaaaataaatgcctaccgagcagatgaatctttgaatgttggccagcatttgcctccgaatagagaacccagagccgataatcatccgtttgggctgacctagagagtaggaggagctgggcagcaacgatgagctctgacgacggtgaggtgctgtcctccaatgagcaggcctgccactatctccgtcgccgtacccctcgcaaactgatatattgtagagaaaattccctatgt

SEQ ID NO: 11669 - DNA, 1501 bp, Oryza sativa
gggtgaacaaggaaataataacaataacaataataaggtcataacaaaggtaaataggcatggctagataaaacagtgataacgcgggaatttaatgtcacatcctgatttttgtttcaggatttataaatcatttaataaattattattagaatttatattaaatgttctttaatttacaagtgaagttaaatgtgggaaataaaattttctaaatttaaagcatggatggatttaatttttattaaattctccatgattaagtcaactctctgaaatattctcggatttttcagagctcaattcctaaatgatacaaagaacagttcagtaattatttgatcattaatgatctaattagaattgttaagagcttttcttgtttaaaaaaaatccttaatttataaatttttgtttaattggaattattagaatttattttaaaagcttagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaatagaaaaaaggttttaaaatcctccttttggctttgggccgaaagtcagcccaagtctctctttccttctccctctctcctccccggcccagtcggcccagtccgccgcgccccttcctcctctctctcggccgctgacaggtgggtcccacctgtcaggttcgtcttcctcgctccgccgccgccgcccgaaccctagtcgagccgcgctgccgtctccttccaaatttggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgatgccggtcgccgtgggctttcgccgccgcgccctagcccctttaaaaggacccccgagctcccctctatccgccgtcaccctcgccgtcggaagagccctagcgccgtggacctcgctccgccgtcgtcgccgtcgctccagccgtgcttcgccgccgttccggtcgtcgtcgtcgctcggggaggtcgccatcgtggtcgccaagttgtcgccgtcctcgtccgcctcttcgccgtcgctgtagaccgccggagcaccgccgtcgtcgtcaagccgaaggtcgccgccgcttcttcctcgtcgccgtcgtcgtccgttgctcctccgccgttgctttggtcaccggtgagttcaccgcgatgcccgcatcgtcctggtgccctccgttcgtgccgaagcgccgtcattcgccggcgagcttgcgcgcccgagccgccgagccgccgccggtggtgacgtcaccgctgacgtcatcgtggccgtctgccgtgagccg

SEQ ID NO: 11670 - DNA, 1501 bp, Oryza sativa
tggtgatccacgagaggtccgatggcgtacgtcagagggagagcctgcacaacgtgaagtcacgatgcgaccccgagaagagagatgtaaaggaatcatcgaatacacttacattaatcgcggcggcgcgttcggtcgcgtccttgttgcagagtgcgatggggatatcgtccgccttcgaggatgcgctgatcattatctgaccaacgtgacgtcccacagtgtcgctgtccagacctataaatcgagaacgagaactcgataagtcaggagaaacagatgcactcggaacaaaattagaaatgcgagaaaaaataccctgaggagagacccgggtcgtgtcctctggcccagagtattcaaaggccggatgggcacgggcctgcagcggctcaatccaccgacctacgaagtcgacagcgacttcgtatcccgacaaccgccgttttcggagatcatcaatgatgtcgatgaaagattggagggagggagtcagggctggttttgcggtccactctgggatttcttctggctgatccttagggacaacaaggacgggttccgagttttctatctagagatagaaccatctcgtccgccacttgctacaataagaagggcactggaaggggatataacgcgacttcaggccattccgaagtcggaatccgatgcatccagacaccctgttggattccatcaaacgcaattcgtaatagaagcaaaagaggtcaagaaagggcactaccccaatgtaggcctctaaaagatgagagaagatgctaagaaatgcgaaggaattggggttcaagtgaaacaaagaaaggccgtagaaattcaagactagaagaagaaattcggaaggcgaagggagaaaaccgcaagaaatataatcctcgaccacaaacatggggcccaagatgagttcaggttctgtacctccagcctccctttgcaaagtcccgcgactagggagggcaccgtcgtcctacagcttcttcaggaatgcggtgttcaaggtagactactcaagatccatcgccgccaaaggatcgctggagaataagatgaaggaaataagctagggttttctttgcggggagcggagaagacgaagagcgctacaaggcaagagagttttctggcaaacggacttcgaatggattcccgaaatccctataaataagcgcactatcgatggtgcgtatcccaaggaaaggagagagattgccgccggaaaattctaggtctgttacgcgcggtagttttcagacatcaatttaaattcactcatgaccattgaacttcacgcggtgttgtcgatggctctttgtctctacggttttttacaccgagatcgatcagatgagaacgataacaatttcgacatcaaaagttgcgatcgataacatgagttcatttaagcagaagtcggggggctactatcagtgttacggataagatataccctctacccttggatgtacgctgtatactaata

SEQ ID NO: 11671 - DNA, 1501 bp, Oryza sativa
gtcatggttcttagcactaaatactggttataagccaatatctctgacgcttagccactactagaaaaactatttttttcagatgatagcactgtcgacgggggatacccgtagaccggatatagagagtattggggtccgttagtacgaggatctacatagtacgacaacaggcaaacaaaagaaaagaattatactggtttaggccccttggtaggtaatagccctaatccagttgatatgggattatatgatggaaaccacaggttacaaagggaatagcggaactcaatgataccgatgagaccgtagtcgagttggttcaactagatctcctggcgacttggctcctgcacgctccggctccgtaggctgtggtggatgttttggcagtaatattcgatgccttaggtcctgccagggggtcccttatataccgcgggttagttgatcctcaagtaggactcggagatatcggacccctcacgatacagtaaagactcaatctcgaccgagtaggactcctcccatccgtagattatgtttctatcacgtgatagatttgcttaacgtatacggaaactatccgtatacgcgtgggtataccgtattagtatacagcgtacatccaagggtagagggtatatcttatccgtaacactgatagtagccccccgacttctgcttaaatgaactcatgttatcgatcgcaacttttgatgtcgaaattgttatcgttctcatctgatcgatctcggtgtaaaaaaccgtagagacaaagagccatcgacaacaccgcgtgaagttcaatggtcatgagtgaatttaaattgatgtctgaaaactaccgcgcgtaacagacctagaattttccggcggcaatctctctcctttccttgggatacgcaccatcgatagtgcgcttatttatagggatttcgggaatccattcgaagtccgtttgccagaaaactctcttgccttgtagcgctcttcgtcttctccgctccccgcaaagaaaaccctagcttatttccttcatcttattctccagcgatcctttggcggcgatggatcttgagtagtctaccttgaacaccgcattcctgaagaagctgtaggacgacggtgccctccctagtcgcgggactttgcaaagggaggctggaggtacagaacctgaactcatcttgggccccatgtttgtggtcgaggattatatttcttgcggttttctcccttcgccttccgaatttcttcttctagtcttgaatttctacggcctttctttgtttcacttgaaccccaattccttcgcatttcttagcatcttctctcatcttttagaggcctacattggggtagtgccctttcttgacctcttttgcttctattacgaattgcgtttgatggaatccaacagggtgtctggatgcatcggattccgacttcggaatggcctgaagtcgcgttatatccccttccagtgcccttcttattg

SEQ ID NO: 11672 - DNA, 553 bp, Oryza sativa
agccccagagggcggcaaggggctaaatgcaatttttgcagacggcggcagacagcgtcgtcgagccttcatttgccacgttagcttgccgcccaccactagggcggcagggtctatttttgtaattttttgcgccgatagattatttctgtaaatattaaaagaaaaaaatttaaaaatgaaaaaaaaatcgcctccctcctctccttcgagcccctctgcacgcgcggcgcatgtgcacgccttgcgcctgaccggtgggtcgacccacccggtcgtcttcaacctccagccggccgctcctctctgtccctctcccgaacggaaaaaaattctatgcggcagcgtcgcaccaagcttctcgtgcggcactgcgtgaactggcgacgcgtgtccaactgcctcccgcgtgaggcgcgtctatcgcgatttttagtggagccgagccgacgcctatcactatggtggagccgagccgagccgtcgctctcatctgctatggcgacagcggcggcggctgctgctgctgcttctgaaacggcggcggcgcgct

SEQ ID NO: 11673 - DNA, 329 bp, Oryza sativa
gttaatcaattttctagatttttctggtaattatttgagcaaggaaagtatttttaataaggcataaatgaaacatcatttcacaaattattttaattgaaaaagtctttaaaaccatcccctaggccgttgggccgtttccggcccaactctcctcttcgcgcgcggccgtgcggcccaagccgagccgccgccccaccctctcctctcaagccgccgacatgtggggcccacatgtcggggtcatcttccacctctggccggccgagccgagcccaagcgccgccgcctccccttcgattccgccctagccagccatctccgagttc

SEQ ID NO: 11674 - DNA, 1501 bp, Oryza sativa
cccattgccactgtcgtcgaccggcgggtcgtcgtcatcgacattcacatggatcgggatgtcggaggtattgccgaacacctccacacgatcctcctccacatcatcatcgtcatcaccgcgcatccccatagtcctcaactcgtagttgacagaggtaggatcgtcatccatcgcaggcactctggtccctcaacggcggctgccgctaagcaacgggcttgtgacctgcaagcagccaacaacactcaaggttagggtcggaaatggagaaaaaaaaaataaaaacaatggttccatgcttgtacctgcgcagccggagcaccggagttgccgttgaagacgataggctcacggatctacgagaagaccaagggatctggcgaagaagaacaaacgggaaagagacgaagaggaaggctggatttggaagagtggaaggacgatgactcaggcgaccatgcgtggccggtggcccccatcctcatgcgcccctcatgcgagtcaggcgaggcatcgatcggagacgaagaggaaggctggatctggaagagtggaagggaggcgactcggtgagtctcaccggtgcgcgcctgaggccctgagcgagtgagcggcggacggtggaggacgagatctggtgggcggtggagcgtcggaggcggatcggcggaggcggttgagcggtggcggctagggttagggttaggcggagaggcggagagcgagaggcgagaggggactggggaggggaggggcggcgacgcggcgttcgctggcttatatatgcgggcgcacgcggtgcggcctggctgtctgttgggctgggccgtgctcgtgcctaccgttggtacgggccgtggtcgtgccgaccgttgggccgtgccgtgccgggccggcccatcgtgccgacctcggtccgtgccgtgccgggccggcccaccgtgcccagccataggcccaggcacggcccaatagtcgtgccgggccggcacgggcccgactgctaccgggccgtgccgtgcttgggccgggccatcgggcctcgggccatatggccaactatacttccatctctctatcctcacctcccacacttccatggccgatgccgtggcggtggccgggtcagtggagatgccggtgaatctgctcccggcgctccactccgcggacactagcgctgcagcagcgtccactacggcgccctgcagcagcgcgacgagcagcggcatccgtgtgtcgtcggcgagcagcggtcctccatgcccatcctcctccgccgccagcccaccaccacacgttgtcaggctgtcgtcatcgccggcgccgcggcggcgttgatgacggcgccctgcagcagcgcgtagttggcgagtagcggcagccacgtgtcgtcggcgagcagcggtcctccatgcacatcctcctccaccgccacaacacgtcgtcaggaggccatcgtcgccggcgctgccgcatagtcgatgacggcgccctg

SEQ ID NO: 11675 - DNA, 1501 bp, Oryza sativa
tgagctggccgccctccaccttgcacaccgtcacgtccgccgccgccgccggcagctcgtaaacgacgacggccgcctgacgacgcgtggcggcggagacggaagatgagcatggaggaccgctgctcgccgacgacacacggctgccgctgctcgccgactacgcgctgctgcagggcgccgtcatcgactatgcggcagcgccggcgacgatggcctcctgacgacgtgttgtggcggtggaggaggatgtgcatggaggaccgctgctcgccgacgacacgtggctgccgctactcgccaactacgcgctgctgcagggcgccgtcatcaacgccgccgcggcgccggcgatgacgacagcctgacaacgtgtggtggtgggctggcggcggaggaggatgggcatggaggaccgctgctcgccgacgacacacggatgccgctgctcgtcgcgctgctgcagggcgccgtagtggacgctgctgcagcgctagtgtccgcggagtggagcgccgggagcagattcaccggcatctccactgacccggccaccgccacggcatcggccatggaagtgtgggaggtgaggatagagagatggaagtatagttggccatatggcccgaggcccgatggcccggcccaagcacggcacggcccggtagcagtcgggcccgtgccggcccggcacgactattgggccgtgcctgggcctatggctgggcacggtgggccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataagccagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcgtcctccaccgtccgccgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccaaatccagccttcctcttcgtctctttcccgtttgttcttcttcgccagatcccttggtcttctcgtagatccgtgagcctatcgtcttcaacggcaactccggtgctccggctgcgcaggtacaagcatggaaccattgtttttattttttttttctccatttccgaccctaaccttgagtgttgttggctgcttgcaggtcacaagcccgttgcttagcggcagccgccgttgagggaccagagtgcctgcga

SEQ ID NO: 11676 - DNA, 1501 bp, Oryza sativa
tctggctccatatctcggtgagctaaaagttcaattaagcgctgctctaagtcgctccacgacttcactctaagcgccactcttggagtgggcccaagcaaataggctcaaagtcagatttttgacacgcttgttaagctccaaaactaaagcttccatgggccccgacaacaggtctacctggatcgattggctctagacttggacacgtcaggtgcaagatttgtggcgttggtggaccaggaataaaaaaaggtgggggaacaagggtttggctacctaaacatgttatttgtttgtgttaatgaggtggtttcccgctattaagctcaaaaggagcgtgcgatatgagaacccgatcgagtgagtcatcatatttgggtagacatggtgtgccacgtcagtaacacttgatgatgatctagaggtcaagatggaccggatatggctctcatgtgtcaccacagaacaacatctatattttataagacaattgcttatttgaccctattctaaagctcaactataaatatgacctcaccttcctgcccctggtcccacctacgctgtgtagctccattttactcagtgtttgtgtgattccttgtaataattaattgtagctctaatgagcaaaggccggaatatttattccattatctaaaaaaaaccgcttcgactcgacctccttcacgccagcgctttcgtctcagggccctcgtagagcaaggaggagttctcatattgctgaggggctgaccgacatggcgacgggcgacgacacaacgcagtgcaatgcagacgtggctagcaatgccacagcggctccgagctgacaagctccctaaattaagtcttgattcaatggcgaactggcgactaacaggcaaagtcacaaggaagcacctgagcagcacatatcagcacttgagtccgatttgggtttgctatggttgtgttagatttaattgggtaattgatccatttaaatcaattaaatcaaataaatttcaaggctcattatgctaggaattcatgtgaatttatttttttatgggatatcaatgggatgaagagttttgagaattaatccatttgattagggaattggtaacttatatcaattagtcctaattgatggatggttgatggttgtgtagtggaggatggtttatggctagttgatgacaattagttgctatattcctcttcctattccattggtgatggttgtgtagtggaggatggtttatggctagttgatgacaattagttgctctattcctcttcctattccatcggtgatggttgtgtagtggaggatagttgatggctaattgatgagaattaattactctattcctctttctattccatgactcttactcttcatcttccattcctcttataaaatgataatggatttgatctcccgcgaaagaggaagacacactttcatcctttttccaacgctgttactgctacggtaatcccaacgcga

SEQ ID NO: 11677 - DNA, 1501 bp, Oryza sativa
acgtgctctcccgccacggaggcgtacgtatacgtacacttatacgtacgtacgaggaggaggtcggcttcgccgcgccgaaactaaagtgacggccgaatcgccacaacgtccacgtcgcagtgggccccacttgaagcgggcccacctgaagctcgtgggtaggagtggcctttggcgtgtataaataaccctcgccttcttcgtcttccctccccccctcttccccaaccccaactactcgcgcttcgaacccacaagttttcggatattacatataggtccctgatcgccgcaatgctgtccctccacgacgccatgccgctcgacttcggcctcccggacatggacgtcggcttcggcttgttcggcgtcgacgcggcggcgttcggatacgatggtgttgcctcggatgcggccgccggcttgtcgccggtggtaggtgccggcgatgggagtggtggtggtggtgatgtgttgttgtactgtgacggcggaggcggcggcggcggcggcggcgaggacggcgaggaggagaggcggcggcggctgaggaggaagatctcgaaccgggagtcggcgcggcggtcgcgggcgcggaggcggcagcgggtggaggagctggagcgcgccgcggacgagctccgcgccgagcggcgcgcgctggcgtcgaggctggacgccacggcgcggcgggcgctcgccgtgcgcggcgcgaacgcgcggcaccacgccgaggcgggcgtgctccggcgccgcctcggcgaggcgcagcgcaacgccgccgtgctgatagggctgtcccgcctcctacgctcgacggcgaacggcgcccacggcggcgccgccccggcccagttgtcgaacggcggcgtggcgtcgttgatgacgtaggagaaagagagaaagcaccatgggaaggaatggtagtagcttgaaggtttccgtcgtcacgtcgactagtgttaagttaatgcgtataatttcaagttccttaattttcttttcaaatttctcgaaaattaggaggagtataaatatgggttttagaagggtattatgtaaattgagagaggctgatatgccctccatttcgtaatatctctccatttgttttcggagaaaaaatatagtacaaataaatagtgggccggctatttggacaccctgcacaacactttcggtccaaatctttaatatattcggcccatttctatccacgaagagagaataaggcccatgggccgaacccgtcggctagggcttccacgcgtccatccgccattatataaacaccaccatgcctctctcctctccatctcctcatcctcgcgctcgcggcggcacgctctccttctctgttgctctctctcgatcttgtttcattcagatgagatgtgatttttctcctgttttttgttttttggggttggtttcatctggcgttggataggaatttggatgtttacctgttcatgggagcactgtcccaaaggccggc

SEQ ID NO: 11678 - DNA, 1501 bp, Oryza sativa
ctggcctgacctgaccttaacatgcatttttttcttggtttggaagacgctgtcagagacgataaaacaaagagctcaaattgctggtcccgtgtaaatgcggcgttgctggaatctggacctgcctgactggctgtctaatttcgctcgcttattcagaggcattgtgttttcgaggtttacgagtgatagataaattccaaagtttaaccttcctgttggcgagatcttttgttttgactctgccggccgaccatctgcctacgctgccgccgggcggccggctcgggactccaaaacaagcccttcgtcgtcgctgccgctcacctcggacatggcgatcgatcgcctgccgttaatactgctgattcgattgactaatcgtgcactaattaccgtcatttctactgcattttcgcacacaaattactactccatctagagggtttgaacctgcctgcagtaacggagttacggagaggagaaaattgcaggcttatgttatgtcagacccttcaacattaagcataaagcattatgtttctttttttttttcattctcattcagaaaccacgaacatgtctgtcagattcagaagtggattgctgcgcaccggctaaactagctaatcgaggaaacaacaaaaatccatcggaaacaacagaacaactcgaaactgtttttgacttttggcacatacatatctcggaaaaaaagaagaataagaaaatctctcgcatggatgatgatgatgtgtatcttccgttgaatactgcaaaaaatatactacaaacttcagtgtacgaaccagtatactgaatgaatccacgcgttgttccatgcacaaaagaagaagagattaagttgacaaagcagatagtgacggagactttactagctgcagctgccatccacccacagaacccacttgcattatccatctctgttgatgcgttcaccaaaccaatcccctgcgtccacgtgtacatcttagtgcatgatgtgtttaacccgatctcttgccatctcatactcctatacagtgcttgacaaaaattgcatacagaatagtactatttatttatttattttggaatgagtactattaaaaattacaaatactcttattaagaatccaaaaatggacgggccgaattggattagatacacttctcatctgtcactactctaaactgtcacgggccaaattaggtacgaaatccccgtgtgcggtcaaaattcggcctaaccactttgcaaatttcgttctagactttaaaaactcgaatgggcccaccaagatgggcctaaatggaataatagaagtttgtattgggccaaattggatccaaatttattttccacgatccaatttgcgagtctactatccctctaaaaaataaaaaagaaaaaaaagaaaatgcgagctacccatcaccacacgccacgtactcatggagcccttgagcagagttccccatccgaaacccaactccggcc

SEQ ID NO: 11679 - DNA, 1501 bp, Oryza sativa
tttcgtcggcagcccatgcgatcctatccttgtgtcgattggtgttgaataattcatctggagtagtatgcggagtcaaatcccgttttaaccagtcaacggtacaccaaccattcggaaaccgaaatggtgaaagctctgtcactattttgttctctattatccaatgcaggattatctttaattttttgtttgagatgtaacggttgcttgaaggaacgtatcaaaacaaagggcctcatcggttgccctatagtttataagccaaagccaaaatttaaattttaaaacttgattttgaatttgattttaatgttttttcaacatagtttttttcaactttggcttttcaatcactaagaacatacatacaaaagttttactcacatatcattttttaatcgctaataagccgttatggcttataataagatgcgggcaaccgatggggaccaaaggattggaatatctaagaaaatttcttatacacgccttatagagcattttgagattatcaaattcctatggattaatttcttaattcttatgccccaaatgacacttctccttttgtctctctacttcctctctcgtatccaccaaattcctgtgcatttttatatctccatgagatttggtagcgcgtgacattgtaacacgcgtgtttttgtaatttagagtatgaccaacaacttacttattctattctatatcctcagatttaaatcgcatccaacagaatcttccaataatccaggttcccaactccgggtattgcgagatgaaggaggagttggccacgcggtgcgcgcatagggatcagggtattgcgagatgaaggagaagctggccacgcggtgcgcgcataaggagcagcagaaaaaactaattttctctgttggtagttaaagggagggaggggttactgattagttttctcacttcctatattcattttagaagcttaaaaaaacatagctttgggatttgattattgtcaatctcttggtgatgctcttagaatattgcgttccaaaggagtactagattttctttaaaaggaatcacatagaacacaccacctatatatacctagccctaccatatttttaaactaagtaaaagtcactaagtttcaatttttcaaaattttcttcgaacttaaccataaacatcaaacttctacaccacaactattcttactgttgggcttggcccagccgcgccgaacactgtcgcaaaaccacgaagctgaagcctagttgggccggaaaggaatatccaagaagtgttggtccgaaacgtggcagcaagaaacattttggcccatttgagagcccacaagctatccggcccatcttctataagaacgaaacgatgataccatcgtgtcagtctcgactcgtcggctcgcctcctcccttcgccgtcgccgatctctctctccgcctcgcctcctccgccgcgcgccgcccgtacgacggcgccgccgcctccatgg

SEQ ID NO: 11680 - DNA, 1501 bp, Oryza sativa
tctccggcacgatgttctccagcgagttggcgcgccacggggggcactgccggcggtcgctccaccgcgccggccccgccgccgccgccgccgtcgcctccggcgcacgcgccatcacggcgccttcgccggggccgcccgccgtcccgagcaccgcgcacgccgccgccgccgcgacgcacgcccggcgcagctgctggaggtgaggcgcgccgccgcctctgctggcggcggccggagccggcgcaggcttgagctggcaggagaccaccatggttgccgacacgtctcgcagcagcagcacagcaattttgatgggaaaaaggccagttcgaagcgagatttatagcgtttttttttcctttttttttttgtttgggtgagcagaggagggtcagatcacggctgttgatctcgacgtggacgctggattttagtgctagcttagcaagcgcgcgcgtgttgctttgcttggcgtgtggaaccacctgtggcgtgtgaaaagttgcatatggcacgtcgggggcgtggggtggggcccgcgggcggtggttagatatttggcatacagtaaatagcgtaattagcagtttgcgagcttgcaactttgcaagggggaaattactcagtcacagcgacgagaggagatgcatgggaaacccgggaaattacttggctgctgctaaaatagtctgccttggacgggttccttcgtataccaaccggagcgagacatgtaccggactttctatttgcgccacgcttggcacttggactcttacggttaaacccagattcaatctaggccggaaataacatgtatattaaaaaatttataatagatataacgagagactggatttattctgagccgggaactaatttatttatgataggaataataaaacatccagattagttccacacttcttgacttattggattgatttctaatatcttattgtccctatcataagtaaattgattcccggtccagaataaattctgatctgttattgtatctacataaatttctttctttagttgtcattccggctcggattgaattcgggcgcaaccgaacaagtcctaattcgtttcaggagggtgagctgtacgagccaccaagtcgccaacaacctaggaagaactcgtatcgccattcgtcgcatgccaacttggaaatcgacgttttttttttctctctctctctgcagactacaattacctcaactcagtgtcaactctgctttcgtagatgggagttcccaacacggcggcacactggaagccaagggaaggcaattaggtaaaaacccctcgctggacacaatcacgcgcacaaactgttcgagggaattccgcgctgaaacaggcacagcttcgtcgcatgatattttaagtgagaaagctaatcaacggtgattctttgaggctagggagaccctgtttagatgagactaaaatttataagtcactatcacatcgaatatttagacac

SEQ ID NO: 11681 - DNA, 1501 bp, Oryza sativa
gtccaaacaagaatataatcccaaataaaaaaaattaaggtgcgcaattcattcaaaccatctcttttgttcttatagaacagtactaggactacatgcatgtgtgagttatgtacttgtatatactatacgtgcaatcccactaacctaaaacaattgctaattgtgacaagaggagtcattgcttaataaagttagcgatgcgacaaattatatttagccagtcaattgaggcacgaggcctaactatatacaaggctgcaattcatcaaggtatgattccatccctcatcatcatctagttgagcttaatttagtttgcatccgtccatacaagaatcaaaaaggattctccaactatacaaacacggtgatgacaattcaaagagaaaacaaggtagcggtatagcctacaaataaaaacaatactgagtagtttcaatgcccaatgatatgcaaaagttaatagctgaagttaggcaactgtcattgaactcaacgcaagtagaacgcgtgaggtacggtcggctggtttagctatatatctatatggttttagatagtcacctgaaattaattaaagaatgactcgacctacataaattaggcgtactgatgcatgaccggatcgatcatcccgaacacgtaatatatactctctaaatatttgatgtcattgacttttttaaatatgtttgatcattcgtcttattaaaaaaattaaataattattaattcttttcctatcatttgattcattgttaaatatatttatatgtatacatataattttacatatttcataaaagtttttgaataggacgaacgatcaaacatgtactaaaaatttgaactgtgttaaatatttcgaaacggagggattatagatatgcattcgatcaagctctctgaaaccacgagacctgctttattattatatatgttatttagtaacattactatatatatgttttttttagttagctaattacaggcagagagcaacaagggatggatgcagaggagcgaccggggcccatcttccacaatctatgtgatcacttgagcgcgagagaatcggcatcttcctctctgctttcaataacgcgatcacaaattgcatctccattatcttgagctcccttagggcttaagctcggaagctgctcttaaatacaagtccaggcccctagccatttccagcgccgtcgcagctgcagctagatagctatatatatatagcgtaatcgatcgatcggttaagcattatattcagagacatatatatatatatactccatgcatagctagctagctgagctgaatgatcgatccatggaatagatcagtagctagctatcattagatatatatacttacaatattattagcacacccctgcatccccggtccgatccgtaacagtagtagctagttaatttgattattgtccgtccgcggccggtcagtggtcgcaatcgatcgatcgatatcatggacg

SEQ ID NO: 11682 - DNA, 1501 bp, Oryza sativa
agaaatatttcatagcacaataaccatgtgacagaagaaggtaggactctgggtacaagactataaataccaaaaaaaaaactaactttaagcaggccaaacaaaataaggtttcccttatggaccctgtaggccaatcctgaaacaataggtaccagatcaactatgaaagaaggataagtaattatgagctgtacacaagctgtcaatttgtggctgagaacatttaactcattcaggtgattattgacccaaaaatctatctattaattccctctgggggaacaagaaacttttttaaagcaagttattgtgaatatattggtgattggaataactaatggttttacataataatagaagccagctttcctgccaaaagaaaagaaataagaaccagctaagaaaacattggcacaagtaggagtatggaaccattaattgtgttttgttgggtatacagcaaaatttggttgggaagaaaagaaagctaattaaagctaaatacacgtcattggtgtggcaggtaatgactacactccttttcatttgtatattgttatgacttacgagtatctgtaaagtagccacttgatgtaagcattttacttgattatcttaattctgtttcatgacttgaccagcttaaccataaggtagtaatctgccgatattttagaattatatatgtgctccgatggaggaaacactccagtttttaaaataatgaaaaacagagtcacctaaatttacaaaagtaatgttgggatccatgagagaaacactcaaaaaagtaaccaatgttactactatgatacagtttcaagaaaaataggaaaggaaaatggacatatttagatgtctgctcaggtaggatgcacataaggtttataggaagcaattttataacctaaccacatgttccatatctcataaacattaagcacaaagtacccatcctgcattttggtatgggtacaggcatgcaacaagtagttctgtttggcccaatatgtgctgtttaattactgaacttgtaaacattgaacagcatttgcattcatattaaataatacttcctccgtttcatattataaaactttctagcattgcccacattcatatatatgttaatgaatctagacatatatgtgtgcctagattcattaacatctatatgaatgtaggcaatgctagaaagtcttataacctgaaacggaggtagtataaaagtttaactattacatatgtgttcaaccatcaatgatatatgttccactcaggagttggaaatgagcatgaaaggggtagaacaactgggcttaaaataatgaaacttgtagtccactagggagaccaagatgaattaattatttgacaggctttggcaatcacagtactggggttatctttataaatagcagagaatgatgaactgaagatccatatcataaccagcaaggagcaagaataagaccaacaacagcatcaagaacaagga

SEQ ID NO: 11683 - DNA, 1375 bp, Oryza sativa
ccggatttaacagtttatgtgtcaagattgattgggtcaattttaagggagtaaaaatggacttattccgatgtacaatgcctcgcgcgattgcgattcgtgttggagggaggattcaagcccaacagaaagaaagaaagcccagtaggagcctataatacgtgaagacgtggtagctgtttgcaccgcacagtccacccactccctttactcagctgtaccactcgctgacacggactggagtacgaatttatttatttttttgttcataaattacgaaaaatatagagagaaaaataatggctcgaatgacgatcctagtacagccatactagaaatgacggttttgttttgccccgatccttttttaatttctttctttttttaatcgttacagttacaggtattaattctctctagtactacattggttgcatctaagaggaagtttaatagtataactagctactagctctaaatcacctagccaacgtaatagtcgatttataaaatagttgtttcatttactattaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttaatacctagtctcatctatcatacacacattacttttagagtccatattgcagctagctacagatctgtagtccgctgcttttctctttcttcttttatctatttaaaatatatttatagttggtttatagactgctattgtatctgctctgattgataagtactccgtgctccgttaatttaataaagggaaggcatggaaactgaaatggaggtgtgtcacgaggaggatagcggcgtgcgtgcgggtagctggtacctactccaagcaaaatccaaaatccaagcagaaaaaaagtcatacgcattcattgtgaaatggaccggcgcaactccccaaataaatgacgcgccttcgccacacatttgaccagaccagggagagatctgctgctgctgctctccaacca

SEQ ID NO: 11684 - DNA, 983 bp, Oryza sativa
cccatgcccaggaggaagccgagggcgaaggtggcgaacacggagaggcccacggaggcggcggcgagggggaggtttccgaggtggccgatgaacatggtggtcacggagctgatggcgtagttggtgatggtgccgatggcgatgggggtgccgatggcccacagccgctttgtctcatgccagaacatgcgcgccgccgccccggccgactccacggcggccgcgtcctcctccggcgctggtggtgacacggagcccatggttgattggttggagagcagcagcagcagatctctccctggtctggtcaaatgtgtggcgaaggcgcgtcatttatttggggagttgcgccggtccatttcacaatgaatgcgtatgactttttttctgcttggattttggattttgcttggagtaggtaccagctacccgcacgcacgccgctatcctcctcgtgacacacctccatttcagtttccatgccttccctttattaaattaacggagcacggagtacttatcaatcagagcagatacaatagcagtctataaaccaactataaatatattttaaatagataaaagaagaaagagaaaagcagcggactacagatctgtagctagctgcaatatggactctaaaagtaatgtgtgtatgatagatgagactaggtattaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctga

SEQ ID NO: 11685 - DNA, 439 bp, Oryza sativa
acccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacatattattctccattcattctcaacatatcgatcatcatttatttttcttcgtatgttgttgatttcagatggatcgtaga

SEQ ID NO: 11686 - DNA, 1501 bp, Oryza sativa
tttagaatgtcattaatttaattccaaactttaaaattaataattaagaactctttttagtataagccaatataccttcagtccaaaagaaaaagacaaccagattcatccccagaaattgattttttacaagacggaggaagtatattttttaaaagaaataatagatatatttagcatatttatagtgtagagtaaattgcacccacggtacatcaactttgtaggttggtgcaatttgatgcaagaacttgagaaatgagcgttctagtgcaataacttggcaggtaagtgcaattcaggacaagaactttataagtgatcgcataaatgtaacaacttgcaagatatgtacgattttgttacaataagttaagaagttatgcgacaacttaattatttggagcactttttaaatacatatttaatttttaagtatttattttgacaatatactagcgtgggtttgtatataagcatatttatatttttatcctaataactaataactgaaaatcaattaactggatgtagaaattattatatttcggtcgagatttgggaaggtacagaaaacaaaaattcttaaagataattggatgtaaattgaatgtgcagtataaatcttaaagattaaattcaatattgtaaagtaatatccgtaggactgctatgtaatggcatattgacatcgtgaaaaaaaaaactcacctagcatatgcttagctaagttgatgcatcaaaatactaatttgtcaagttcttgtactagaacgcgcctacttgtcaagttgttgcacttgaacgtttaattttcaagttattgcactatatcgcacccacccgccaaattgttgtaccgtggatataatttactctatagtgtaaataacaacagcctataacacactggtggtgaccgtttacaccaaaagttggcactatgggtagattttgacctcctaaatatcctgaaacttttgggttgggaaccaaaacttccatgaaagagagatctacctggaatttctgggtaaagttttgtttcatattggaagcattagaacaacaccaaaccattacttcctcagtttcatatattttctagcattgcctatattcatatagatgttaatgaatctatatatgtgtctagattcataaacatctatataaatgtgggcaatgctaaaaagtcttctaatatgaaagggagggagtactttttttttttataatccatatcccccttaacccttccaaccccaaattgatattggtatttcgtttgtgcgatgtaaaagggtgccgtaggccctgtcagccaacctatagcacatcgacacgcacttgccctgatgggttctctcctggaactttcactgtagtacttgcagaacctgatggcacgtattgttcttgtagtggcatatcttcgggtgccaccgcatgtatttactgtgtgctttgattggacacgttttcatgttaatattggcta

SEQ ID NO: 11687 - DNA, 1501 bp, Oryza sativa
attgaatgctctatgtgatggaaatgtgcatgacgtctatagtcctttctaagactctaagagtgagttacaaaccgcctttgctacctgtacgttgattgagttttagaaaaatcgtagttgattgatcaatcatcaatctgttgttgatctaagggctatagctctatcttgtacctcgagccaagagggagacatgataaggagagggatatgtcagagaggactcgcgacaacgtcctggtggagatgggcgggcggtgggtgggggtgagatcatgtggttaggttgcaagggtgatagatctagcagcgtgagccaccccgagatgaaggagaaaacacatatggatttgttgatgaagagggtgatggcagtgatgtggagggaaagaggacagggataggaaaggcttgtccagcctcgccggtgtcagcgctggcagtgcaaagaggaatgccatcacacgcgagtcaaagttgggacttagaacgttggtggcacaagagacgggatcaggagagggggaggctatgttaaaattagattgttacacaaataacaatgtaatctgagctatttaataaactatatataaaacatcaggcaactaatgaatggtcaagccgttatcaattattctggatggtaactccctgccttcgatgcaggacggagtgtagcgggggcccctgtccgaccatcccttgcgataagagtttttttctttctcagtaacttatatttcctgtatttgtgttttttgtttcttttttttccttgacccctagcaacggccctctgaccgtttgcgttgtgtaaccaaactctgttgtcttcttctaatatattgacgtgcaatcatttagcgcgttcgcgagaaaaaaatggtttggatggttaaatcttactagaaaccagaacaagataggctacgcaattagcaatggatggttggcattaggtcatctaaggtcaaaccgacggagatacatttgctgcataaatagcaactagcgtaatatgtgatgtgatgtacttcctacgtcttataataagtttattttttagctacttatatttgtctagaaataagttaatttttagaataattatttgtatcggagtttatgaaagtaaaaagtaattgtatttggagtacataaagtgaggaagtattgagatttgataaagtagaggtattttagtttttttttattggtacgtatgagattagtgaaaaataaatttatttgggaagggatgtagtacctagctactcttgtaccagctagattaagtataaaccaaaaacaacgggagtagtagtagtaagaatgtaaaacggttccaacataacgcaacaacggaacggttggatattcggttgggaggagaagggagattccgtttgagtaggttataaatagcaaggaatacatacgtacgttccaaatcatcacaaagcaagcaattaagctggcatgggcggcggcggcg

SEQ ID NO: 11688 - DNA, 1175 bp, Oryza sativa
aaaagaagagtctaagtagaaatacaatttaaaaatagctgaaattgaaagatgagtccatataagaacccgatacgagattaatcgaaattcagaataaaaacaaaataaaatccgaaattataaaagaaaagaagagtccaagtagaaatacaatttaaaaataattaaaattcggaattaaaaataaggtatattgatagaagaatccatataggaacccaacacgagattaattaatattcaaaataaaaataaaaaaaatccgaaattagcaaaaagaaaagaagagttcaagtaagaatacaatttaaaattaactaaaattcagaattaaaaataagcgatattgaaagaagaatccatataagaaactcaatacgagattaattaaaattttaaataaaaaataaaataatatccaaagttagaaaaattaaaagagagttcatgtaagaatacaattttgaaacaactgaaattcaaaagtaaaaaaaataaaaatattaaaagaaaactatacggtattaattaaaatatgaaaaaaataaattctgaaattagaaaaagaaaaaagatttcagttaggaatagtatttataaataactaaaattggtgataaaaaataaagactattgaaagaaaagaccatctaaaacacatgacgagataaattaagtaccaggcctataaaggagtagagtggtggcggttgatacgacatattaaaaggtggggcgacaggtaggccgtgaagcaaacataaaaagcggttgccgagacttctagaaagtaaaaaaaatagaccccattgataatcatatccgacttttaaaatctcaatgacaataaaaaggagaagcaacgggcggagtgtatagcagtatagttgcaaaaccgccgacggttggtgggactttaaaaaataaaaactgaattccaatgatagttatgtttgatttttagaatcccaatgacaataaagagtaggcagcggatgagtcgtagagaagtatagtggcatcgtttgacgggacttctaaaatttataagaaattaaacccaacaaaacaataaactctaaaaactaaaggtccaatttttaaaggtttggaacttctaaaaagcaaaaaaaaaataacaatgataatcatatttgattttaaaatgttaa

SEQ ID NO: 11689 - DNA, 356 bp, Oryza sativa
aggcggttggaggcgaggtcgaggagggagagggcgggggcgttgcgagggcgagggggatgggcccggagagggagttgtgggcgaggaagatggaggcgagggcggagaaagcggcgagttcgggagggaggtggccggcgagggcggaggccgggaggcggatggagaggaggaggaggaggtcgtccgggaccgggtggtgggcgaggcctgcagagaggttgccgcaggggagctcgcgggggagggtggcggcggtggaccagcggaggccgcgccactggcagagcggggtggaggcggtccaggtggccagctgcgcgttccctcctacttcgccctccccctgcagc

SEQ ID NO: 11690 - DNA, 1501 bp, Oryza sativa
atcacaatcgatcctagatacgcttataataaaatggagggagtacttcctttctccccaaacaaacaacgccattaacatttttacataaggctcgactattcatttctctactacttaaaaaataaaatgtgcttccatcgtccgtaaaaaaaaataggcgaaaaaaaacaagtttgtccgataaaaaaaaccgggcgaaaaaagtgcgaaaaaaaagaaaaaccaaatatgcccgatccagaaaaaaggggggaaaaaccggggaaaaaaaccaaaattgtccgatccaaaaaaaaaaccgggccaacaaaaacgtaaaaaaaaaagaaaaaacaaaatagcgataaaaaagtccgactcggtcccgtaaaaaaatagcgataaaaataaaaaaaagcccgactcctcgttgcgattccctctcagaaacaaaaaaaaagtccaactctagatccgagtcccactcctctcggtttgagtccgagatactaggcaccgcttctctcagtttcaatctatagcgtgatatttcatacatcttggtaaaaaaaaattgatatgccggattgaagatctgtttgcaaaaatggaacctacatgtcgagagcatttcatttttatatgattttaatttttgggtttgtacatttgcatttgagtccctgtaatttttatatttacatttgagtccctataatcttgcaataaggtgcttttggtcctttttttttgaaaaaaacaataaataaaagggatagaacaaaggcagaaaggtgcataaaaaggaaaagaaaagccacacaaaaaagaaaataaacaaaaaaacaacaacaacaaaagtctatttcccctaagtggtaaaaaaactatagatgcaaacggaaaaaaaatctaatttgtataaaaggcaaaaaaaagtggcgaaaaaaacgctatatccgattcctttaaaaacggaaaaaagtctgatccctgtaaaagcgaaaaaaatctgaaaaaaatctaaaaaagtttgtccgattccctaagaaagtggcaaaaaatagttcgtaaaaaataaaaagctggttcgtataaaataaaaaatgcacgcgagaaaaacaatgaaaagggcgaaacaaagtccaatttctaatcactataaatcgctctgaaaaaactgttagaaaaaagctaaattgatggacgcttgagtcggataggatccatcgattttttaccatctactacacggtttttatttcgtcatatattctcatgtattggaaaaaagcaaaaaataatattcagaaaaaacaggcaaaaaaaccacgcgataaagtaattgttagaaaaaataggcaaaaaacacgcgagaaaagcaaaacaaaaaaggggagaaaaatatggttttcgtcatcagtaaaaaaaaggaaaaaacatgctaggaaaaaattgttagaaataaatgcgctatttctgaaaaatagtttgagaaaatcgagcaagaaaaaacacc

SEQ ID NO: 11691 - DNA, 1501 bp, Oryza sativa
agggtttaaatctggacgaatactacattcatccacccatggtgtacgaacaaatgtacttcctggtgtcatcgtaattcttttgtgtcctacaacaaaaggtaattgatgtctcatacttttcctaggaccctgattacaagttgaaatactactagcatgttagttccatcgccgtacttgtacaacattaacacgcacatgcacgttgctccacggcattgaattttagggccacggttttgtgtgaagtcgatggatgtgtgttaggtacataatctgttccaaaaaatcacttgcccatgacattcattctgtccaaaatggaattactttcgtgtgctctgctctaagcaggacagtgtactggcacagctagtgcgctgctcaagttaggtggagaaggtggcattcatttcataatgtttcatccatcacctgcatggatgaaatctcacaaactccagagcatttcaaaacaattatacgaagttttcagagttcaaagattcagtgcaaacgattatctgaacttcccagagctcaaagattcagtgcaaacaattactccatctgaagtttccagagttcaaagactcagtgcaaacagttatctgaagttttcagagttcaaagattcagtgcaaacaattacttgcagtgtctcttgcaatttatgtgcatcttccaatgccaggattgctgggtgctttgatgcttcctctaccttggctttatgcaaagcaaggaggagaggcatcatcaggtgtaaaagtgctaaaaggaaaaaaaataaaagaatccaagaaaagaaggaaaagcactgaaagaaaaaagggcaatgttcaccacacttgctaacagtggtgctgaactaagggccatatgtgatatgtggtactcaccaagggaaaaaagttcatttggagagtaaagcatcatttaacactgccagattgttactgtgcaaaaatgtgcagcagtaccagcatatgtcctaacgtctaattactgcttcaggactggcttatcatcgaagtttcagttttgatcctaaagcaattggtggaacagtagatcagaagcaacattctgaagtaaaactaaggcctgtcaaactgatttcataactcctaattaatcagtagaattactaatcaaacttaaggcgtaaagcagcacattattctaagcctaacaagcaccaatcagagtgtgatcccaagaaagcagaggagcagggcactggtgtgtgtgtatatttcttttttctgaagactcaacagtgagaaaaagtgaacgctgggactgctagtccttggtcttttgcctgctccccgtttccagctgaatcgttggagacacacctgtccgttgatgcctgcagctacctcatgcttctgccagccacccgtgagtgatgtgcagcgcagggcaagccagcaattgtactagtacaagttacagtagaatcagaggatatatacttgcactaggcctc

SEQ ID NO: 11692 - DNA, 796 bp, Oryza sativa
cgatcgtatgatgattgatgaatgttgtgttgccacggggatcgagcatggccggcgttcgtggcgacgacgacgacccggcctaaaatgtcaaatcaagaacgagtctcacacaagcttggaacaacccgaacggaaatatttgtctcgtgccgtgcatctacgtagcccgatgattccaaggcaaacgaatcaacaaaatttggagccaatatgggcatgcgactatgaagtgccgccgttggcctgctcctgtttatgcttccgctgttccgcacacatgtacaagtccatttagagatagacctggccatgccattagtaactaatatatatattatgtactccctccgttttaggttataagacgttttgactttggtcaaaatcaagctgccttaagtttaaacaagtttataaaaaaatagtaatattttaaacctaagataaatttattataaaaatataatcaattattgattcgatgaaactaatttagtattataaatattactatatttgtatgtaaatttagtcaaacttaaaacagtttgactttaatcaaagttaaaacacattataacttaaaacgaagggagtactatattaatccaagtgattagtgtactaagcctctatccgtctataaatacatgcaaaagcctctgaacttgccaagccagtgaaactgagcacacaataatctgcagctcgagataagatttgccccctgcaaagtcatctctagctagcttggaacacataatctgcgatcgatcgatggcttccaagcaaa

SEQ ID NO: 11693 - DNA, 642 bp, Oryza sativa
tacagttgaagaaatcctggacccatcatagtcataggtatgaagtgcagcttgtttctttgttttccttgcatgcatgtccagtaattgttctgtttgctgctcctagattctgcaagttatatatatacgtatgtatatactaatgcatctggggataaagcgagcatacattttctgttggacactatacatgaatgtaggtgacatagaatgatttatatatccactgtccaacaagaaaagtgagttggtttatatatctactttccaagatgatagcaaaaatgcaattagagttttgcaaactttgtaatcagagaaacaaccaatcacatcctgtgtgattaccctttggtttgctttgcttggagtgtaattagggatatatgtggattagggatacccttgcagtataggcaacaaactcaatgtatacactatgtggattagggatatgtatgttaatataaaactaacagaggaaaaagctactgtgttgcagtatagacaacaaagctactgtgacaatataaaattagcagaggaatacattccctttcttactcttaatatacatcggccggctattcgccggcccggcgaaaaaaaaaattagcagaggaaaaagattagttagaa

SEQ ID NO: 11694 - DNA, 412 bp, Oryza sativa
ttaaaaatggagggagtatctattatatactaaaactctaaaagtccattaaatttacactaaaaatttttagtattttttagtacctctcaaatactacaaaatttatctttcaaaaagacatatttatagtaccaaagttatgacgtaccgttccttgttggaatccaaaatgcacagttgagagattcctgatctcagacagccaccacaccagctcaacaagaagggctcctgccaaagtgccaaaccctcagcgcggaagacaatgcaatcatagtccatacatcgacgagccgcggcacaaggccgaagagcaagcctcgggagacagataagctcgacgcgcgagaaccagcactgcacgatctggagcgccacgagccgcgaccgcggcgcgtcgatcctcagc

SEQ ID NO: 11695 - DNA, 1501 bp, Oryza sativa
aaggccaaaaccgagtgggccaaaaaggaaatgggctgaccattagccttttcgcacaggagaacccacacgcgaagtcaagagaggaatcgcacgggtagccgactcaagggctatgactgattcatcggctcatgtgccattcactcgacaacaacatggactcaagggctctctggcaccgattcctcggttatgtgcccatccactcaacagcaacatggcttctatccagaaggctttgtttggttgctcggcaacaatcattctccctccgcatccattctagtcattcccctattagtcatcactactggataaaccatctttgttgggtggacaaaaaacataatagtcccggtttgaatagaaaccggaactaaatatgattttttttatctcggtttaaaactctgtcggccctaggtgatctttagtcctaggtgatcctattcctcctctctcttacactctccttcctatttctgaccgagactgtcagggggccaagcatttttaggattgaaaattaatctttagtcccagtgggtaaaaaaaccatacacagtatataatccctaggacttatcctcccaaattgctcatcttcccattcctctcctttatccttatcctctccttcctattcctcctctctcttatcctctccttcctattcctcctctatcgacgagagcagatcgagcgaggccagcggagggtggtggatggcggattttttttttgagaatttatgattcggatcttagatgtatttgatttgtgtgtgatgtaaatatgtgatgtatttgtgatgattttcttagaacttgtgatgtattttttttagaatttgtgatgtatttggagacgatcgatttgaggatttgaagatatccttttgttctctgatctgtgatgatcgatttgggatttcacgatctggggatgattcggggatggagtgaaatcaatattcaatgtttaaaacaatgggaaaaaaaagaaaaaagaactagcaaccggacctgacctgggtccatctttagtcccggttggtataatttttaatcccggttatttcacccgggactaaagatggggcatctttagtcccggattcgtgattccggttgcataaccgggactatagggggttatcaacggggaccgatgcccttttctccagcggtgcatctcaaatggattagtagttaagaaaaagtacgaattaacccccctccccccgaactaccgcgatcaaccgaattattcccctaaacccgaaaaagacatcgttcgcccctaaactttcaataccaaacaaattacccccctcgaccgaataaccgggactataggagtttatcaaccgggaccgatgcccctttctccagcaatgcatctcaaatggattagtggttaagaaaaagtacgaattaacccccctccccctgaactatcgcgatcgactgaattacccccctaaacccaaaaaaga

SEQ ID NO: 11696 - DNA, 1501 bp, Oryza sativa
ttatttttgttataacttgtaaatggtatgttcggctgccggggctacggctgcggcacgaactcaccgtgcgcagccacagccgttgcagccggcctgccgaacacttccaaagttgaattcgatcatgcttttgtgaagtgatatattatatattaatttattttattattttttaaaaaacttctatagctatttaattagttgacgtacgagaaacaggtgaaatccaatgagtgtttaaaaaagtttccccatagctatcgatgacgatgaccgccgcatagtgacatgggattggtttcttggagataaggagatgtgtagacgtatagccacgtcgtgcaagatgtccttatatgtatatataaatagaagtcatataggagtatcttagaatataagcatttttagcacggtgacaaatcaaatatttttaatttaaccattaatagagaaaagatcaattatgtaaaattgatgttactagttttatcattaaataaactatcataatatgcaactctttttatttaaaatatcttacttttataaatattattgatcaaagtagcatctcgtaaaccgtgtcagggtccaaaaatacttatatgggatagagggagtatataacttttgatagaaaattatccctaaaattatttaaatgtaactttatgtaattattttataattaaattacaatttaaatataattataaatgtaactcaagtgtatttcgtatgtaacttcaagtatatataagtcgtgtgcaataactacataacctagctatggtgtatttcctctgtttcacgatgtaagtcattttagcattttccatatttatattggtattaatgaatctagatagatatatatgtctaaattcattaatatcactataaatatgaaaaatgctaaaatgacttacgttgtgaaacggagagagcatgtaacttttagtggaagaaacaagcttgttcgattataaggtatcaagatcaagatcaatccactatctgtgcatgcgattttggtttcactgtgaaactttcacacatatatccaactgtttttcccatgcacacaaccgcacagatccaacagtaaaataaaaactgcttttcccaagcccacatcccatcgtaagcacagatccaacagtaaaagaatcttattgatacggccacgaaaaatctgtcgacaacgcattagtaaagttaagtgtaaaaccgatatagtaggaacattctccctccgtcccaaaatataagtattttttactctgatatagtctctgagatgttactttgaccaacaatatctataaaagtaagttgtttaaataaaaagagttgtatgttatgatagtttgtttaatgataaatctaataccattaatttacatgattgatttttttttgctattagtggtcaaatttaaaaatgtttgacttgtcactatgctaaaaatgcttatattttggaacggcgtga

SEQ ID NO: 11697 - DNA, 1501 bp, Oryza sativa
ttggccacaattcgattatctcggttaatttggttaaccgagcccaatgaccgaaatacccgaaataaatttggtcttttgatggctgagaccaaactactaatcgaatttctcggcctcggtcttttcggttcgattcttcggttcggtctaattatgcccacctctaggtgaagctggagctgcgtcaaacagactctacatcacttgccctggtttagtttactctctccggtgactgctgcgtgttggtggcatgcagcgagcaatggccgcgtttattttagcaggggatgagcaatgtgggtggcatgcagagagcaagattggtgaggatgagacgcgagaggagcagcgacttctccggtgacgacgacaaccacgtgagggccgggctggccgcttgctagtcgccctaacatgtggtcgaggtgcgatattattgttactcctatactgtacggtctagcaccgatttattcgtcgtaatcaacagtcaacactcaacactatcagggtgctactaatgatttttccggaagtgtttacatatgtactcacgccgttccaaaatataagcatttttagcatagtgacaagtcaaacatttttaaatttgaccactaatagcaaaaaaaaatcaatcatgtaaattaatggtattagatttatcattaaacaaactatcataacatacaactctttttatttaaacaacttacttttatagatattgttggtcaaagtaacatctcagagactatatcagagtaaaaaatacttatattttgggacggagggagaatgttcctactatatcggttttacacttaactttactaatgcgttgtcgacagatttttcgtggccgtatcaataagattcttttactgttggatctgtgcttacgatgggatgtgggcttgggaaaagcagtttttattttactgttggatctgtgcggttgtgtgcatgggaaaaacagttggatatatgtgtgaaagtttcacagtgaaaccaaaatcgcatgcacagatagtggattgatcttgatcttgataccttataatcgaacaagcttgtttcttccactaaaagttacatgctctctccgtttcacaacgtaagtcattttagcatttttcatatttatagtgatattaatgaatttagacatatatatctatctagattcattaataccaatataaatatggaaaatgctaaaatgacttacatcgtgaaacagaggaaatacaccatagctaggttatgtagttattgcacacgacttatatatacttgaagttacatacgaaatacacttgagttacatttataattatatttaaattgtaatttaattataaaataattacataaagttacatttaaataattttagggataattttctatcaaaagttatatactccctctatcccatataagtatttttggaccctgacacggtttacgagatgctactttgatcaataat

SEQ ID NO: 11698 - DNA, 1501 bp, Oryza sativa
ttataattatatttaaattgtaatttaattataaaataattacataaagttacatttaaataattttagggataattttctatcaaaagttatatactccctctatcccatataagtatttttggaccctgacacggtttacgagatgctactttgatcaataatatttataaaagtaagatattttaaataaaaagagttgcatattatgatagtttatttaatgataaaactagtaacatcaattttacataattgatcttttctctattaatggttaaattaaaaatatttgatttgtcaccgtgctaaaaatgcttatattctaagatactcctatatgacttctatttatatatacatataaggacatcttgcacgacgtggctatacgtctacacatctccttatctccaagaaaccaatcccatgtcactatgcggcggtcatcgtcatcgatagctatggggaaacttttttaaacactcattggatttcacctgtttctcgtacgtcaactaattaaatagctatagaagttttttaaaaaataataaaataaattaatatataatatatcacttcacaaaagcatgatcgaattcaactttggaagtgttcggcaggccggctgcaacggctgtggctgcgcacggtgagttcgtgccgcagccgtagccccggcagccgaacataccatttacaagttataacaaaaataataaatttaactatgaatatatatatactagttaaagtttaatttataacttgtagaaggcaaatttaaatttacatatttgtaaagtgatatattatatattaatttacatgcttgtatatcttatacgtttgggaattggcttgtgggtgttaggaaaaagaatcaaaaaacttattcttgttgaagcttccgctgtatgttgggctctttggcttagtagaaatgacatggttttttataaaacaccatcaaaatcctatttgtaggtgcttttcagggcaacgtattggcttcggggatgagctcaattacaaaggcatgatgaagatatgaaactaataaatgataaatgtcgtaaactttgagacgacaattatgcatctatttgccaacttcggatggagattctctaatagaatttagtagttagggattgttttcttctattggtgtctattagtttgtgtttgcttagttttgtttctgctatcgtgaattttctgtgtgagttttgtaataattggatgtagctttttaagtaaataccaagatgttacatttcattattaaaaaaatattatatattaatttatcttattattttctttaaaaatatttataatcatttagtttgtatgtaagaaacggatagatattccccgagagaatactcccttcgtactcgtaaaggaagtcgtttaggacagcaacacggtctccaaaatataactttgaccttttgtttctataaaaatatttattaaaaagtgatatatg

SEQ ID NO: 11699 - DNA, 244 bp, Oryza sativa
  unsure (1)..(244): unsure at all n locations
ccatccgtccagcttggcgtgcctgccgcgnaggcggaagcagtggagggagaagcggcgggcggggccagggtgttcggcgagaatcttgaaggcaagggcgacgcgcttccgttcctggccgaagagatcgtaaacatcgaggttgaggggcgcgagcgccacagggggcgccaccggcgggagacgagctgcgtgcgggcgccatacttggtggggaggagcgagatgatttcgccgagga

SEQ ID NO: 11700 - DNA, 1501 bp, Oryza sativa
atgctgcaaatggcataggtatgggaattgaacatattatattggtcacgctttgattcatacccctgatcgtacattacatcttaaaaatattcttcatgttacccaagccaaaatgaatcttatttatgcttctcgtctagctgaagataatcatgcttttcttgagattcaccctaaatattttttgttaaggattgggtcacgaagaacacaattcttaaagggtggcatcaaaggggcctctgatgacgctctctctcgtggcccgatcttctggtgaggggataactctcgctttgatcgagtgcgacgtttgtgacgtggctaccaattagaacatgtccagaatgccgtgcaatcgctaaaccacaaacgatgttgtaccaaccgtggcgcgcggttgatgatccctgcaatgcaaatgagagaacactgcaagaacaagataagatgcaatctaaatattgcgaataggtaattaagcacaaagaaatggttgcgattgaagtggtagatccaatcgacccgtcaaatcaacacaccgaatattgggggctctgaatctatagtcgccgactagtagagcgaggactagagacaaggtgaatagcacttagcaaaattcaactaaacaaaaccccattgtttttcaggatgtacaaagctatttatagagaaaaataaagctagggttaagtactaattcgtggaggtggagggagaaacttccgagatgggcctagtctattacaaggtccaaggcccaagttcggtttcagcaacaacactgttttgttttggtgattcttgttgactcgagatgaatttggacatcagaccagatgcatttgaaaggtagcgagataagctttccatgaagtccaagatcacccaaatcggagttggcatgaaggcactaggtccgtttgaagtcagtgttgtctccggaggccgaactggacttggacttggaattataattggaaagtgtgaagttatgtgcgtatccgatgaaatgatgtcctcatcatcctccccttcttgaattggagtcgtcctcaactcaatcccatcttcttgaccgtgttcactctgtcgtccaggggtcatccttggaggtatctcatcgtgaaaaacaccctcatattcctgcaaaaagttagtaatagcgggtagcaaagaatataaagtactaggagtagtaaccaatgtgggtatatgatctttgcaaaaaagagcatagtaacaagaatctggctcatctagagcgaaaatattatatttagaagctagcaaaacacccttcaacttaatttcattctttgaggcacttggttctattttactaggtgaagcaagattcttagtaataatctgattttcactgttagatttcttttcacattcaagtcttgcaaggtcatctttcaaagcagcggctgtcagggttacggataaggtataccctctacccttggatatacgtcatatatcgata

SEQ ID NO: 11701 - DNA, 259 bp, Oryza sativa
ttgaggcttagggtcacggattagatttcaatcacttttgagggtcaccaagtctattttatgtctctcttctttgggctgtgatatataaatagctaaataagtctatttaaggtccctattctttggacatcgacatctctaatactaccaattgcagggttcaggatcaagtttttcattgggccacatgccaacttataaatttcgttagggcccatctgaaaatctgccacgtgtccccttctctgattctagg

SEQ ID NO: 11702 - DNA, 1501 bp, Oryza sativa
  unsure (1)..(1501): unsure at all n locations
cgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttcccaccaaaaaaaatttaaanaaaaaatttaaatcgccatgttttactaattacatgggatccgggtattacctatctgctcgcttgtgccatgtttacatgatatcagttctttgtcnnccttgggtaaagaaaacactagctcatgttacttatgtgacctagctagaactatatgcttagccatgcttaattaccactagctcagttgatgggataattgcagtattagaccctttagtatcagagtgagctgcgtgctcgagacacccggccatgcttcatggtcgtaattatccaactaaaatgcaactgaatagtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaaagggtgggcgtgatgggagcgggggcggggccccttgcgacggcctctgtcgcttcggatttcaccttaggcacgagaagggactgcccgttgcccgctggggacggggggtgaaaacctgaggtgtggtgtgcttggttagagggggttatgcgaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaccagttttactgttttgctcaataaaatgttttacacccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagat

SEQ ID NO: 11703 - DNA, 1501 bp, Oryza sativa
gagaagcgcccgcgctgcctgcctcgtggtcaggatccggtgcatctgctggagcgtctgctacctcagcagatcagcctacacaaaaaaaaatcatcgcatcacgccatggtaataagcaatttagttcgccattgatgtttgaccgaagcttgaggaagttctccagcgtggtgagcatggccatggcgatggctatctgtcccatgtagttggtgacgttgtcggcgcctatgccgccgacgaccacggtggcggccgccgatgccaatgtgtctcccagcgtctgctgcagagcctccatcccctgcgacagcgcgtcctcgacctgctgcgaggactgctgtaggttgcagatgcccataaacaactgatccgtcagtggctcaagatggctctcaagaacctgcacaaacaacatcatcatcatcatcattcaacaatagcagtcaatggtagcttcagattctttgcttgttactgaattgagtgggtgatcactcgtgtcaaaccttgaggagctcagaggaacagaagccgccgagccacatgaagaagcgctcagcgtggctcatccacaagccggagaggacatggaacacgtcggactaggtggcgaagctcttgaggcggaacacctggtcgtagtgcatcatcacggcgtcgacaagcacgcggagctcgtcctcgctcatcagtgcgttcacgctgccgtcgccgttgacgatgtcatcggggtacacgcgggcggcggcgagctacccgcgcgtctgcggcgagaagcgcggtctcctcatcggcatcagctacgccatcacaaggcaccagcggcagcctcaccatctccagcagcggctgcggcgacatccagatcaataagaccatcgtcactgccgctctagctcccggcggcggttgctccgaccacacatggtccttggccggccgcgccgccgccacgttcgagcccgccccctctgcagcttggtgtgttgccgacgccctcctcctctcccgcgctcgccccgccggctgccctacccaaggaagagagagagaggaggaagggggagaagaggggaaagagaactggaggccaggggagaccggaggcgcatgcgcgaccggtggcatgcagcggagaagagcggcggcttgctcgctccgtcggaccacctcacccgcctcgcccggcgacctcctccccacccaccactaccagccagcctgcccaagaggagaaaagtgagagagacagagagagagagggggggaggaggaggaagggagaggaggggaaagagggagggtgataacgtggcatcctgacatgtggggtctacgtgggtcccacgctgatttggccaccacgtcagacaaaaccacggtgaaaaccactgagggacctaatgcaaacatttttgtaggttgagggatgtcatatatctggtttgtgattgggggacgttttgtaactcgacgacaaattgagggacgttcg

SEQ ID NO: 11704 - DNA, 1501 bp, Oryza sativa; identical to SEQ ID NO: 1249

SEQ ID NO: 11705 - DNA, 1501 bp, Oryza sativa
ttgtaacttgactagttgagctttatatatgggttcagctggatattagatataagtgcttagccatgcttggaaacattagcacactattgggataacttatgcttcactattatttaatgatggcttaataatagctcatgatggttaatcatgattgattaataaattaacttgccaactaaaacctgataatggtgggttgtgagcatatggttttgatggttgtgctcatgacaattaaggaccggttcacgattttcggctgtgaaacattaaccgtgccaaccacaagctagcgtgggcaacagctttactttccgtatagtatggttcatagtagagcaccagactatgaagtggcggagataagcccacgggggtcgctgtggagtccataccttgtttataagggggtgattatgatgcgggaacggtgcactgctttgaattgtattatatagagggtattgtcacaatctctattcgggtacttgtcaagtatcgcgacgcatggttgacatgatgttgaggttgtgtcttgtgggtacagtggtacacctctggccagagtttaatctattcgaataaccatgcccgcggtaatgggcgggtctaacaatgtctttcgtgattagtctcacacttctcaccctattaaatgatgatgttaataacttgtttagctcctggtttggagatagaactgtgcagccgggattggttgttcagaatggttgggcctatgcaacagggtatgttgtatagcgttggattaatattgtttaattgttatttaactgttttattaaattctgaaatatttgttaaatgctatttatgcaaatgatattatactatgccatcctttgttatcctgtgcaatttcatatttgctgcgtggcttggtgagtatgtcgtatactcaccttgcaatcattcatcagagaaggagttctacaatgatgctgatggagtggatgattaggcgtagccctggtcaagctgcctgtggagaggagtcgcctgcgctgtttcttttaattttccgctgcttagaactttattgattgagatgaactatctacctctgtaatgacattttattcgcttattaattagagtaataattgtactctattatcaatttgttattgtgtgcctcggctgattcctggacgagggtttacacacatgtaagcgtttggaattttggatagaaattccgggcgtgactgagatgcccgccggaaatttctgggtctgttacgcgcggcggttttttggacttcagttcaaattcgctcgtgaccgttgggcttcaaatggtgttctcgactatgtcttgtctttacggtcctcgcactgggaacgacaacagtctcgacgctagaagttgtgaatggttacacgagctcattttaagcagaagtcgggggctactgtcagggttacgggttaggcataccctttacccttcgatatacgtcacatatcggta

SEQ ID NO: 11706 - DNA, 1501 bp, Oryza sativa
atatgaaattgcacaggataacaaaggatggcatagtataatatcatttgcataaatagcatttaacaaatatttcagaatttaataaaacagttaaataacaattaaacaatattaatccaacgctatacaacataccctgttgcataggcccaaccattctgaacaaccaatcccggctgcacagttctatctccaaaccaggagctaaacaagttattaacatcatcatttaatagggtgagaagtgtgagactaatcacgaaagacattgttagacccgcccattaccgcgggcatggttattcgaatagattaaactctggccagaggtgtaccactgtacccacaagacacaacctcaacatcatgtcaaccatgcgtcgcgatacttgacaagtacccgaatagagattgtgacaataccctctatataatacaattcaaagcagtgcaccgttcccgcatcataatcacccccttataaacaaggtatggactccacagcgacccccgtgggcttatctccgccacttcatagtctggtgctctactatgaaccatactatacggaaagtaaagctgttgcccacgctagcttgtggttggcacggttaatgtttcacagccgaaaatcgtgaaccggtccttaattgtcatgagcacaaccatcaaaaccatatgctcacaacccaccattatcaggttttagttggcaagttaatttattaatcaatcatgattaaccatcatgagctattattaagccatcattaaataatagtgaagcataagttatcccaatagtgtgctaatgtttccaagcatggctaagcacttatatctaatatccagctgaacccatatataaagctcaactagtcaagttacaataacccaaggtatcaaggaataaagtactgaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaattcctcaaattcttttcctgcaaattcggactctccgagaacgtcggaatctaaagagaaaagaacaaaatcaccaaaacagcacataaacaagcatgaacagtacatgtggatatttttaacatgtagatctcaattttagaaaaatttagagacctgaaccaactaaatccgagctaagatgaattagttatgaattttcaaagattaaatcggattaaatcatttatatagattttaatggaattatgacgcaataatgaattatttttgaaaaggaaaagaggattattgcgtcagcggctagggttcacggtggaccgggtgcacggcggcggctcacgaacggccgagatctaaccctatccaatcggacggccgagatctaatgggtctaccgcggctcacgggaagcgacgacaa

SEQ ID NO: 11707 - DNA, 446 bp, Oryza sativa
tttcaaattttaaatttgaaaactttcaacccaaatttgaaaactttcaaccaaaatttgaaaactttcaagtcaatatttgactgttaagttaaaataaaaaaactttcaattctacattttgtaaagaagtgtgagaaagattaaaaaaaatgggaaagaaacggcggaaaaaaaacgtgtctaaggtcagaaaaaaaaagtacgaaaaggagaaaaaaagagctcggggaggggatagccggcatgcgcgccagctaaattgatttagctggcgcgtacacgcccattagccatccccggtagccatttgcactatatccataatatacaagtaggcagccattcgcaccttatccataccaggacgatccatttgcaccttatccacattatcacataatgcttctgcctataaatagtagcagcaccttacattcaagaat

SEQ ID NO: 11708 - DNA, 154 bp, Oryza sativa
cctttttccttttggaatcatcagctaattcgctttggaaatcatcggatttgagctcgattcagattcccctttcctcccgaaccctaaaactttgcatcgcgtcgccggccgccgtgggccttcgccaccgccccctagcccctataaaagg

SEQ ID NO: 11709 - DNA, 1501 bp, Oryza sativa
tgaggggaaatattcctcttatcctcctctatctttaccctcaaaaatcggagctaaccgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgttgcccctctcccgtgcctcgtagcgccgccgccacgtgctccaccccgccgtcgtcgccggccgagctccatccgcgtcgtgccgtcgcctccgtcgtcgccgccagtcgccgtcaccgccgtaaggtgcgccgaggtgtggagaagcccggccgccggagccccgaagccgccgatcgccggagccccgaagccgtcgaccgaagccgcgccgccgctagacctcgtcgccggccgtcatcgttcgtcgtttggttcgagggtgagtaccgttgggttcgtctcgtcgtcctctacgtgtaaatgtcctccaaagtcgcagccgaccatccaatctccggcgaggtcgtcatcttggttcggccgccattgatgaggtcatcatgacgtcatcatcgtttttctttttcctgtttttctaatagattaaatcttcagaaattcataactaaatcatcgtaactcggttttgagtggttcaagttgctaaattcatctaaaattatgatctacatgtttgtttactttttatgtattgtttatttggtttttattagtctttttcttcgttttgcgtgaaagttagtcgtttccgtcgttgcgaaggttcgcgagtacgccggaagtattcaagaagattaattgaagaccgattattgcaaggcaagtcacacagatcccaaacaaccctttgagcatgttgaacccgtttaaagctattattttatttcaactatgcattatttttgaatgtcatcgggtggtgaacctttccccattaattaatggccgaagatgatcttattttcctatgggttataattcgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggt

SEQ ID NO: 11710 - DNA, 1501 bp, Oryza sativa
cttcgattggcaaacagggattagccttctcggcgaggtcatccgtattttgacacgggtgataacctgaggagacgtggtgctgcgattgcggggctcaagaacgtgcgcgttcaagaagccggatcgatttgtgtcgcgactccgcccaaatcgttgtttatcagaacctttcggaagatcgggaaccctagtgcacatcaagtggtatcagagctctaggttcaccgtcaggttcgctcagtttctttgcccttgattagttttttttttcgcaattatcctagagtctacagaaaagccaaaaaaaaattagttgttagttaccttaacctagaccgtgtttagcctttgcatgattctctctcagagtccgtagtgttgagtttgagtcctagtttaagttcatgttgctggtctagtgtgtgttttagtctagtcatgtgtttgtcctttgtaaccctagccgctacctttcaccgtgtgttaggcttcatcctttgagagccgtttccgccatcataaacacccatccagataaccaagcatctccagaacaccctacaactccgctgccaccatatcccaattccaccgcaaaatagactaggttatatcccctctggaaaacctagccggaagccgaaacttcaaacagccataacttttgcatacggactcggaatcaggaaaaatttaacttttcggataagagaaaaaattttatatccgtttatccccgcctttggctggtttggcgaatccaaaattccaaaaattggcttgcaaaattgtctgttcgagctcacaagttcctgcaccttgtttatagtggtttcagaaaaatccataggccacatacctactccaattgagctttaacttggaggtgtgcctatttttgtgttctaaaaaaagaaaaaaaatatcaaaaaaataaaagaaaaaaaagaaaagttgatttccactagtgctttgagctcacgacgcgctccgttgagcttatctgccagttcggttttgtagtttttgctgaaactcgctgaagcttgcctgtcagtccttctttgctgtttactagtgtcatattctttgagccatctttgttatcactactgtctaggacacgagtagaccagcaactaagggcaagtgacttgggatttttattcagcattactatctgtcattggattgtgtaccactcataaacatatttttggccttcctagctccacatattacttctgaacagcacaggttcttgatcactgcaattgctgactacgccttccaggtatcctttgctttgctggtaagaaccttataagaccatggttaggaactccatattgctgagaatcgttgagaggcaccactacacctgcgtagtagattattagggataaccttcaccgttttgtttctgttttggtgtttcaatgtcaggtaacgaaggcgagaagagtccccaggattttgctgactgtgtcagccaaga

SEQ ID NO: 11711 - DNA, 975 bp, Oryza sativa
cagtcgaagtcagctaaaggttcaaccagggacaagtcaggtgaggagaagattccatctgcaacaagggatcgagacaagcagcctagagtggagaagtttttctaggcaagtttgttataaaagatgcgacggaagaagtcagacaagaagagaagaccgcccaacctatcttcatgctagcctcctcgaatctcggggacgagattcttgtaaggggggtggatttgtcacgtcctgataaattcatcccgaaataaaaatcattttcgaaaaggaataatagaattaattaaaattcagaaagaaattggcaaacactaaaatacgtacaagaaaaattcgaatgtggcccggagaatttttgttaaattctccttggtcaaaaaggagccctcaaattttacttgaattttcagagcaccgaaaataattattaagcaacaaaaacaataatcaaagtttattaaaaagaaaaacctaaaaataaatcctcttcctcctttgggccaagcccagcccaaagtctccctctcctccctctctttctctccctctccttctctccctcctcctcttgggcctcctcccctcccggcccactccctcctccctctctctcccgggctccctcgccctcctctcctcccgggccgcctctcggcccaagccgttccgccccctcccacctgggccgcctccgggcccaacccgagcggcgccccccctgcctgagccagccgcgtgcgcatgcgcgccgcacgcgcgctgacgccgcgcgcccgcgtgaggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttgga

SEQ ID NO: 11712 - DNA, 1501 bp, Oryza sativa
aaatgtttccactgaaatttaaacccaactgaaaaaaactttgccttttcagtttcttggtgaatcttttgtatgtgtttcatcaaattcgtaaaaaaaaactattttctatatttggggtcataattatgtccagtttgattttatcacaattctttttagattatgtttacaaagtagaaagcataagtacgtatgacatataagtcattttgaaaaaatctaacagtcaactaatagaatagatataaaggagataaaaaaaacgcaaggacatgtaaagataagataaaattcatgaatatagaagggattctttgagcaatttgtttctatattctttgtgcaagttccatttaaccatcattttcaccatagcatacatatgtgtctgtgctaatgatttaattattgttttgacgttgtaattaattaattaatatttaataggccggagcaatggtgacatgttgggagagaagatcaacataccacctgggccgctatgtgcaaagcgaccagacctctgcaagaactgctggtgttgtgaggtcagcgacgggcaatgctaccagagtctcgaggcctgccaggtcaactgcccattaccatcgccaccggccatttgatcagatctcgatcgatgcatcatatcgtttgtgtgataataagctgatcaatcaaccaataaagaaggcattaattaagtatcgtactctgttcgttttggaaataaaatgctgatgccatcaatggatgcatcatgcatgcatgaattaatgttctggaaaatatgtgataatcacatgtcgtgaaaacttgaaaacaaccttggataaaataaaaggacacctgatatttatccacgttatttagagtaaaaattttacttgcggatttaatcatgagtaaaaattttactattgatgacgtggataaatctcatacgttcatttttaaatccaacggtagctttcaggtttgtacgtgatatattttccttcttaataacgtttatagtgccagatatgggacaattgatcttttgtccatattttaaagtctaactataactatacacatttgaccctacatttttaactttgcttatttgatcttattttttttaaatcgaagttgttatttggccctattgtataggaatagatttagaagaaaataaaaaatgaatttagagagggaagaagacttaactgccccctgtgatttaccaaagcacatacgcgcggctagagttacatgggcgcggaggagaccaatctcatgagcacagagccaatctcggtcagcaaccaaattgtacacattctgatatgcaatacttatattattatagtctttagacttatctttgtcggctttagtttctgcttgttccttggatttacattcttcggaagtttcaataacggatccaccaatatctgatttagacagattattgtgtgctttggtgaagaattagtacttaactggcccc

SEQ ID NO: 11713 - DNA, 345 bp, Oryza sativa
cgagcgaaagccctgtctcggttctctttgagaccttgacggatgggggcggcggtgttttccatcgcttctcttcttgaaaacgtcgtttagacatcccctagcggaaacccccaagcaattgatgcaagctcgctctagatttcatcctcttatggcggcgtcctagacactataagttggtcacatcagagggcctaaggggagaagtgtttcattcttctctctcaccctctctctctaacttctgaagacttggatagagcggggtttgtgttgattgtaagggttgggttttgggcgatctcggctgtgttttgttgttggcctagcggcggtcggtca

SEQ ID NO: 11714 - DNA, 171 bp, Oryza sativa
attcctgcacgccctatatgtatatatatatatatgtatatatatgtacgtacatttactttagtgttaatatatattttggtaatatatatgtacataaaatgttaaatgttaagtgctttaaattataaatatgtgtgtaatatatgtatttatacatatatacatacg

SEQ ID NO: 11715 - DNA, 1501 bp, Oryza sativa
gcctctatctctcccttggattcgctcggatttactcccgcaatcctcgccggcgcaatcaatggcggccgagatttccgcggccgattccttcctctccggccgccctctctccctcccgacgctatataaacgttccccgtgcttccctcctccgtttccgacactcgccgctcactctccccgtcggattcgtgcccgcgccgtcttcctctctctccgccgtcgccgccgagctccggttcgccgccgtcgtcgccccggacctcctcccgactcggcatcgcttgcttcggcatcgccgtgtcctcgtcgatctcgtccactcctccgtttcggccgccgactgccggagcgccgccgtcctcgtcgacccgaaccgcgccgccacctctttccactccggtcgccgttttcgtcgtcatcgtcgacccggggtgagccgaggaccgttgtttcacttcccccttccctcccctctctcggccgccgctccgtcgcgccggaggtcgccgccggcgaccatcggggcgcgggcgcgccgcctcccgtcgaccgtgccggcgaggccgccttcgggcgcgccccgcggctgccaggtggggcccggccgtcagccgcccgcgccctcgggtgcggctgacacgtgggacccacggcgccggccggcgtcaggccgcgtgcgcccggtccaccgtggaccgtgaggctgccgcgtgggccccggtccgcgcgccccctccccctcggctgacgcaataaatcctttttaaattaaaatttaaatgaagaaattcgcaaatattcatttaaagagcatataaacttcaaatggccataacttggccatttcaactcggaattggaccgttcaagtctctaatttttccttaagaagtcaagaacccatttttgtgctttgttcctgcttgttatatggagtttattagagtaaaagccttttcttttccgttggtcgtggagacgctgcagcttcggaagatccgctcttcgtggaggttaaagccgacgtttgggaaagcgagcaaggcaagtcacatcatccttgaacatattggatcccattttacaaaattcttttgatttaaattattgcattatcgctttacttaaattcccgcgttatcactgttttatttagccatgcctatttacctttgttatgaccttattattattgtcattgatattattaccttgttcaccctagattaaacaaaaccccaactagtggacactctactcatggtaccactagtatgaatttaggtagatgcttcactgattaattaggcaacattagggggttttataactctagactttgggatattcatatcacctggacactatggaatggttggattattgtggaattggattcacacctccccctctattcaaaatcctcaaaatggttttcggacgggctcggggtgcattgttttgatagtagcacctcggccatataaggaccggt

SEQ ID NO: 11716 - DNA, 1501 bp, Oryza sativa
tcgttaaatatcaaaaatatcacctatgcggtcaataagagataaacatccaaaatcctacaaataaagtacaaaaccccccaattcagtagtgccatttgatagatgtcgattttagagaaatcctggaagttgaatggacccaatcggagttacggtttgcaagatacaaatttccgaagttcaaatggttttataaatggaggaaaaggatttcccagaatttggaggaaatattcccaagattatcctatgaaatggaggagggatggactttggtggaggtgatgattgctgatgggctacggtccgaggtttggaggagggaaataatacagacttttgtaggaattgatttcctgggcttggccaagaagaatgccttgtagacttgttaatcgggtggcccaagggagaaagggggacttgatgtagacttttagagggaaaaagggctcacggtgaggagtcaaaagggtgggtcccacttcctttttctttttcttctctcatggttttcttctcaatttgtctgccttatgtctctctctcgttcccatcgtctcacgtgcgtgtgcgtccgagcgagaggcggcaggcgcgcgacggcgcgggcggcggccgggcgtggcggcgcggttgcgcgtagggagagggaggcggcacagaggggaggagtcagggcggagccgggcagaggaggaaaggaagggaacggcaccgggcaggacgaggtcggggcactggttggacggggtggccggcttgacggcgctggcatccacactagagcaggttcggtcatgtgtaacgggcctaaagcctcatctctatcaggtaacgccccttcactaagcaaagatcactgatgtgataaaatatctcaatcgggcatccggccgtcacgcatgacacacatctcaatcaggctaacattatagcccgtcacggatgactctcatctctaacgggcctaaactataacccgtcacggatgactctcatctcaatcgggcctgaactatagcccatcacggatgactcttatctcaatcgggcctaaattatagcccgtcacagatgagtataatctaaaaataaataaattttatttttttgctagccttaggcctttgctagccatgcccgtgggctggtcggttggtcacccatcccgaaattgctcttctagggaagaatttcccagtcgggttacccatcctgagattgctccaccctaagcacgcttaacctcagagcactttgggattcggcttctgaagaagaagttgtacattcattcacatacacaactatcaatatatttaacacaaccacattcacataacatccattttatcacatatttcacatatttcaccagcaaaaccaagttaattggatcaaatatatatttagcaagtattaacatgatgaggagtcaaatcagacatttaggcaaaaataaattttgaattgaattttatgatacgaaatgaac

SEQ ID NO: 11717 - DNA, 1501 bp, Oryza sativa
caccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtaccttgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaag

SEQ ID NO: 11718 - DNA, 1501 bp, Oryza sativa
ccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaataggtaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagat

SEQ ID NO: 11719 - DNA, 1501 bp, Oryza sativa
ttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaataggtaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacg

SEQ ID NO: 11720 - DNA, 1501 bp, Oryza sativa
caatagctgtggcttttgaaataactagtcccgctgacagcgacccccacatgtcatacacacgttgaaataaaagaagagggagagatggatatggcaacggcggtgtcgtcggcctcagcggtggcagcggcgtctcggcgaggaggagcggtagcggcggttcagcgacgaagaggacgcacggtggtgaggagcggtggcgccaggaggatgaggcagtggtgacgccaccgctgtcggccacctcaccaccttcgtctcccacctccatggccgacgagcgaaggggcggcggcgtcgggaggaggaggcgtcggtcggggaagggcgggagcggcgctggcgtcgcgttgaccggcgtctgttgaggaagggcgggggcggcatcgatcagggaaggacgggagctgcgccggcgtcgggttgggcgtcgtcggttggggaagggcgggggctgcgccgacatcaggttgggcggcgtcggttggggaaaggcgggggccgcgccgatggcggacacccaatgcgcccgatggccgacgctcgccccatgaagtcacgactcgcgagaaggaggagacgaggaaaagaatatcggaccgttttttcataatggcagaggtgggtaatttttccctcaaaagcacttggagcaaaagcacttatgcttttgggtcctttggttgactcttgacttttgcaaaaggaaaagcaggttgaaaagtccaaccaaacacacccctagtgtatatttatagttaactattgtataaattaactattagattgactatagattatttgaagcttatagtaggctcttaaccttatgagctggaaagtctaagcttaacaaatatgcagttctttcgtttgtactcatcatcaaaaattatgttgaagaagtttttttttcttacgctagatagagttatgaccctactattaaacttagtacttcaatccattagcctataaatcatataaactaaaaaggcgacttaaaaatccaagaaaaaattccctaaataaagaggctctaagtatatttttcttccctcatctcttgcttctaattgaattgtctccttcaatagtaaaattcggatataataagtttgatcacggttaatttaacacatcagtagaaaatcgattttcaaaccatcaaaggagtcgatttataccggtttttgaagttggagagtgcgatatacccggttttgcggttgattgatgcaatttgaccgaggtctttcaaattagacttattttctttgctagagggaggaaaaatgggccttactggtccaaatttagctagattaatgggccggacgtgtactgtaactggccagcccagtcactcgcatcgtcgactacctcttgccatcggttctcccgggaagttttgcggcggcctagggttttagcattctcacctcagcggcggcggcggcgggggacaccggattttccgctccgatgcctcgtcagc

SEQ ID NO: 11721 - DNA, 226 bp, Oryza sativa
attaatgatttaagataaatctatttatataatttttgtatttttaaactcaacaacttgtgattattcatgatttatatttctaagatttaacttaaatattgttctaaatgattttctttacgagtacggagggagtacgtctccctttatacggtcggccgggtcgccgcgtcgtcaacacgggagccccggggcctaaccccaccaccgtcacgctaccagt

SEQ ID NO: 11722 - DNA, 195 bp, Oryza sativa
atcgaacaccttcgtcgcttctacccctgaagggggggggtcgggtgtcaggttttggctcgggccaaccccgcacccccctcgggtgtgcaggattggccgggggctaccacacatgcgcatatattcctttttcctttatttcagcatttcaatagaagcagtttcaattttctaaaggttgtgtctgtgccg

SEQ ID NO: 11723 - DNA, 879 bp, Oryza sativa
ttttccacaatagacgtttcacctaatgtatttataatgggtcactatttatagatctaaatgttccagtaatttaaatactcttttgcaacaaaaaacgcacatattttgggaaacctttctattaggaaatttggtttatttttttccataaaaaatattttacctagtgtactcacaatgttttactatgtatagatctaatgttgcagtgaacgaaatattctattgcaacaaaaaaacccacatattttggaaaccccctattaagagaatttggtttattttttgtttcaccgaaaaatgtttcacctaatgtaatcacaatgtttcactatatatagatataatgttgcagtgaactgaaatattttttcgctatttgctgaaacattgtttttatataaggtgaaacaacacccgatttaaacgagtgaaacattttcaatcacctagtgagacaattccgatatagctggtggaacatcgtgcaacatttataaaaaattcaataataagctaatcttttttcgtcggaatatatccatgtgtaatcttgttttgaagatttaattgcaacgaatttaatggtgcaatcggatcatgatttggataagtaatttaagagaaaaatcaatttaaagtagttttgcacgtaaatcggacgctaatgtcatgatcggtcgtccgatccgtatgccctcctggataataatgctaagtgcaaattggctagtggtttacaaaacagcgtgagttatcatgattatcgcgtaccgtaatcttcttagtttttgataatcctcatgataaacatacggttttcacggtccgggtcgcaccgcgcgacggcgcagccaccattttctcctgcgtagc

SEQ ID NO: 11724 - DNA, 1501 bp, Oryza sativa
tagtttcacaggatccggaggcacttaattataaaatgacgcctcagtgtacccgcgcgcagtcctagctagtgatgtacatatgtctctgtacgttcaatcttattcatgtttttcttagttattctatctttgatatgccactcatgagaaatagctatatatatattttagtttggatggagtatatggttgccgtatcaaaattaaagtacacaaatgatttggatgtcagctttgcaaaaacttttattaaaactggtttaattaaattgcctttaaaagagtttttttttgtctgattttgtagtaaaaggtcactactacataaaagttttttccatataagaccccagtaggttgcaggtgattataagtagctgtgcctataaaaacatgccccaccatgggccggttgacggtccgcatgcgatattggccacattattgcatgcggcattcctaagggaccgcatgtgatgccgcatgcgataatgcggctattatcgcatatggtcagcttaagcagccactaccataatactattatcccatacgtctgcttaagccgaccacatgcaggcaatgatggcccatatatcaccacctacctcaagctacacccatttgaactcaaagtttctctctcctaaaccaagcaacaaaaaggggggggggatatcaactcgaaatctttgcttgaatttgatatagaaggtaacgcacttgctttccttcttcatttatctccatttattttaaatttcatcagtgcaatgcggcaaatttctcatttttatgtgagtttttttttttttttgcaaaatctagctcgaatagaatgtttcgatgagcgaattgttgatgtaagcgctattacatactacttaatcgtaatgctgcattaattttgaggagatacatgtattttcatgtttttttttcaaatacatgtgctatatttttattcgtactgcgattttgatttttcataaatggatcgggcatggatgtacgagattcgaagaactcatccgacattcgtgaatgaagcatccaaatttttttgccttggcaaaggcacatgctttaaggagaatatgaggcaaagtttttggccatgctttgattgcaagaatcagaaattattggcacacatagtggagcatggattcatgtacaactacaaggtttggccctatcaaggggacttcctactcctgaagatgacggtgaagagttcaatttccagatggatgagacataattttgcaatcatggatatatatgtctcctgagaaaggatggatgtagatggttccaccggtaatgatgattttgaggccgttttcgatctggaggacatgctatggcacattgaaccagagctactactacgtagagcacgaggtttagagaattgggagtcattaaagaagtcatcaaaagatcttctttacgatgaatccaatggatgtggtaaggacatcacagtgttgcg

SEQ ID NO: 11725 - DNA, 1501 bp, Oryza sativa
caaatgcaaaaatcagttttagtagcatttagaaaccgaatctgtagttatattttatattctgagaaaccgaatctgtagttatagaacaaaaagctccctcatttttttaagctatttttttctagattctattgattctcttgattttaatcagctgcttttaagaatttaaagccagacataccatgtttcccatgtcgtatatctcacgtacgtataagtttattttgtcacgtttggattcctttgatcctatggcaccttaattaattagcatcaactgttgatgcttagcattggaagtaccttgacaatatattacacccattgcagtggagggtgctaatttaatttcttgtagctacaggaatgtctcctcaaactgcttatttcatatgacttcaatatatgctccttgttagacaataagaacatagcaaatgttgtgcaattttgttacatattatgatatggaatggattcacaagaggcattattttttcttcataaagacggaatattttaaattcagataaataaaacttttgtggcacatatttaaggaggtatcacaaagtaccaacacttctaaaagaattgtagtcactatatatgcaaaaagaaaattgcagaagaatcaaaatttcagttaattcaatactaaatatgtctcatttgcttaatgtatattgaaaagaaaattaaagcgctttatatcactgcaacaacttgggaaaaaagtcactagtgtcactatcctatgattttgaagcatgccccaagcgccgtccaattatcctagtcagctaatatattctagccacataacgcaaaacgttgttcgagctagctgtctttgtcaatctcaatgggcgttttggttagtgtctaaagcgaaaattgagtcctttctgttttctttttcccaaaacagttcatttcgaaattctcatcaacaagctctagtatatgtacagtacaatttgctaggtagtagttttttatttgtttcgatctcccgtacacttttctataggtaatggatctactggtttacatgttcccttgccacaacactaaataaaatgtttacaagcgtactcaatattactgtacattctgatcacaatcgtcaaatgagttgacttcagaattcccagaaaaaaatgtgtgacttcagaatttagtagatttgaggaaaaacattcacgcccggtcactctgtcccggggcgacgcgggaggcgaacaagctgcaccgcccccgcccttcttctcccctccaaagcctcaccgccgcccgagccgccgccggcaaagctaggcggctgcaaggacagcagcggcggggctctctctctcgctcgcggtcaagacgatcgggacaccagcaagactggagcttagggtatggtgccggcaccgaggagaagcgaccgacggtctgacggcgtccagatccagtgccatggagcctggatctggttccccatggctgg

SEQ ID NO: 11726 - DNA, 1501 bp, Oryza sativa
aatatataatctatacatcgaaatatgtttaaaccaagtgattgctatagatcggacagcatgccgagacagtataaatcacttatgtctaaaattactttaaattaaaaattatatatattcatagcatagccgataaagcaaatctaacatgtatcggctattactccgatactactttatactaagatattaatatagatgaaatatactaaacaggaatcaatctaacatcaggataacctaacagactgataataggcttaatatatttcatcgaagttagatctcaatataaaggacagatttagcatatcaagtaacatataaggaacaagataactaaatcaggtaagatcggctgaaactccgatgctatttaaattagcaatcatcaaacaagctagatattatggttctaaatattacttaataaatcaaacttaactaatgcagcattaagcacagagagaaacataagatctaaacaagctgatgacaaacttttcatgatgatagatatactatataatctaattcgaagtcagtatctaaccctatcggcagttttcgacaatagaggctagccgatgaggttagatagcaatatcgatctagattatatagcatatatgataattcgacgatttacataaacaggattagagtgtcatagagatgtaagcactaatcccgagaacgcaagctaccataacaagctttaccttttcgtcggagaacgaaaccgatgcagtccaactcaaaagcaagaactcgtcgaaataatgaaaatagaaaagggtggcgtgtcacgtcctgataaattcatcccaaaattaaaaatcattctctaaaaggaataatagaattaattaaaattcgaaaagaaattggtaaacactaaaatacatacaagaaaaattcgaatgtagtccggagatttttgttaaattctccttggtctaaaaggagccctcaaattttacttgaattttcagagcaccgaaaatatttattaagcaacaacaacaattaacaaagtttactgaaaataaaaactaaaaataaatcctccttcctccctttgggccaagtctggcccaaagtcctccccctctctctctcggcctgcggccaaagtcctctctttctctccctctccttctctccctccttctcttgggcctccccttcccctcggcccagctcccttttcctcccctcccgcctgggccgcctcccggcccaagccgccccacccagcctcccgagccggcccccccctcacgcgcgccgcacgcgcgctgaccgcgtgccccgcgtgggacccgcctgccaggcgcgtcttcctcctcccgctcggcctcttctctctcccgtgcaaaacctagcgccgttcctcctccaaatccgccccattcaagccggctatttccaaattgattagggggttttaatcctcattgattcctcatcaattccccctaatttcccccttgaa

SEQ ID NO: 11727 - DNA, 1096 bp, Oryza sativa
aatatttgtcttgtattctgaaatatagttcaatgcagctgaaatcgtttaagtaaagaaataccgaatggttcaaatcgatcacaaattggttatatacaatttaaaagctgtaaccactaaaaatactgtttatttatttttaaaaggaccaactcaaaaagtataaaccacaaatgcatgccaagtgcatggatgcaagcggtgcatagtccgatctcatccttcacgttaaaaaaagagaagtgtgaatttatttaagtttctatataaaataggccattaaatatcttaacaaccaataaaaaggaaaagaaaaagaaataggggcgtacaggaggtggcagctatgtgccgcaggttcctagagagggctttggtaggagaggggccccggagattaatctaatctaacgatgcaaaattatgtgttcactagtttaaataaaaatcaatggcttgatgttttgccttttgcttagaattactaggagtactttcactaatttattagagcgccaagtggcgacgtgagagtgttttgaagaagtttaatggacttttagtacataataataaaatacatcgcaggctgagatttgtttgaatcttacagggttcaaacctgattaatttgtttgaataaattaaaacatctctaaactgctatgaaattttgtgcacatttaacagttttcccaacataccgattaaagtgtagttttggttcaatttgatgcagcatgcactactgatgaatagaaaaaaaatcatgcaccctagaaagaaagtcaaagcatcaaatagcttgagagaaaaaaatacactagggctgtgacagctgccatcccgaatcgacatcacgcgagcaaaacacagtgcaacacgcatatctccagggcggcgatgtgagagtctagtcgaggcaatcagagaggaggagaaagctaatgggcgagcggtcgttgactgttcacgagcacgattcactggtggagaaacccttattagtctcggttcgtaaccccctgtagttctggactaaagatcgagctgccctttttttttatttgcatggccctgttgctgcatgata

SEQ ID NO: 11728 - DNA, 1501 bp, Oryza sativa
ttcatcaaagaataagaatcaaaacacactttgatcttacagcaatatcaatgtgttaatattaaagtaatttatttactgcgagaaggcacgagaaccaattgggagtagtactatatatgctaagtaatatatttactaaaaggagggctgagaacaatatgagagtaatttatttactggcaaattactaagagaagggctgagaacaacatgagagtaatccatttactaagagtaggaaacaattgaggagagttgacaacgacctatgagtaatctttttacttattgtgtactatgtcacatataaaggcttagtaattattttactggacctttatttaaaaatggtgcggggatgagcatattaacccctcctccccgaatagtaattttattacttatagagttctatgtctcataaaatagcttagtaatcattttactgaacgtttattttgaaaaggtgtgggatgggtacaccatcccattcgtatgcatagtaattagtttacttacagtatattatgtcacatacagaggcttagtaatcattttattggacgtttattttcaaaaggtgcggggtgggaagtgcggaaggcttgaaaatgttgggggggaggagggggttgggggagggaagggggtgatgtgaggagagtagtttagttatagcgcacccttggtgcggtttagtgcatatatatatatatatatatatatatgtagtaaatttgtttggtgctccatggtgcccgggcaccattgttgaaattgagtatatacccaattcgaatgagtatgaaacttttttaattatttaggtattaacattaactacttttactaactagttcaaagcaagtttgaactgaatttgaacttatttttgttagattttgattctaggtatatagcatccatacatataattagttaggtatgtaatcatggataggtataggtacgaatcgaattcttataactaggtatatactcacaattagaaaattttgaaaaatttgagtgattttgtgcatttgaaaccatggtgcccgggcaccatggtgccccatatgagtgtcctatatatatatatatatatagagagagagagagcatggttctctctttcacaatcttcccttgggattgaataaatacgatacctctgaatatttccgggtgaaatgttacaatggtatatccgtgcgcttgcggattacttttataaccataaatatacgaggattgtttctgcgccattattgggaatgaatatttctagtaatgtcgttaaggaatatcaacaagcatttctgacgctgttgccggggaagattagcaaagagattactattagcgaattatacatatataataacgtctgcatggttgctgtcctttgtaggctaaaattgattcttttcacttgtgtcatgaaaacagggtaatgcatgtctagtttcaatctgcaagaaaacttcaacgaaca

SEQ ID NO: 11729 - DNA, 1501 bp, Oryza sativa
tgcactaaaccgcaccaagggtgcgctataactaaactactctcctcacatcacccccttccctcccccaaccccctcctcccccccaacattttcaagccttccgcacttcccaccccgcaccttttgaaaataaacgtccaataaaatgattactaagcctctgtatgtgacataatatactgtaagtaaactaattactatgcatacgaatgggatggtgtacccatcccacaccttttcaaaataaacgttcagtaaaatgattactaagctattttatgagacatagaactctataagtaataaaattactattcggggaggaggggttaatatgctcatccccgcaccatttttaaataaaggtccagtaaaataattactaagcctttatatgtgacatagtacacaataagtaaaaagattactcataggtcgttgtcaactctcctcaattgtttcctactcttagtaaatggattactctcatgttgttctcagcccttctcttagtaatttgccagtaaataaattactctcatattgttctcagccctccttttagtaaatatattacttagcatatatagtactactcccaattggttctcgtgccttctcgcagtaaataaattactttaatattaacacattgatattgctgtaagatcaaagtgtgttttgattcttattctttgatgaataattggcatatgtgattattggttttgatatttggagattatcgtcgaagtggttttggagataatcaattttcaggtgatgatcagattcactgttattttatgtgaccggtccgaccgggcggaggttgccggtcagaccggcgctatgtgagcggtcagaccggcttgcccgcggtctgaccggccgacgttgtgtcggtttcagtttcgggttgtttgtttttatatccgtgattgtttcatgattatggcttctagatggatactatacgtatgtaatactgttgtttgctaacaatgagtcaagttggagatagcttggtcttggaatatggtttctttgtttgtttcatgtgtaggtgactcgatgcctcgggagagtatttgcggtgatggaccgggagtcggcttggtggtaagacgatgtccgtggtggtcagatatcatgtgggatactaaggctagagttgatgcacgtggttgacggagattccatatggcatacgatggaggtattgtgtacgtatgggatgcggagtcgaatttggaaggagtccaaatttggtatgattggttatgtaaagtttgtttcttgtactagagggtttcctaaggtgtttaggactcttagtatgagtttggttcgtggctttaggctgccaacatcatgtataaatagagggggagcgtgaggcttcccggtatcgcttttgtatcgcttttgagagcaattgagttgctagtttagttagggtttcgagtttagtcgaaatttttgtaaggagtgctgt

SEQ ID NO: 11730 - DNA, 1139 bp, Oryza sativa
ttagtccaggtttataacaccaaccgggagtaaagttgggggcctgacaaggactaacaggtttagaaccgagactaaagatcatctttagtcccggttggtgccaaccgggactaaagatcaaatatgcccactgtagccaccaaccaggactaaagatcatctttagtcccggtttttagtggaatcgggactattgtggatttcggccgaccgaccaaagattggtttctccaccagtgattagaaatatagatttaaactgtttttgctgtctcttgtaagcatttggtataaaataatttagcaattttgaattaataagtacagaaataaacttggtttggagttaagctttttcatgatttaatgattcctatattcatagttattaaatatcaagttgtattccatgtggagtaaagtgaatgaaatcgattggagcgagagataattgaatgacccaatagagcgaatagatttcaagagtacatttaaaaaatgtgaagcggtagcaataattatacatgagttgaatatgatacactacgccagatcctcacacttctgacgggatacctatgacgggcaacggatttggtcactagtgaccattacctctgacgggtcagacgggataacgtcaccggtgagccatccggccgcggaccgtcacaggtatcccctcacctgtgacgggccgaaaggaaaacccgtcagaggtataccagtgacgagttttgcttccaacctgtcactggtatcccctcacctgtgacgggccgatacattagaagccgtcagaggtgatgggccgccacctgtgacggctttcatttctggcccgtcgcaggtgaggggataccagtgacgggccgttgaacagaagcccgtcaaaggtatgagcaatacctttcacgggctttttttatctaacccgtttgaggtgtgttgggtctataaatacccccaaactgccaactgctttccatcccgaccattgtactgttcacaaatcagttgggagggcaaggggggcgattttttgctaaaattcaaggtaaaaaacacattattctccattcattctcaacatatcgatcatcatttatttttcttcgtatgttgttgatttcaga

SEQ ID NO: 11731 - DNA, 1501 bp, Oryza sativa
aaataattctagcacatggaattcaaccgtattcgaatttgcaatttcaaacaccatggttcaaatttgagttcaaaattttctaacatgaaaattgaaagtgcatctaggcccctaatgattttcatgattgattacaatgcgattagagaggactaacattttcattcaagcaaatgtgaaggttgttatgtcctcaatgtgttgcaatacaatccatatcccgtgaatgcgacatcgcgatgtaacgcggcaatgatcaaatggtatattgtatctttttcctcgcattgtgtcgtagaaaagccatactattatgggggatgatgcatagacatgtaaggagtgatgcgtgtgctcaaaatcatttttcctttcaagcatttctcttttggagcgttctggaaattttcggaagttccgaaaatacacagaagcgttctggaaatttttggaagttccgaaaatgtttttcggaagttccgaaaaatgcgttgacttcgattatttctcagatctggaattttcggaagttccgaaaattgtttcggaagttccgaaaattgcatttattgcactccaacgggcagatttgtgctgtgggtataaatacccacctcgcctcacttgtgagggctgctggttccattccaattatttgtgcccttggcttgctctctctctctctagttcatttgagccttgcttcctcgattcatctctccacctgtgtttgattcggatttggtgtgtgtgtgagagtgtggattcgagtttgtgtggatgctccttgtggtctttgtgaagatttgtgagcacttgcatcatctccgggagttctttgcatcatcttttactcttggaggttgaggactcctagacggctaagtgtcactcccgagccaccgatctacttgtggttggccgggagaagtttgtgaaggccggatctcgcctccgcaagggaagagatacctcttagtgaaaggagtgcttagtgcaacctcttgacgaaagggttagctaagacccggctcttagtgagctcctcaacggagagtagaatcccctcaaggatttgaactccgggaacaagtttgcaagcttcaccttggtgatatctctttatccctctcctctaactttgcttgcttgtgccgctattggtctagttgctgtatgtgcctttgtttacatgtggtagacttctagatctagatacttctttttgtgtgcgctgctctgtgcattaacggaagttccgaaaatcctttcggaagtttcaaaaattcccagcctagttccgaaaattactgctttcgctttacttaagtttttaaattagcctattcacccccctctaggcctaattgaccttttcaaaaataatataaggcaaagcctagacaagagtggcgtgttaagagcacagttacgacagccgatgaagctgaagccgataaggccaagaggctgcttaaaggaaaagccgttacatcta

SEQ ID NO: 11732 - DNA, 1501 bp, Oryza sativa
agtgtaacagtagatcattcgaaggtagctcatacaaaaacagcggtaagacagggacagagcacgactgacccaaatgtgacggtggagttggcgggtcgtgtctgcccatccccggacacctgatcaaactgcaggaggtcggacacgaagtaccctgtggtggagctaccgtcaccatacgtgacgctgtactcacagggcaagctggtggtgcacccgggcagcaagcccccgtaggtggcggcgcagaacccctgatcgcacgaaaccttgctcccagtagacgagtccttggggtcatacagcgtcagctctagctgcacgcaacgcacggttttgcccacagttgagagaatccaaaaatctaaaagaagaagaaaagaaaacgagatggtgtgttaccccgaggccgctcttgcgtgggcatcgatcgcaggagatgcagttcacccagaggatgtcgctgccggtgtccacctgcacgtagtaccgcttggtcggcgtcccgatcccgatctccgtgtagtacagcctgcggcgagacgagagagcaccaaatcagccaagcaagcaagcaagcacggcagcagcagaggccaagcgaaggggagggaggtggcgccgcgtacccggtgtcggtggggaggccgaggccgccgagggggatgtcggcggcagcgaggagcctccccctgcggctcccgtcgtgcgctcggtacgcctccgccgccgcccccgcaccaccggcggggaggctgcggcgcacgtggaacacccctgttgcttccgcccccgctccctccaccgccgccagcattaccgccgccgcgacgacgacgacgacgaggagcagcgccaccgctggcgctggcgcgggcgggcggtccatcgtgggagtgcggcggcgggcggcggcggcggcaagaatcgctgctgccttatgccaccggcccttccctcctcctcctccggctccgcctccgcctccgcgggtgagcttgaggttaattgggggagcggaaaaggtgggggaagggagggaggaagggaagaagggggggaaaggaacggggtggcggtggggtggcctcctccgcccggggatgcggggggagggagacggagacggagacgggccgacgacgcgacgcggaaatagtaggcgtcgtcaggtggtcgccgtgtccgagaaaaaggaaacggggggggggggggctcttcttctgtggttgtggttatgggagctcacttcattagtttgactcagcgttgaataataatactcccacgtcgtttatggcaaagctaattaaaggtagagaaaaaattacaactggatgtgttctttttatgacaagttttatagaagacgtgactatcgcatctaatcctatcttatagagttgtaacccattaattataaagctcaatatacaaacatgccaccgcatcatccacaagcaataattatatacaaaatttatgcaagcatttaaca

SEQ ID NO: 11733 - DNA, 1501 bp, Oryza sativa
aaccgaattaaaacatcaaacaagccgcagatcgcacgaaacatggcaacagcagtccaaacgaagaaccgatgctttatccgctctttttatgccgttgtgcaactgatatcgaatcgattgatgataggagaatcaaaaagcgaaacgaagcaatcacgcccccaccggccccgctccaactctagctcagcgcgtgaataccccgttgccccccacagataccgagccagcacagaagcaaacgacagaggtagagagagagggggcggggtaggcccaggggctaacgcgtgatcaagcaacggggagcagcgagcgggagcgcgggagcgcgatctcacctgggttaggctggcctcggcggccttgcgctcctcggggacgtggctgagcgccgcgcgcagcaccacggccaggctctgcagatccatctccgggccggcttggggtaccggcggcggcggcgcgcggacgggggcggggggctagggctcctcgcggcggtggcggcggggggagtggagtccggagtcctctccttccccccgcttgtgtgggcgtcgcggagacttgggggaggcgcgtgcgggaaggggaaagaggagaagccgcccgtgcgtgcgtgcgtgcgtgcgggtgcgcgaggcggcaggcagggaaaggggactcaaggaggagggagcaaagatcaacgctagggtttggtcaaggccgcaaggggtttttggctttcgggttcaggcggccgagcgagccaaggtagagcttagctagcaataggccaccggccgcagcgcaggccccggtccgcgagaccgcgcgtacgtgtgcggtgtgcctctgctttccagtcttcatggactccgtgcacggcgacgcgccaaatcgtgagttcgtgacaagtacaaggtgggtggcaaccggcgtgggccttaatttggccgaatgcaacaccgaataggctgaacacaattacacaccgaccaaacaaatactaccttccttttttaataaattacgatgttgatttttttatgggacatttaaccatttatctttattaaaaaaatttacgtaattataatttattttgttgtgagttagtttatgacttaaagtattttaagcatgatttatatcttatacatttgcataaaacttttgaataagacgaatgatcaaacatgtgtttttaaaagttaacggtgtcatttattaaaaaaaaggaggtatgagtagaattgaagtggtagtttttattctgaacaatcctgaatttaggtttctatcctaaacaattataaagcatttaccgataaaaccgaaaagtcccctattttcatgtgcggctcctcaaaaggaccatacggaaaaatcaattttcacatgcgagcctcttaaatggaccgtgggcctattttcgcaggtggttaagagcaaggctaataatacagccgacatgttggctataaggttctttatagtctttctcagccta

SEQ ID NO: 11734 - DNA, 1501 bp, Oryza sativa
ccctcttaatagtacggattttcctaaactcaatttcgaaagtgaaaaacctagtctaatcaccttcggtgattttcgcacttaggaacatttgaattggggggtctccttgcattcttagccatcacaacttgctttgggactaaactcctgtgaataaacttgataaacacgttagtcccctttaaccaccttgtcattaatcaccaaaacccactagggggtttaagtgcatcttcatccctctgcctagaggggtgtcaaaacgtacaaggcgcataatcttggaatattcttccatcaaccataccctctagaagctcatctaagaataatcaaccttctttgagcgcgggaggacaagacctcagaaactaccgggaagttgggcgtgctccatagccagctatgaggcagcacgcctcgccataaatgaaacaggtttatggggggatcctcggccagtctggagttgaaagggcatggacaagacgccaacgctaagttactttggacagtggcgcttgggacacgcgtcgcacatgccccgcgccacctgatttagccaaacgggcagagaagcaaccgtggcattgtttcgggtaggtcgggccttatcgggcccaccacgcaccacgtggtgaacacactggcggaggcccaaccatctaagacggagcccggagcccggggtaatatgaactgtaagacttgaagggtttcttgagaactgcgttagggaagcagccaacaacaacaagacggctgattagacaagactaagagtagatttctaatgatgcgagcccctccttagactataaaaggaaggggactagatacggatgaagggttgcattcttctaggtcagaactattgctttgtagcctaaaaatgcttcctttgtacttagctgatctagagaagacaatgaacaccaacacatgactagggtattacacctccgggtggcttgaacctgtataacctcctgcctctctcttctcgtgaggcggttgggccccacgaatccatcacgatcgcagataccgcgcacctcatgccgactaacccccagtcgaatcttcactctcggggattccccgctgtccgagggactgccccctcgacagttacctcttaatttagtggtgtacgtcatatatgaaactaggtgattccccacgttttgttgcagaatttcctaactaacttataataactttttaataatagagctaaaagtaaaaaatatattagttattaacaacaaatacaactggtttgtcaaactatgttcaaagaaaaatacattgtagatgaaatatgatatcccacactttgattatatggataaatatttattaagtattataaaaatgatcgatatatatatgttaaaaatattgtgtgaaggaagatgattggatgctgatttatagatgatgttaaatgcttgcataaattttgtatataattattgcttgtggatgatgcggt

SEQ ID NO: 11735 - DNA, 1501 bp, Oryza sativa
agctgtgccaaacaggcccttagattagtaattaataacttagacgtgatgtctaggttagagattatctttgtttgttgtgtatcccacggatttgtaagaggtagccggtagggggtgacagccctgaatcccgtcctagtaatcctccatgttcggatatatcatacaactatagccggaaccatgctggcagaccagcagcggtcggtgcccaaagcaacggatagaaaattacctttacttagcttagataactaaaacatgtagaaagtcctctctagcctagctagctaccaatagttgtagtccttggatatagtcttagccttaggtagattaaacacgttccctaagtttgctatccttttggggttacccgaaggtgaagtgctacagcagtatttcatgcacttgcagatttatctctggtcgtaagaaataccaacaaccacccaccatatgaagaacacactaccagccaatcagaagagatcacaatgattggaggccccacgtgtcaatcaaaaccgactacaaatgagtcaatccatggtgcaacatgtagagggccctccagtcagtatcccagccgaaggagtggccgataggtgggactagagagttgaccaaacctcttttggccccctcatcttggcccttcagatggcaacttctcattcaatgccaataatggttaggggtgttaaccaaccgacttcacaattgtcataggatggttataaaagaagctcggttcccaggaatgatgcttcagtaacacaatggttaattcttaagcagaatttaactcttgctgaggctacctcatacatccaagcagcatttcctacttttgaaccttgaggacaaggttcttgcgagggaagggtattgtcaggagctgtgaactgaaatggagttcagacttaggactgaagttatagatgggaagcagaggaagcttcagctgggataacgatttgatgggtacacttatgaggatcagacgactatcaacgatggagagaaaagcgaaggagatcaggcggaggtcactacaccaggacaactgtagtgattacctgttgttattttcagctgaaatcatgcagctcattgtttccattatttcttcttacttttacctgtacagctggatgtaatcgcctgaattgtaagctacatattaaggcctttggccctagggaatgaatcaagatcaaaactacatttcattttttttggagattatggttaccacatattcactcggctgggctatccaactggttacaggggatagataatgtatatagaatacgtacaagactaggacttgggtattatgttttcttgtgtatcaagaaatgacttgtaatcctagtttgttaagtttgtggattagatataggaaacttaaaccgtaagtgaataagtttctatcttataagactgctccttcacctatataaggagggcaggacgccccttagggggt

SEQ ID NO: 11736 - DNA, 811 bp, Oryza sativa
caagattagagtggatcctcccaagttgctcgttcaggctcatggggatcaatctgaagatcaggtgaatccggcgcccctgaaagcgtgcaaggattgcaagccatctgtcaattaataattgtcagggttatggataccacatacctaatagtagtcgactacatctcggcaggacccaccacataccatgtcctatacgaaaacaacctgcggatataggaggagttccggataaggaaagacaacccgagttctacatggaaacgacaagaactacttagattgtatccatattggttaccctaattctacttggacaaggagacacctatgagtataaatacaagaccccctaggaggagaggggacacggacaacacaatcgacgaccaccacaatcaacacacctaccacaatatacggaacaacagaagccacagcatacaagccaacatacgccaagacaagccgccggatatcgacatcagagatacgcctggatcaactctatccggtaccttcagaggccgtccgtagggatctagcactgtctctgatttcgtcgggcgcgagctcgaggagcaaggttacccctgttgtcgactacgagtcagacttttaaaccggcatgtcgacaacagatagataggctacctcacatattgtactggtgtgattatggtgaataaaagtaactccggctccggccaacaggatgtagggttattacctgacagttcaggggcccgaatctttataaaaatcctcgtctccatctcttttacctcagtctcgcgtatatcctagc

SEQ ID NO: 11737 - DNA, 1501 bp, Oryza sativa
cacaccgtccacgatatggaatttgcggcgcacctggaataccccattggccatggtaccatgagtagaggatgctaccaccactagagccaaaatgattgttgataacaacaaaggagctgccatctcttcagcaaagtgcgtactatcccttccctttttgtattttatggagttttaaatggtaattgttggttcctcatctggtcctcatctctggcaatgggctattctatgagcttcaatatgaatgggtaggggcatgctagcaaaagatgtggggaaccgtgaacaggaaatagctaaaagtggaagcagtcaccaattattgccgggagagagtacgaggaaactggaaactacatgggtttttgcggttgagaaaaatgcacgtgtgtttttttcagataatggatataaatctggccactacactggtgaagaaaccgtctttagtcccggtttgtaacccatgtagtcccggttttccaactgggatcaccaatccggaactaaatatcgctatctttagtccgaggtgaaaaaaccggaagtaaagatcgatctttagtccgggactaaagatcgctcaaccacgtggccggttgagccatctttagtcccggttggtaacaccaaccgggactaaagatcgattcatttttttttatttccatggccatgttgctgcattgttgttggtatttcttaacgacattactagaaatataattcctagcaatggcgcaaaaatactcttggtatattatggttacagagtttatccgcaagcacacagatatatcattgtagcatttcacccgagagtattccaagggtatcgtatttatttaatcccatggaaaaatcatagtagagagaacctgactaataatttatatgttacttgtaataatcatagtctatgcaggggttaagaaaatccaaagggtagagtgacacacaagcaaggagctactcattctcatactaaaatatttaagctaagtgggaagaaaacagaaagagaatctattcctatacttcaaatatacatagtatatatacatcctagttatctgatatagtagctaataccccctatccgatgccctcctggtacttcgagaagccacccctgactgccgagttccttacgacagcccgtcatgaccatacaaccggggctaaatgcggagtagtaccctccccgggaaattaacttaggactatatatacacgcggaggaatacccgtactgagctatcactatcatcggcccacctctcatccgcagcatataaccgtaaataataatatcccgtaatctagacaccacgcctaaactactagatactactctaatatcatcttcatgacatagagtaattgcataaccaaacattatacccgtaccaacgcatctcccagataagctagcagtatattcaatataacacgaacataatgtaaaattcgcattcatatactcggaaagtat

SEQ ID NO: 11738 - DNA, 1501 bp, Oryza sativa
aattcaggggcccgaacctgtataaaatcctcgcccccatctcttttacctcaatctcgcatatatcctagtaccaatgatccccatactatgcaaataccgtagtcgtgacatcaaacgtcgacagtattgaaatactttccgagtatatgaatgcgaattttacattatgttcgtgttatattgaatatactgctagcttatctgggagatgcgttggtacgggtataatgtttggttatgcaattactctatgtcatgaagatgatattagagtagtatctagtagtttaggcgtggtgtctagattacgggatattattatttacggttatatgctgcggatgagaggtgggccgatgatagtgatagctcagtacgggtattcctccgcgtgtatatatagtcctaagttaatttcccggggagggtactactccgcatttagccccggttgtatggtcatgacgggctgtcgtaaggaactcggcagtcaggggtggcttctcgaagtaccaggagggcatcggatagggggtattagctactatatcagataactaggatgtatatatactatgtatatttgaagtataggaatagattctctttctgttttcttcccacttagcttaaatattttagtatgagaatgagtagctccttgcttgtgtgtcactctaccctttggattttcttaacccctgcatagactatgattattacaagtaacatataaattattagtcaggttctctctactatgatttttccatgggattaaataaatacgatacccttggaatactctcgggtgaaatgctacaatgatatatctgtgtgcttgcggataaactctgtaaccataatataccaagagtatttttgcgccattgctaggaattatatttctagtaatgtcgttaagaaataccaacaacaatgcagcaacatggccatggaaataaaaaaaaatgaatcgatctttagtcccggttggtgttaccaaccgggactaaagatggctcaaccggccacgtggttgagcgatctttagtcccggactaaagatcgatctttacttccggttttttcacctcggactaaagatagcgatatttagttccggattggtgatcccagttggaaaaccgggactacatgggttacaaaccgggactaaagacggtttcttcaccagtgtagtggccagatttatatccattatctgaaaaaaacacacgtgcatttttctcaaccgcaaaaacccatgtagtttccagtttcctcgtactctctcccggcaataattggtgactgcttccacttttagctatttcctgttcacggttccccacatcttttgctagcatgcccctacccattcatattgaagctcatagaatagcccattgccagagatgaggaccagatgaggaaccaacaattaccatttaaaactccataaaatacaaaaagggaagggatagtacgcactttg

SEQ ID NO: 11739 - DNA, 248 bp, Oryza sativa
acaatgactggtgggccctgatggcggttatggcagttatgaccgttcccggccggtttcacatgatttgtgggccctccaatctgtgtgctcgcgtctgattggtcggaggtgtgtttcctcgcatgtcgggtgtgttttctcattaaaatacgtgcatacacatatttcaccaacactagtggaattgattagtaataatccctaccactaagttggataccatgttttgtttcattatatgtagg

SEQ ID NO: 11740 - DNA, 1501 bp, Oryza sativa
ccttggcagcggccaaggaggaggaacgaccaacgcgccggcacaccatggtggctaccggtggccgtattgctgtcgctgcagccatcgttgcacgctcgacaaaacgagggacgcagctgcgacggcgaccgtggccctacgcatagcgtgtacacattgttgtccgtgggcgtggtgctaaagagggagtgtgtggaggagatctacggtgagcggatgttgctggagttgttgtcgtcggcgggtggtcggacgagcaagacaacaacaactacgtagggcaacatccgcaagaagctccggtattgatttgtatttgttcatccgcaaagcacggtcttcctggtacatcacatatgtcgacacgttcttgttagactctattgatttgtatttgttcatcttttgttgatcgaatacatgcgagtcactaaaccaaagctttgtttctttgagcagaagcagaaagtcccaacttaagctcaggccaagccaggagcaaacttgtcttttttaaatttctctctccgctttttcttaaaaattataaaataatgtatctagtgttctacagacaattacatcatttttatggtgtcttttggcaatggcacgatcttacggtgtccctcagccaattatacaaaatttggatatcacgtagcaaattttgcctaataaatacgataccttggaatactcccggataaaatactacaatgatatatctgtgcgcttgcggattccttctgtaactgtatatatagcaggaccatttctagcgctattgctggaaattcatatttatagtaatgtcgttaagaaatatcagcaccccacatgtaaacgggaagaagatagaaaatatgacggtgatggcatggttccaatttcgtaaaatttaagttgcacgcttagaaattgaagaattgtaatgactttttttttaataaccacatttgcaatggcatggatcgaactaatgaatatgcacataacgacagatgttgtagcactagcactgttcggaagaattagtgccagtaatttcttcaaaactacttcttccgggttgataatacttatcgttttggactagagacggtcttgaaaactaacattgaccattattttttattataatatatataaaagtgttaacagctatataattttattaaaatattttttaagactaatctatacatgtagttatcatatttgaaagataaatattttaaaaatgatttataataaaaattctaaagtttgatctcaccttgtttaaaacgacaagtattatcggtgcggatggagtattttggagaagacttcaattgtgaaaactctaccctcgtactgacaaattaatggcactactccagtgcactaggaacagtacacatgtgcgtgcatgctctgttcttatttcgagtttgtcctgcagaaaacctcgcacccgactatccaagcacagaggcccccgacacgagtacac

SEQ ID NO: 11741 - DNA, 1501 bp, Oryza sativa
cgtatatataaaatatatacattgatcaatgaatgaatctaggtaagataaaaatgttttacaatatgaaacggatggagtagcaacggttcgagctatcggtttataaggatgcattggtacttttcatgcttaaagaacctttaataataaaacaacaaaataaataaatacttaattcctcatttcacaatgtaagttgtcggtgacatgggaccgggagtatcatgactagaggcttgggcagccgcgatcacccacgtggcccgacccccccgagggggtcgggtccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgtttatccggtccgtgaccgggcgcagcgtgtgaccggtcacagaccggtcagatcgcgggttaggtggtggcaggtggcctgttacacgcctcgccccgtcccgttggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcaggtaaaagtgcgagccaaatcttgctcaaagtaggatgggtccccacccaaaagaagggtaggtagaaatggtatatgtggtatccccttgagatataaaaggaggaccatgcctaccaagaaaagggaagaaaaaaaaaagaaggaagaaggagagaggggagctcatagaaaggacggggaaaaagagtagggagagggtctctagagttgaaaggctcttgctcttcagctctttgtaactccttcagagacagatccgccagaacacaggagtagggtattacgcttctcagcggcccgaacctatctacatcgcccgtgtcttgcgcgtttgctctctcgcgaaccattccacagatcaagggcttagaacctcacttagcgcccccggccgaaccggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaa

SEQ ID NO: 11742 - DNA, 1501 bp, Oryza sativa
tgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatagggaaataaagtgtagttataaatggtcatcgtatgcaaataaaaatgtggcgttcccgtatagcaccagtatacctgctaatggtcatcgaaatgctagtgtgtgtgtgtgattttaagaagccatgtaagcagaagtgttcactaaaatcaatcaatctttactcattcagaaaaaaagataattctatttatagaaataaagatctaggcatctagcacacgtatgatgtggtaaaattagtttcgtctccactagatatgccttgagctctacaactatttacgtttcaacctcgttgctgttgtttcgtgggatgtagtgctggcttggtaaaggtaatttggttcaaagctgaaatattttcaagttaataaatcgagaggacaaaaacattgagctaggaaagtgttcataaatgggaagtgtctgatttttcttttaactgaaggagctcatgggttgtacttggaagcagcttctcactaaagtcagagatataggtccaaacaggagggactcgtcctcatggacccatacatcaaaaacacacatcccaacttatataggccgtgtttatgtcccccttcaaacttccgaaaatttcgtcacatcaaatatttgaacgtatgcatggagtattaaatgtggataaaaaaaacaattgcacagtttacatgtaaattgcgagacgaatctttagagcctaattactccatgatttgacaatgtgatgctatagtaaacatttgctaatgatgaattaattaggcttaataaattcgtcttgtagtttacaggcgaaaaatgtataatttgttttattattagtctacgttaaacactttaaatgtgtatccgtatacttaaaaaaatttttgccaagtaactaaacacaaccatagtatattacattacatgagtcttatcaggttgtattatcagatcgtactaagtacatgaataaatgggagtgacatacagtttgagccgatctatacatactctcttcgtcccaaaaaaagataaatcctgggtttccgtgtccaacgtttgactgtccgtcttatataaaattttttttataattagtatttttattgttgttagatgataaaacatgattaatactttatgcgtgacttatctttttttttcatatttttttcaaataagacggtcaaacgttggacacggaaactcagggtttgtcttttttttttgggacagagggagtacaaaatatcactgaccccctggtg

SEQ ID NO: 11743 - DNA, 1501 bp, Oryza sativa
cttacagcttgaaagcatatatcataatgcttcctccagacccgccgcctcctttgagactgcccacaccaccttcagcaagtacatcgccgtcgacattcatgaactcacttgccctgagcatgacacggcctccaccatctcccccaaactgatgatcagcagccatgctaccacccttgctgccgtaactccatggccacgccaacgtggaccaagcatacacatcacctccccagttggtgtcattggagaccttacacgacgcgccacgcccaccgtgcccccctccggcaccttcaaggctatgaggcgtcccactcgtctgcggagggggctctccggcaagcccggtggtgttgacagtggagcgttgatccagcgacacgtttgtcgcgtagagactaacggagcccgcaatcaaatccacgtgctcgccgatggtgatgctcccggagacattgatggcgatgtagcagccggcgacggggcagatgatcttcacatggggcgaaatcaccacgctcccgtcgccgtacacgcagaggtcgccgtccagcgaggagctggagccgatgacgcaggtggtgtcgaacgacccggacccgttcatctcttcgcacgacctcgacctcgccgtgtggctcccgcacgggaactccccccgcaccgctccgccatcgaaggagcgacctccggctccgcctccaccgccacccttgtcagcgaggaccagccccgacgcgggggacgcgccaaccaaccccgccaccgccgcggcgaccacgagcaccaccacccacaatcccacccgcctcatctccgcggatcgccccaaaacatagctcaacggcggcgggattcgcccgggggtggaggcgaggcgaggcgagggtacggatctcgcggcggatcgatccccgagccctagagcggcgaggcggtggaggagagagagagagagagagagagagagagtggagacgaagcagcggagtgttacgctacgctgcggctgcggctcgcgaggaggtgggggaaggaggagagagaaagaagagagagagagaatgaagggggatggtggccagctggcgtgatttgtgtgggtggggtcagtaatcagtccacgctgtgctgtttgcttgcttgatcacctctcttaccatcgtcgtcaagtgggaggattagaattaagcaaaagcgattagtggttagtagtcgtagtagtactagcgagcgacggggagggagggagaagagagacggtcgctgtcgcgtcatggtacatggcaccggtgtcttccatccgttccgtccgctgtcacaggatggagccgcggggccgacgctgccgtacgtggatcaccgcccatcggtttttttttctttttctttttctttttctgcggggcggttttttttctaagggttacgtatgataatgccacaaatcaaaccaccaaatgatcatatatatttctttatatttctttttaga

SEQ ID NO: 11744 - DNA, 861 bp, Oryza sativa
gttttagctaatataaatatattatgcaaatgaataaaaactacttatcgtttattaatacgtacagaaaacgagaaaaaagaaacgatgagaagagattaattatattcattcaggactagtagatcactctaccaccaagaatctctttttagaacaaaattttactttatttatagagtgagtaaacagaggaagtcataagtgggaaaaaatttaaaaatatatctctttttactggttttacatgaatatacacgtttataaaaaatttgcataattataccgttgtcgtaggacgatgccaggagattcgagactcgcaactgtctcgcagagcgagggcgcgagaccgctcaacctcacgtgacgagtgcgcgagacatgacttcgcatccgaactagcgcaattaataggctaattagcgtccttagcaattaattatttattattatttctttaattagcattattagtaattaattaagatacttaatcactagtaatcattaatcttttcccagcgttgtccttttttggttgtgcgagactgcccgcactcgctacgtcagagggacgtccggcagcgctcgaccatccgttcagcatccaacggagttaaacacgcacagcagacaggctcggcccacggcaaataaaaaacggcccacatcttcgcgttgacgccaccacgagccgctgcagtgcagccggtggtgcgccgcgccgctgccacaagtgagggaggggaggcctatgctgccgtcgccacacggccacaacccgtgcttcccgatgaagccccctctgccaccaccctcttccttgaccccgtcccacgcctccgcgtcctccctagt

SEQ ID NO: 11745 - DNA, 1501 bp, Oryza sativa
tgtcaaactgtcaatccccctaaatagtctcgtacacaaagattgaaactcacacaccttttgaccctcctaggatcagtcaagacaatctctgagagggatttatccatcacaatcttcttcttctcatcctcagtgaatttcacattcgcaagctctgcagcaaagggagaagcagtactaccaatgggctcacctccaccaacattcacctctgtagttagcaaaggggggctggacatctgctgtccaacaactccgaagttgaggttccccatcatgaagctgtcaaccgacaagctgcggcaatggtgggttgtgctgccagcaccggagctcttaacttctttgtctatgctaccagaagggctccatgcctgtatgcccatgtccttgagggcagcagccgccacatcctccaattggtgccccttgatcgttgtgacctccggcttaactgatgctacaggtggcatttgtgggtgttcttgtgaatacccgaaggggatgtcgctatgcgaccgcctatgcccctcaataagcggtagcttgctaggaagcccctggttagatctccccgaccgtagtgcgacagggatcaccggcggcacatctacaacatcatatggtggtagactgatggattccatcaagaaaaaatgattaggaaagaacgagtataagtcttcaggcccaaagccactaccaagttctagcataggggccgaaggtggtggttccgagtagggggggaaggaagatcctgttgaagagatgaagcgggcaggagtagggtggatcaatggtaggaatttcgatcggtcaagacggtggtgggaggtgaggttgaggatggtgggaactcgcggtggcaccaccggatcctcgctcccatcgtcgcaccggtccagcaaagagaggcggcgtgagggttcaccctccatgttcggcacaaagcaagggggtggggggggaggaagtggcggctagggtttgggggaggttaccaacaagcacgaggattcgccgattgagaatgtgagagagggaagcaatgaacaaaatgtgaaggctttgtttgtgttatacgagtggcatgtagaaagggaaaggcgcgtgggataaaaccgatctcaatctctcatcttgtcttttattccgaacacgcgcttatgacttatctgggccaaaagcccataagcaattatatggcttgcatttaagatgtacttctcatgaaactactgggccggtgcaagaaatatgtagtgacaattacatttgtaattggtcatatgcgaagaaaaagattgccctgagtcttgaaaagtgaggaagtaattaagccaactagctgaatcaaactctgcctaaattacaaattctatgcattggaggaaagtagataaaattagacatcacattgcagggtatttgtcaattcattgtccagtaagtaaattacaccaaatacatgttacatgttggatcgtgtccttat

SEQ ID NO: 11746 - DNA, 1501 bp, Oryza sativa
tttgtggtttttcgatgaaagtattcattttatcgcaagtttttgtgatttttgagatgaaagttcctgattcgaactgaaagttttgtgattttgagatgaatgttttcatatcattgaaaagaatggtttttgattttcaagatcaaagtttgaggaagactataagttacagttaaatcattggtgcaagaagcggcagatgtcgaatgaagcaaaagcaaaaccagcagctaggagagcaggcatggctgtgcgcaacttccgttgctagcgcagctgcgccaactagcaacccccttcaatgttttctacaggatgactaaaaataatatctgaatccacgctagttgtaaagaaatggaaattgttataacattgttaaagatagaaacactttggctatgtttggataatgggtttgggatataatttcccactcctcaaagagtaagtttcaattctagccatccattcttctcactccatttcattctatccctccattcatttctatttcccaatcccacctctcctaacccattatccaaacatatcctttcaccattggtcatctactttgggcatgcgtaatcaaactttgccttacttgtccatgcaattccttgtaaacaagatagtggaatagcttgcacttgaaaactagtaaactattttccattatgaatttcgattgtttttagttaatacagatcacgtcccattcctttcccctctaccactcatttctctccaccaccttatccatatcctctccaccatccttctctctctcatgcatccttctctctctcacgcgaagctcagaggaggagtggctggggtaggggcagcggcggcggtggctctaacgagctgcggcatcggtggcggctccgaggaggagcggcgtcggcggcggctcgagcggaggggaggtgcatctgcggtggcgcgggtggaggaaatgtgcgtctgcggcggcataggcagaggggaggggcgtcggtgtggagattatggatatcccatatctacatggcgacgatatttggactggatataggataccgaatatatatagaatatcttatttgtatctcgggtttgtttcttaacttgtacatcaaggaaacaccttgagacttagtcggttacgactgtattttacctgtatttgtatattccgttagggatatagattatcttttgtaacccggactccttcctatatataaggggggtccgggcgcctctaggggcagagatgttgattttctccaaatcatacaatcaataacacactcggcggattcatccccggacaggagtagggtattacttcttttataagaaggcctgaacctgtataaatcctttgtctccaaacccatacactttcctagcttgatagccaccccttttattattgccgaaatctagtttcgacagttggcgcgccaggtaggggtagcgtcaagcttttcgccgatcagtgcaa

SEQ ID NO: 11747 - DNA, 1501 bp, Oryza sativa
cgcctccattagcggcagtcgtgtgcacgtcggcagccaaggaggttgtatggtagtgccaacctattgcgaaaatggaatctagggggtatgtagatggttaaaatggaagaactcaccgagataggctgagacgacggattacggccgaaaaaacttctcggcggtgaagaacagagcagagcaggagcgacagtgctcggctcagtgcggtgaggtgaaactcgacacggagcttcggttaggctttagtaagctagaacatggttgaatataggtgttctaagggttggttagggtggagggtggatggaggggtgtaaagtcgatcgcgcacaaggtgttcgaccgatgggcgagagtggttgatgatatgaattggcaaagcagggcttcggggttgtggggttatggttggtgatgatcgatgatggacaaggaaggggctgaggtcttatttatagggctaggagaagcggatgagttcgggcgccattatcgccattgatgaactcgggaattaggtgtggcaggggtggcagagggctgagagagggagggcaagatcaatttgagtggcgggaggccatgttcaaattcttaccgatgaaggcttgacttggccgcgggtgaaaacggctggcgacatgttggcgccaatccgagcacgacgcgcggcggcggcgatggttaaaacggccagctcggtggtgattggtttgaattgagagaggggaaaccatcgtatatattcaatccaaccgtgcggcaagaattggcgcgattcaccccgggtagaagaaaaatcggactcggcggcggctttggacgggcatgcacggcatcgagcggcgattacttgtggcggaggtcgtcccggcttcgtcctcatcaagattggtgcgacggcggtggtctgagaggagttgtgcggctggcggcgcgtcaaggcagtcgggcacacgcgagcagccctgaagctgaagcgagtaaaggggatggaaaggcaaagaagaccacggccttgggtgggttgtggtccccaaggacccaacctagactttgttaaagattggatggatgttgggctgctctagttggactgggcatttcatcgagcaccttgagtgcgatgaacagtgttttcagagaattttgaatatttttcctagaaaagaatgaatttaaactataaatttgagaaggtttcaccagggtttaaagtatagcaaactctcactactaaaagggtaaactaaggaaataaactaaagtttgaaatttgagagattttgctcaaattcactaaggtttaggttaggggaataattaaagtaggttaaaagaattctaaaggagtaatacttgaaccaataaaataagaataacaaggattcaaatagatttttaaattatattaatctagtcaaaagccagcatgatgcagtcaaaatttagtttaaaatttgaggatgttacaccgccgctgccctagccgagg

SEQ ID NO: 11748 - DNA, 1501 bp, Oryza sativa
aagacgaatggttgtaaaaaattaatggcttcatatatttaaaaaatagagatagaataaaataaaaaagaccacataggcacggtggctagcatgcctatgtgctatgttatgctatgagaccacctatgtggtctttttttaaaaaagacaacctatgtggtcttttttttaaaaaagaccccaagcgatcgatccccatccacccctatactctcctctccccccttcctccttcccttcttctcttcctactacaccccaattatctccaccccgtaggaactacgagatcacctcgtaggaactacgtaatttaaaaaacaataaaaaatataaagttgaaaaatttatttatagaaatactatataaaaaaatatttgaattcaaattcaaatttgaaacggatttgtaaacttttgacttataaactttgggtctataaactttaggtgtataaacattagatgtatagaaataccatatataaaaaatatttgaattcaaattcaaatttgaatcggatataattcaaattcaaatttgaatcggggatgtaaacttttgacttataaactttgggtctataaactttagatgtatagaaatactatatataaaaaatatttgaattcaaattcaaatttgaatcggatatataaacttttgatttataaactttaggtttctaaactttggatgtgtaaacttgaggtgtataaactttaggtacataaatttactaaaataaaaaagtaatgtggtgccaaaaaaaaaacaggtggagggagagggcgatacgaatatgatcgctggggcaatcgatcgccccttagcaatctggcttctcgtacgaaagtccgccttgtgcagctatgtcaaaaaaaaaaaaatcttcactccctcaaacaaatctccacacgatctaacggtttcacaaacggaaagttttgagggagaaactgtcaaggttttttttttagcaaatccaaaagaaaagaaaaacccggagagggtaatttggcccgtctgtcagcatctgatccgcgatcaccaggatattctgatggcaacaactagcactgggttaatcagcataggtcgatcgcgcgccctgctagagtttaattacatttcagataacatctctaccacgctgtcacggtgctaaaatcccggaaacccacgcctaatcacatggcatcatgcccatgacagccggggaaacagcaactccatttatataacactccccaagatctcgtactccgtagatggcatccacacatatacacacactcctcgactccttggccctttatatacatacacacaggcacacgtcccactcactcgctgcctgctcaaacacacacacggcactccatttttaacaagtgttttctctctgacaagccagctgcacttaagcattgctagagcgctaagctacctgcagcgtagtgtagtgtagtgtactgccatggcagtgcgcgtgct

SEQ ID NO: 11749 - DNA, 1501 bp, Oryza sativa
ccagattgctaaggggcgatcgattgccccagcgatcatattcgtatcgccctctccctccacctgttttttttttggcaccacattacttttttattttagtaaatttatgtacctaaagtttatacacctcaagtttacacatccaaagtttagaaacctaaagtttataaatcaaaagtttatatatccgattcaaatttgaatttgaattcaaatattttttatatatagtatttctatacatctaaagtttatagacccaaagtttataagtcaaaagtttacatccccgattcaaatttgaatttgaattatatccgattcaaatttgaatttgaattcaaatattttttatatatggtatttctatacatctaatgtttatacacctaaagtttatagacccaaagtttataagtcaaaagtttacaaatccgtttcaaatttgaatttgaattcaaatatttttttatatagtatttctataaataaatttttcaactttatattttttattgttttttaaattacgtagttcctacgaggtgatctcgtagttcctacggggtggagataattggggtgtagtaggaagagaagaagggaaggaggaaggggggagaggagagtataggggtggatggggatcgatcgcttggggtcttttttaaaaaaaagaccacataggttgtcttttttaaaaaaagaccacataggtggtctcatagcataacatagcacataggcatgctagccaccgtgcctatgtggtcttttttattttattctatctctattttttaaatatatgaagccattaattttttacaaccattcgtcttattcaaatgaataatatttaagtaaatatcttttcttttgttgtggcttgatttatcaataaaggaactttaaacattacttatatttttttatatttgcacaaatttttgaataagttgaatgatctaagtttgtaataaaagtcaacaatgctatgtattaaaaaaacatagggagtagtaatttatataagttaagtatatcgcagtgtaattataatgtacatcctccattcaaaagtcttaaggatattttatttattatttttcaaaatgagataggtgtgtgtatatatagtcttcctgcatctaagacttacataaaaatattgtgtttttgttttgtagtgctagattaaattattgattggaaatcgaaacccgaataaccatcttaatatttaatactcctcattggtttgcatgcaggcgtataatccttggtactttttttttctcaatgaaaaaagtaatatgccttagatttggatggagggagtaattgtcgaatgttctatggcaactattttttttcatattggtcatctttaacttttggataagactatttatcttataaaaaactaatcccttcgttttatattataagtcacttttactttttttttccaaatcaaacatttttaagtttgatc

SEQ ID NO: 11750 - DNA, 1501 bp, Oryza sativa
taagtgttggtatttcttagcgacactactgaaaatataattcccagcagtagcactagaaatattcctggtatattatggttacagatgtgatccgcaagcgcacggatatactattgtagcatttcacccgggagtattccaaggtatcatatttattttatcccaagagaagatatgataagagagtactatgctaatagtctatgcaggggttaatttagttcaaagggtagggtgacacacagaagaaagaactaagaactactctcactaaaatatagtctaagctaagtggagaaagaataagaaaagtatcattcttgtacttctagtacatacatctttagtctatacttgctattatacagtcatgcaaccaataccccgtacccagtgtcctcctggtgtttcgagaagccacccctgactgccgagttccttacgacggcccgtcatgaccgtacaaccggggctaaatacggaggaataccctccccagagaattaacttaggattatataccggcgcggaggaatacccgtactgagctgtcaccatcagcggcccacctctcatccgcaatatacaaccccaattaatggtatctaataatctaagcaccgcgcttatattactaaatactactttacatccttgcaaccgacatagagcaaccgaataatcggacactaaacccacaccaatacacctatctggaaagctagttacacgactatattaattcaagtataaagtaaagtcggcactcaagtaatatgaatggaataaattatcgaaagggtataaagaagaatattctattaattcaataagtcttacaaaagaagagagaaaagctactaaagccatacccgaattctcctgaagactcgaggactataaagactattatatttcctactccactaatactagaactactaaacaatacttgagagagctcttgatcttctttttgatgtgtgtgtgggaatgaatgagaggaggggtatttatagcccatgaggtgccttgggagtgtggagatgctccaagcatcctaggagcatctttgctctcctcttgacatgtagcatgatgaagcatccaaagagcatatttcacctccttgtgccatgtgtccatgcttatgacggtttctactagtagaattgctcccaaccatcataggatacctgtagataactgccggtggaaaatggactggattgggccagctggtggttcggccgaaccctagccaggcccaatcagcccacaattcggcaggtggattcctcgtttgccccttaactcagaacagagaattttgggcttatttgatcatgtcatatctgagttctcagcccatctatccacacgtctgattctcggcagtgtctgtttgattgatcgattgttgtactgtcgattctcctccattttgatagcttctcctgcatggttagttttccaagcatatagtggaatagaatat

SEQ ID NO: 11751 - DNA, 1501 bp, Oryza sativa
tggcacggaaatagttctagtatatttatggttatagaagtaatccgcaagtgcacggatataccactattagcatttcaccttgaactattccaaggtatcgtatttatttaatcccaagggaagatgtgaaagagaaaaccatgctaataattatacacatatatattacttgccttcatcaaagtctaagaaggggttaatttaatatatgtgtagagtgacacgaagcgaagcttttagattccctcaaataaataatcctaagctaagtagaagaagaaatagaaagaactcaactcctatacttctaatatacaccctgtcacacccggaaattcactagtaatttctgaactaatttgtgcataaaatcctcatccagaaatcatccgaggtacacaaactgacaatttaatatacaaatccatcgtaataataacgttacatacttacaaaagaaaagaaaacagcagcggaattaacggtctagcgatggcttcagctccactcccacaggcagctcaactggggtataagccaaacgtcttctccttctggatccttttcttcaactgaggttgattgattattgcaaggtgaacatatgacatactccgcaagccacacagcaaatatgcaagtgcacaaggataccaaaggattgcataatataggctcatttgcaaaagcagtatttagcaaatatttaagaatagtaaaacagtagagtaatcatcaattttaatcaacactgaacagcacacccatgctgctcaggcccaaccattctgaacaaccaaacccggctgcacagatctaactccataccaggagctaagcaaattattaccaattatagcatcaataattattgtgagaggtgtgagactaatcatgaaaaacattgctcaacccgcccataaccgcgggcacggctattcgaatagttttaatctggccagaggtgtaccactgtacccacaagacacagcctcaacatcatgtcttccatgcgtcgcgatactggaaagtacccgaatagaggctgtgacagtaccttctgcacaacacaactcaccacagtgcaccattcctggatcataatcaccccctctataaatataaccagaggcatggactccccagcgacccccacagacttctcgccacttctcaatctggcaccccgcaatgaatcatgctatacaaaaggtaaagccgttacccacgctggcttctggttgttacggttaatgtctcacaacggtagctcgcgaaccggtccttaattgtcatgaacacgaccttcaaaaccatgtgctcacaacccaccattgacaggttttaattatcatttaattatcataacacgattaaccatcgtgagctaccattaaatataatcataaataataatgtagtatgattcatctcattaatgagctaatgtttctaagcatggctaatcaattacatatgtagcatttagttgaaccaa

SEQ ID NO: 11752 - DNA, 1501 bp, Oryza sativa
ttgctaagagaaatgcttgtaacaacatgtatattgttgataatattaagtattttcagtaaatacctaagcacaacctgtactgattcactatgctatgctaaggtgcatccatacatgctgattctgtgctctcatcccattattctttgacgcaagatgatcaaccctgattttgtatgtgatgtctaaaaatttgcaaaggttgagtggaactgatttttgtatgatcaaaccattattcattgctcatcccagttttagactagattgatcaagattcatcactgatccaaattttgccatgaattggacgaggttgataaagataattgtatgatttcaggcctaataaagttgtatgctttagaatggtcaattaattgcatgttttagacccaagaaaattgaaattaaactacggatcttattttatgaaagatggcttctgtactcagctcactgaatcaggttttttaattgaactctccgatacttaagttaatgtgttgaaactatgcttgattgctaattatatacttttagttttgccggatgtcatatgtgatgcttctgagggagcctaatgtacagcttgagattatttactcttaacctgatgcgctcatatgtgatgctcctggaggatatttatataaatcgatgtcgtcttctcaaattataatttactgtttttaataatttgtactggcatatcaaattactgtttttaataatttgtactggcatatcaaattaactgatgtttttaataatttgtactgatatatcaaaatcactgttgttacgcttcatggctcataataaatcgctggtgcattgatatctacatgttttcacatttgctatttacagctcaggtactttcagtgaacatgaagcttactcataaggaatcaaaccaattgtgaagatagcaggtactctgagaattgacagagatgagagtctggctaaatagtcagccatgtgaaatgccttaatgaactctgtatttcgatagatgagatagctcatttaggcagtacatacatgacgtgggttcttcgatccattcaaactctagtgctgatccatttatagatatttctcccttgcatatgctctttgcattgactcccaaccatataacattgcggggccctaaaatttatattactacctacacgaaatcagtgtaatgcacaatttattttttatgtagatatattgtactcttaaatttgtttatacaaatgatttttatttttaggtaatacaatattgctaaagtacctaaatgaaataaatgtgacatgatatccaactagcaattttcgattagatgaaatgttatgtgatttgtttgtaaatcacattatatgtttgttgtggactaaggtagattgatgttttatcggataggaatggatccaaatggatcggcgtttgaagaacgcgccccatttcgagacataactaatatttcttcaggtattgt

SEQ ID NO: 11753 - DNA, 1501 bp, Oryza sativa
aattatggtggcaaattgactaacttttaaaaaaaatggtgacatatttatagaaaatccgttggttaaattaatttagagtaaattttacaaaactacatgttttatggttcaaattgtagaaaaccacacatattttgacacttagcatttaagtacatatattttggtagtttagttttacaaaaccacactatcgatgaatggattcacccgtgagataacatggttgttccatctaggatgaggacgtgacatcctattaatttcgtgcgatggctggtaataggatgccatatcctcgtcctagatgaaatagccacgtcatctcgcgggtgaatccattcatcgatagtgtggttttgtgaaactacacaaccaaaatatatgtacttaagtgccaagtgtcaaagtgtgtgtgattttctgcaacttggaccacaaaacgtgtagttttgtgaaatttactcattaatttaaccagcggatttgctataaatatgtcaccatttttttttgttaaaagttagtcaattttttttggccataggatatacattaagattcgtgctattttcatatcacgtagttgcaaaaacaattatggtggcaatttaaccatcggatcctatatgcctatacaagtcatcccctacaattgaaactaatttcctgtgatatgagtgagccacgtcacctatattaatcccagccatcatattacagatgagcgtttgttactctgcagaacatagatgtactctacaggtgaatgttctcctatctcaacgcatggcaccacaaatcaaagtgaacgacccactaattaatgtggtaacgcctaggagcccactaaagctcaaccgtttcatctccacgaaaaaaataaagaagctcaaccatttaatcccactaagcaacacacatctcaaagaaaaataaacggttgacgctattttaacttgattgatgagtgaagtaagcaggtactccctccattccataatataagacacaaccattttcttaatgctccataatataagacatgcatgcatgtagggaattaattatgaccccttctctattaaattattacttttttaaatcctccactcttatgttctcttattctattagatgcatgcattgtatttattaggatgatccaaattacaagataataataattatattcttggtctttggattaggggtggttatgccttatattttagaatggatggagtataatagcaggctataagtcggctataaacatattttaaggagataaaatagaagagagaagagcagcgggctatagatttgtagccagctatagcacggactccaagacgtaatgtgtgtatgacaaatgggaccaggtattaatagtgtagtatgtaactattgtatgagttggctgttaaattaactatagataatttaaagttagtagttggttatactattaaacttgctctaaacagtcttcatg

SEQ ID NO: 11754 - DNA, 335 bp, Oryza sativa
cgatatttttggctcgctcaatcctagccagacactagagaacttgcacgcgtagcggccacttgcggatggctgagtgtacatgcaaaccacgacgacgcaaagctgcgccaccgatgccactatggccagtactccctccgtcccctccgccccctccaaaaaaaaatcaatcatgggtttgaacctaaattggacacagacacacatgtatccaggttcaaacctaagattgtttttttttcggacagagggggtaagtgttaacatgcctaggcactgcttcccacctccttcacatccaccaaagaccaaaccaccacccgaaaatgcgt

SEQ ID NO: 11755 - DNA, 165 bp, Oryza sativa
tactatctaaatagtattatgtattaattaattaattatttgcaacattattgattaaaaattatttttaaaaaaattggcgggaaattttaaattttggcgtgcatattttaccaggcagccccgccttctttatcacaggcggccccttccctctttcccagg

SEQ ID NO: 11756 - DNA, 522 bp, Oryza sativa
attaatattcattacaaagtaattacatcctagttccgttgtacctacataccaattacacgctgtacttacatctcagttgcattatacttgcgtatcaattacattgtagttatttggtatttatattgcaatttttactatatgtgtggagtgttatgtagtgttaattatatggtttgagaaataaagtatgtactagtttataattaatcgtgaaagtctgtacgtggaggccctctattcttgtcgttatgggtaaggattagagattgagaaaaatctgactgtgcttggctccgttttgtgtcgaatactttttagataacccaccaatcacaattatgtgaataacaacaacagcagacttaacttgcgaatttctatcctacaacagtgtctccacaaggggtacaatgcaaattgccaatcataatttgtcaatttgtgactgaaagttaaaacgtccctaacccgatcactatttcagcttatacgtcaacagctcggttcatatataga

SEQ ID NO: 11757 - DNA, 1501 bp, Oryza sativa
gatttccagcctgtaggggaggggcacgtgtccctgggcggatcagataggccaccacatcatcatctcgaagctagtggtgagctaggctgcacgagaagtcgagaagaacgagaggtgtacgtgtggtggtaggagagggaatccatccatggtgatggacgcagctagagcggtggcgatgccgtcgctgtcgccggccaccgtcgcggcgaggccgagcagccgccgccttcacaaggtcgccgccatggccacccagaagcccacctccggcacaagaagggtaagtcttaagtcttcttcctcttccccatggcgtgtgagcttgtagatcgatcgatcgatcgatcgggctaacggcggcgagcggcggcggtgcaggggacgacggtgtacttcccggtgggggagccggggccgagccagacgacgagcgggaaggcggcggcgccgccggtgaagctgctgacgaacgtggagaagctgcggctgctgacgaaggcggagaaggcggggctcctgtcggcggcggagcgcgccgggctgtcgctgtcggcggtggagcggctgggcctgttgtccaaggcggaggagctggaggtgctgtcggcggcgaccgacccgggcacccccggcgcgctgctcggcgtcgcgctgctgctgctcgccgccggccccgccgtcgtctacctcgtcccggaggagtacccatgggaggtcgccgtccaggccgtggtcgcgctcgcttgcgtcgtcggtggctccaccgccttcgccgcctccagcttcgtgtccaagctccagagctcgtccagctgaagcgattacatgctcactgccttagctttgagtgattaattaccacttaatttgcaattagtgtgtaattaagcagagtatttagtgtgtatatcaattactgtgcccctaccctacgccttgattttgtacgagagcattggtgtacctgcaaaaattgtataaaacctagtattatctgataattgtatctaaatggcttggcaaggttaatttacctagctgatgttgattaggatgtgacgtgcatacgtatgagtatgtataaaacatgctatatttataaatttttttctctactttatcttgaattttgtatatttctaacccatgtatcattgctcggtattttatatctttctctaccatcactatatatatcattctcatttgtatgtttacgtagtatcctaatcagtacctaaatcaacaaaactagtcgtgtaatgtccttttaaccttagttcgcacgcgcaagataagtttatgtaacaaaacaagcattttataagatcatacactagattacacccactcgacaagttcgtgtaccgcggatgcaatttactcttattttaaagcatggacttaaaagaaattcaaaacttagttttccggatcggctataattatggcgacagatttttcccacaaacgcagtcgaattttcagccttagg

SEQ ID NO: 11758 - DNA, 1501 bp, Oryza sativa
atcaacatcagctaggtaaattaaccttgccaagccatttagatacaattatcagataatactaggttttatacaatttttgcaggtacaccaatgctctcgtacaaaatcaaggcgtagggtaggggcacagtaattgatatacacactaaatactctgcttaattacacactaattgcaaattaagtggtaattaatcactcaaagctaaggcagtgagcatgtaatcgcttcagctggacgagctctggagcttggacacgaagctggaggcggcgaaggcggtggagccaccgacgacgcaagcgagcgcgaccacggcctggacggcgacctcccatgggtactcctccgggacgaggtagacgacggcggggccggcggcgagcagcagcagcgcgacgccgagcagcgcgccgggggtgcccgggtcggtcgccgccgacagcacctccagctcctccgccttggacaacaggcccagccgctccaccgccgacagcgacagcccggcgcgctccgccgccgacaggagccccgccttctccgccttcgtcagcagccgcagcttctccacgttcgtcagcagcttcaccggcggcgccgccgccttcccgctcgtcgtctggctcggccccggctcccccaccgggaagtacaccgtcgtcccctgcaccgccgccgctcgccgccgttagcccgatcgatcgatcgatcgatctacaagctcacacgccatggggaagaggaagaagacttaagacttacccttcttgtgccggaggtgggcttctgggtggccatggcggcgaccttgtgaaggcggcggctgctcggcctcgccgcgacggtggccggcgacagcgacggcatcgccaccgctctagctgcgtccatcaccatggatggattccctctcctaccaccacacgtacacctctcgttcttctcgacttctcgtgcagcctagctcaccactagcttcgagatgatgatgtggtggcctatctgatccgcccagggacacgtgcccctcccctacaggctggaaatcccacgtcagacacgcatggattaatcctaattgaaagattaaggaataataaagtaattataattagagaaggtgaatgacaagatgattccatggcccaatggataaggcgctggtctacggaaccagagattctgggttcgatccccagtggaatcgcacagtttttctatttttgggtctttttagctatttggcccatttaaggcccatcgaatgggccttttattcggcctataataggttattgtgtttgggccaaatgtagcgtaaatgggccgacgatgaagcccaatagacccataaagtgggcccacgctccactgctgggttaatacccagccgccgcaaggcccagggcgaagcaaccaaacccttcgcgagatcagaagcgaaaccctagcggcgaatccccacacgacgcgccggagcggggagaggggcca

SEQ ID NO: 11759 - DNA, 1501 bp, Oryza sativa
ttttagataacccaccaatcacaattatgtgaataacaacaacagcagacttagcttgcgaatttctatcctacaacagtgtctccacaaggggtacaatgccaaattgccaatcataatttgtcaatttgtgactgaaagttaaaacgtccctaacccgatcactatttcagcttatacgtcaacagctcggttcatatatagaacagccgtgaagaagctcaggctgccatcggtttgccaactgctgataatacatcaaacgatcgtattagcactaaaaaaaataatttccctcttatataggctaatcgcctgcttattagacttgctattaggaaccctctttccccgttacactctaaacgaagtggatgtttaatgtatgattaattaagtattagcttaaaaaagctttaaaaatgaattaatatgattttttaaaacaaattttctatataactttttataaaaaatatacaatttagcagtttgggaaacatatgtgaagaaaatgattaaggagaagttagagcatgaccaacagctttattattattttattccctatcctcagatttaggaaaatttggttaaaaatcgtatccaacagaatccctaacctgtctcctaataatccaagttcccaactccggatatctcgtttcctactttaaggagcgaattttttcccaatcgctctttcgcgcgcgtagggagaaaaaattaagctagccacgcggtgcgcacgtaggggaggagcagaaaaaactaattctctgttggtagttaaagggagagcccacttttcattatagggaatcaaatttaggacatctcttaaaaagattagttttcttactttctatatttagtttaggagttaaaaaaacatagttttgggaataaaatattgggactactgaacaaatcctatacggccctaccctaaccttgttaggcggaggattgatcagtcctagtatcggctctttcgaaagaaattgcacaaagcgactattttctgcattttattgatgcggcattagttggctattaggaagaaggcttttgtgttctctcatttttcatacacacgcttctcaaactattaaatgatttgatttaaaaaatattaaaaaaattacttaaaatcatattaatttatttttcaagttttttaactaataattaataaattacgcgttaatttatcgttatgttttgcgtgttgggggagttagtttccaacgtactataaggttttaagcacaaactccaaagtgtcatgtatacttaaatgatgatgtggaggagaggagagaagagaagagaaaagagagaaagaaggagccacctctacctaccttgacatgataaaattttggagcttgccactagctgcactattgaccttgctctcgtataaggggcaacctccacacaaactttaagaaacaagagaaaaagaaaggggttgattaggacattcctaacccaa

SEQ ID NO: 11760 - DNA, 1501 bp, Oryza sativa
tggaaaagtaataaaaatcctcctcctcagcttgggccgaatccagcccattccctcctttcccctctcccttcctctcagcccagataaagtctgtttgacctccctggcgctacagtactccatcttcctcctccagacagagccgagccagccgtgctcgtgcacagtgccgcctcctcccaccaatccgacctccccgttgctcctctttccaaattagttgcgggaatggaatcctctcaatctcctcttccttttccccaagaaatccccaaatgtttctatggaaatcctttccaatttcgcggttcaacctttcctttttccggcgaaccctacctaatccgtcgccgattccatccgttcccgagtcgatctctccctcttctggctataaatagcatcccctcggcctcctcttccgtttgcctcaagtcccaagccgagccgtcgcttgtagcgccgccgccgccttgccctagccgccgccgacgccggtgaccctccagccgcgtcgcgccgcctcctcggtcgaccccaacctgcgccgtcgcctccctcggcttcgcaagggtgagagctaccccggccacccgttcccttgcgccgaatctcgccggaatcgctctccccgcgctcgccttctctctccacctccggccgccgctccagcagccccgcgccgtcgctgtggtcgtcgccttcggtcgccgctgccgccattgggttcgcgaggaggagaagaagaccggcctccacttccccgtcgtcgaagaccctgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgcccctcggttgttgcctctcgtcgccggaaagccgtcgccatcgtcaacccaaggtcgccgcctttggaactcgtcgcctgccatctccctcgccgtctgtcgtcgtgtaagtggtggtaagggtcgccttgatctcctctctctcccggtgccctccgtttgcatctttgtaccgtggttcgctggtaactgccgttcccgtgcttgcggtcgtcgatcctgcgtggcagccatgtcatcgctgatatcgacgccatcttggccatccaaaattaatataaatttgtcatctcttttcaatgacatattattcatttttaatatatgtcatctaccaaatatgatctaatctttttccggaggatgttttaatcttctgtctcagttataaatcttttgtaaattgtttaatcaatttggaatagtcttttctttaataggtttaattggaattaaatcttgtaaaattcatatttaattcatttgaagtcagaatgaggccgttcaagtctcataattcatctaaaattatgacctacatgtttgtttactttttatgtattatttatttggtttttattagtcttttt

SEQ ID NO: 11761 - DNA, 543 bp, Oryza sativa
tgctccgcccgcgcgccgcgcgcgcgtgcgcgtgagccgctcgcgccgagcgccctcccttcccctcgctctccttctccccgcctccatccctggcgagctccccgcccgcgaaatcggccccgcgcggcgttgtttgcgcgcgcgcccgcgtggttgccgcccgtgccgcgcctgcgccgtctgcgtcacccggccccgctgccctgccgcgcctgcagccgcgcatccgctcggccccgcaagccagcgcgcgtgcccgagccgcgccgctcaaaccgccgcgcctcccgttgcaacccgcccgcgcgcgtgccgtggtggccgaccgcctggtcgccgccgccgtcaccctctgccgcgcctgcccgcgcctgtcgcccgtgtcgccgctccgctccacacagccccgccgtcatcgccgtcgtcatcgcccggcccccgccactccgcttgctagcctccaaggggcggaggcagagccccctcctccctctgccgcgtcgcccccgctcccctcttccttttcccaaagaggcaagg

SEQ ID NO: 11762 - DNA, 1501 bp, Oryza sativa
  unsure (1)..(1501): unsure at all n locations
tcgggcgctgagcaagagagagagctcgctctctctttctcttctccctccctctctgctctcgctactgcttcccgccgacgccgctcaaatcgccgcgccacccgttgcttcttgcgcgcgcgtgccgccgtcagcgcctgccgcgcctgaccccgcgcctgccgccctgtagccgtgcccttccaaaccgcccccgccgtcatcgccgtcgtcacgacccggccccgccaccaccgcgcatgcttccaagggttggaggcagagctcctcctcccactgcctcatcgccctctctccccttcattcttttcccaaagagccaagaggcaagtctcctttccctctttcttgtcttctttttctccnccgcgggcatcatcctccctgtcgccgttttggccgctagccggagcgccagctcgctggcttgaccgcccaatgtcggttcctccctcccaaactgacattgtcgcccctataaatccgagcccctttcctcattccaaactcccttgttttcgccttccgcctccaccgcgccatagtcgctccgccctgcttgcacatctgtcgttcgtcgccaaagcaccgggagagccggtgcgtccgaagcacgcgtgaaggggactccgggcgctcgtcttttcctcttccccggcccgaggccggagagatcactcccgtgctgtcggcctctcgtcacagcgccccgcctcgtctcggtagagcatgccccgttctccctcctcgctctctctcctcctcttagatttgtcggtagcgatcttagcactccctgtagccgccgcccgagtccggtaaccgccgctcgtcgccagccgctctcggggtagctccgcccaatccagtgctaggaatgcaatcccgtagccgcgtagatgctctcgctgccaagaatcggcccctcgtggtctcgtcgcccttcccctcttttgccgccgccggtgtgcgccgccgcgattcatcgccgtcgagccatctccggtgcatccgagccgaaggctcgatccctctcgttcttgtaatcacaccggtgcatctccccttggccgaagatgtcccgacgagctccggtgagcaccgccgtcgcccgccgtccgttcccggccggcctcccttcgtcctcctccagccggcccacgtggcagccacgaaggcgccacgtcggcgccagctcggccgcgggctaggactgtttgacctcggagaagccgctcctccgatctgtctcccgtgcgcgcgtggtccacggagagccagctggctgcgcgtgggcccgccgtctcccagtccacccggtgcaccatctgtgagccgcatccgcaaaccctagctcccccgcgccgcataaaccctctctcccgtgcaccgagtcactgactcgtgggcctaccccgggaccccgcacgatggatccggctcatccggatctctctctctccctctctctctcccccgcctccctctgttgcgccac

SEQ ID NO: 11763 - DNA, 1501 bp, Oryza sativa
ctacgtcctggtgcgagaaccagcgagtgagtagaattatctctcggacaccaatggaagttgtggtgcgagagattactgcgtcctggtgcgagaaccagcgagcgagtagaattatctctcggacaccaatggaggtgctagagttagtttattacatgtgcgtctcatgtggccagcatgacttacacacccaacttgtagcatattcggatatccgatcacaatcatgtcgggtgatcaagccgacggcgttcgcgaggaattatctgttaacaaccttttctcgagtagtccagccatggccggtgctatgagataggtcgtcggtcttcgttggtaggttgggtacgataactctgcatttgtcgagaatgttttcgataatggagtgtactcgaccacaacctactcgagtgctcaattgttcctaaaagatattttctagaaggcaagacatatagcagagaatatcgagtatgtaatcaaaaaactgcatgtagcttctagtattatcaggatataacgagcagatgtaattatcaggcattatgtaaaccgtaaacaagcatgatttatacagaagaaaatagagcgagcccccagcgttagaccgtagtcgatttaacatcggggacactcgtgcaaaagatattgtataaaaaacatgctctaggtaaacataataaatcatggatctgacaatgctgtatgatctgaatgataggtacggtaaattgtatataaaatattgtgtacctgtgtagatatatgccggatatatctacggaattagtagattaattgaattaattaatctactaattaccttgattagccttggtagctggtctggattgttttttctggacgcataatacaggcacgtacaggtggcccactgacatacgtacatatgtacctaaggtaaaatagccttcggtacattgtaagtgttactgtatgtgcatgggtcccacggtatgcatgtataatatacatgtagatggcaatgcagtcggccggctgcttggttggcaggtctgacgacgggtaattgactccgatctgatgtaggccgatgtatctgaatctgatgaggacacctcgtcgattctcagaataggctaatcgtcagactgatctcggatgtcgtcaatgcccgatgatgataattcgtctaactttttggcggcggatgtcggttcaaaggtagttgattcgggcaaggcctcacggttgacaactttgaaccgataccctccacggcgatgacgtcttgaaggttggtcgatctcgagagatcgaattgttgacgacgatggtcccgatctcgtcgggggacgtactctggcggggttggagctcccgggtccgaagtcgtcaagtagcttgttattggagaatccatcttttgaaacccatctcgtcgaaattctggtatttgcatagtatggggaccgtcggtgctaggatatacgcgagactgaggtaaaagaga

SEQ ID NO: 11764 - DNA, 1501 bp, Oryza sativa
cctggacatgacaagatatcaaaagaagacaagatatcaaaagaaaataattaggatgataagttaatatgaaaacatttagtttgctacgtataactaatgccacacatggaatggtagcaatagttatttattgcaaccatgtgaagtgttgcaatatatattttttgccacatccattttatggcaatatcaaattttattacaactaaataaaaatcgttgcaataacctattaccacgctatttattaccacagctagcaacgattttaagattgtggcaacattgatctattgccacaattttagtattgatgctactatttttttcgtggcgataaattatttttctagtagtgtttattgcgagaacgaacatgggagtaatatttttacttatagtgtactatgtcacatataaatagttagtaatcattttactggacatttattttgaaaaggtgcgggatgagtacaagatccgatttctacgcatagtaattttattacttatagtgttctgtgtcatataaaaaggcttagtaatcattttgctagatgattattttgtaaattgccccattttggaggcatttgtaaatttgccactggtttttttaatattgcaagaataccactcgaataaaagttctagtggtatttttacaatattctagtgatagttttgcaataacgattcaaagtagtggtaaattttgtaattgccccattttgaaaaggtgtggaggtggggggagggagcgtgggtggggggtggggatggactgtatgtgaggggagcgttttagttatagtgcatcctggttgcggtttaacgcattcctatatatagagagatatattagcctcacccttaaatcctttcttttttattcttttttttttttgctttggttacgtatagtatcttcgggttataagctgttgctgtaaagttatctttcaagcaggccccaaaggatagcccttttttagtaaatttataatgccacttcaataaagtaattttagaaaattaattaaaagaaagacatgaaaaaatccttttttttctttttcatcattgcttgaatggttgattagagactgtatatctcatcgaccaatgtgaaatagagtatatttttatcacgattggaatctggatgaagttggggcggttaaaataatattaggtcttctactatgcaacttaggtatctgttccacactgttttgaaagatcgacagaaaagaattagttatgttaggactgagcacatgtcgacccactagtttaaatgactgatcaagtcttctttcaaaaccaatttgttaggacttgggtacatatttatgtacatccctgtcaagtcttgataaagattgtcagcttgctttgtcttgcagctgagctcctccttttaatccctcgttggcttccggatcagcaccagctattcattgtagcacacccacaaacccaggagaggtagcaa

SEQ ID NO: 11765 - DNA, 676 bp, Oryza sativa
  unsure (1)..(676): unsure at all n locations
gttagtggcagaatcagccaattaggacctggcaatcctatgcagctgcataaacaccatggtttgaatcaatagtgtagttgctttgctccgtaagtctgtgttctttgctcaatgttcctgtcggtgatatgggaccgggagtatcatgaccagaggcttgaggtagacacaatcgcccgcgtggcctggcaccttcggggacgtcgggcccgagggtgaggtgtccgccctcctcctgatttcccccgagggggggtcgggttcncttgccctctcccctatggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaaatgacaca

SEQ ID NO: 11766 - DNA, 1501 bp, Oryza sativa
agtcaccatgtcaagcaccccctgttatgtacttaccacccatcacatatactttaatactttatatttacaagcacatagtttagccaaatcacccattgtccaataaaaaacagagcaaaatcctgaacttaattgaacatctaatcctatgaatatgagagcaaaattagttgacgaggacactagtcactactagtcataaaatatgagaatcaactgaaatgtgagaatcaaaaatcagttgatcccagaatcaactgaaatcgaatcagaaaaataaaattcactagcagtcactactggttcccccaaaaattatctagaacaaagcaaaatctgtctaagttgattgcttatgagtgctgatgaggtggcaaacatatgcatatccacagtaacaaaaaaaagagttaagctaacatgaacccacaaatggcaaatagtgagggcatatatgacaataaggcaaaaagatcaccattcagtgctagtggtcaaaaatgccaaaaagtgcagatgggccagtcaatcacaacaatatatgctcatgaaaatttttacaaaaatcatcaaaacttcgtgactacctgcaaccagactgaacttaactcagtataagaggataatgagttgatgactgcaggaatacaaacttagaaatgcagaggtgtataaatctgcagtatgtaatcaaacacaacacaagcggctgctaggttttctcagttctggatggtttaatcgtttatatttaccagcacacagtttagacaaaaaagtgcacccattgcactataaaaaacagagcgaaacactgaaactttactgaatatctaatcctacaaatacaaaaacaaaatcagttgatgaggacacctagaatcaactgaaaaaatcgagtcagaaaacaaaattcaaaaccagcccctattgggttctcccaaaaatttgtctagaacaaagcaaatctgcgcacaatcgtttcaggggaaaaaactaactgcatatggaggaacgcaaaatagtacatttctgacaaaaaactcagtacaccaagttaatgcacaaagatgtttttgctcctattaaatcctctgtagttttttctctgaaaatctcactcaagtatgaatgttattagaaagcaacaactatatgatgacacctacaaaatcagattgcagcaatccatgcatcatgtgaaagcctcatgataataccaggtcaagcagggcatggagatagaaaaatttctctgtgaataacttgaatcatgctggcaaaataacttgagatatgtagtatttcaggagccaaatatgctccaagattgcagctggatattgctctggattgaaaatcacattgcaaaaaaatgcagtcatcagttgtgcagcaatatgcagtcaaaaatagcattcatttacagcaatctgcccaaatattccagctatatcaatgcattgattcagcaatatgcagcaatctacccaaattg

SEQ ID NO: 11767 - DNA, 1501 bp, Oryza sativa
ggtggaatggcttttggaaaaccgaccaaaagttgtttttcttgggttttggcatttgcacgtttaaaagatgctaggttgagaaaaagtgtgcacaactcagaagatctacgtggaataggcttaactgcaatatagacaattatgtaaagtaaaccaaaatacatccaaaatcttattggaacagactttattcacattgcaacgtcccttgttcttacatgaagacaaagctatctacgataaaaaggcatgtgcattgcatacatacttctaaaaggtacaaactaaacaaaaaaaagcataaggaaaggggaactttcccgtggaagagccaaaagagaatgaaccaaactaaggaggatctcaatatcaaactagtagagaagaaataagcaaataggttgattccaacataacatagagattgaatgttgagggtgtgtgcacacacatctcccaccaagcgtgctaagcttcatgccttcccttaaagagcaagactattaggaaataatgatacatgttaccaatgaaactaagacctagaaatttatacaagcatacatctatatgaaacaaaaagaacactttattttcctccatagcacactcctctctcatggtctcacattcatccccgtgtgaggaggtaggcactaaagttggtgtcatcaggggcggagcccccgcccaactagcccaggcagccgctcgggctcaccggtgaaaagtccattaaattttaatattattgaataaattgatgatgaaatttctgtagcaaatgatagttatagtgatgtttgcctgggctcaaaaatctttcttgctccgacattgggtgtcatcgagtagtgagcgaaggatcaaaacatgacattagcagagaaacttgtcctcaacctttccaatcctaatctatgtgagaaagcacaccttgaggtctcaaagggttgatagatctccttaccctaagatattagttaatttctaattgcctggttgattatttttgtaattgttcttaattgaataagtaattgtaaatcgcatattctacaattgacattacaacatcatggaaggaaaaacctatgaataatgaagcttcttgaaactatttttctgaaaagagagatgtttcaaaacctggctctgctgttgtggaattcttttggcacagttgcttcactgctccaggtatgatcatgcttgatcccacaagtaattagtaatttttgctgtgttgtactatgtacgtgttcagttttttttttgaggtcttctccaaaaaggtggttttgatgtcagccactcttagtaattgtcacaccctaaaattcccatatatataaattgttgtttaattagaattattagaattgattttaaaagcctagaagagaagatctaattttaaataataaattccaatataaaattgggccagataaaattttattaaatactttgcttgattctatagttcctagatttt

SEQ ID NO: 11768 - DNA, 1501 bp, Oryza sativa
gaccactagcactgaatggtgatctttttgccttattgtcatatatgccctcactatttgccatttgtgggttcatgttagcttaactcttttttttgttactgtggatatgcatatgtttgccacctcatcagcactcataagcaatcaacttagacagattttgctttgttctagataatttttgggggaaccagtagtgactgctagtgaattttatttttctgattcgatttcagttgattctgggatcaactgatttttgattctcacatttcagttgattctcatattttatgactagtagtgactagtgtcctcgtcaactaattttgctctcatattcataggattagatgttcaattaagttcaggattttgctctgttttttattggacaatgggtgatttggctaaactatgtgcttgtaaatataaagtattaaagtatatgtgatgggtggtaagtacataacagggggtgcttgacatggtgactaacaggactagtccatacatataaacaattttttgatccagtgttttgctactatgtcctgataatgtacaacatataaaaaattctcactacaccaagtcaccaaaaatgctcatacatgtgtctgaaaaccaaggggtagagagagagagagagagagagagagagagagagagagtaccttcagcatatagagaacgaacagcttggacggaataaaatctcctggatgaatagtatctttttttggcgcttttctgaattccattgtttcatgttttttgcataacctttttgatttccttgccgctatctgcttgtatcaatgatttctaataaatcagttggtcaggagctcaaggtgtctatgtaactgttgcgcagataacaaattccattacgtgactcaggcagtatggatgattttgaggaacatggtattagttatcgtgaagactcggactgtagcgaggcaaattgtgcaatttcagattatgttccaagcaaggatgccactggtgagcactctgcaagcaaagataacagctcggcagaatctgaaagtaacagagttgaaataaagcagtcttcagattctgcaataaaaaaaatggagatatactatttttatgataatgattttactagtctatttccctgtttctctttaaccgctataatgtcccataccatggatcaattaaaccaagcaaagtgtataaacttactaatcgcccgataggtttttttttaattcacatgtttttgtttctatcccctgccaatttcttgtgtttataatgtttcgaagtataaagtgtttaaagtagaatgtttgtaagtataaagtttctgcaactataaatttttggatgttgaaacttttattagtgtaaattttacaagtataaagttcctatataaaaaaatattggaatccgaattgtaatttgaatcgggtatataaacttttgacttataaactttaggtctacaaacttt

SEQ ID NO: 11769 - DNA, 1501 bp, Oryza sativa
gtaatgtcaattgtagaatatgcgatttacaattacttattcaattaagaacaattacaaaaataatcaaccaggcaattagaaattaactaatatcttagggtaaggagatctatcaaccctttgagacctcaaggtgtgctttctcacatagattaggattggaaaggttgaggacaagtttctctgctaatgtcatgttttgatccttcgctcactactcgatgacacccaatgtcggagcaagaaagatttttgagcccaggcaaacatcactataactatcatttgctacagaaatttcatcatcaatttattcaataatattaaaatttaatggacttttcaccggtgagcccgagcggctgcctgggctagttgggcgggggctccgcccctgatgacaccaactttagtgcctacctcctcacacggggatgaatgtgagaccatgagagaggagtgtgctatggaggaaaataaagtgttctttttgtttcatatagatgtatgcttgtataaatttctaggtcttagtttcattggtaacatgtatcattatttcctaatagtcttgctctttaagggaaggcatgaagcttagcacgcttggtgggagatgtgtgtgcacacaccctcaacattcaatctctatgttatgttggaatcaacctatttgcttatttcttctctactagtttgatattgagatcctccttagtttggttcattctcttttggctcttccacgggaaagttcccctttccttatgcttttttttgtttagtttgtaccttttagaagtatgtatgcaatgcacatgcctttttatcgtagatagctttgtcttcatgtaagaacaagggacgttgcaatgtgaataaagtctgttccaataagattttggatgtattttggtttactttacataattgtctatattgcagttaagcctattccacgtagatcttctgagttgtgcacactttttctcaacctagcatcttttaaacgtgcaaatgccaaaacccaagaaaaacaacttttggtcggttttccaaaagccattccacctctacctgtatgtagaagcaactagagtaattccctacacctacccctctccctatttaatttcaagcgaccagtggaaacatgaatcatgtgaactttaaacactcacccttcttctccctcccctctcccccctctcctacacacccctcctgttcccttagacaatttatcgcctcaaccacaattcttgtagttagaatgcctgatactgtgtagtagtctaataatctttatgaaaaatatccaaacctaccaaaggggccttactattgtattgggtaggttaataggcatttgcggtaatattgtcacatcaatgcatgccatgccacatattgtccaaatatttacttaaatattgcatattatcgacaaatttaatttaattttatacatatttatttaaaaattgaggggaaaact

SEQ ID NO: 11770 - DNA, 1501 bp, Oryza sativa
tcgtcctttttccgtcatttcgggcttggacaaggatcacttagcgaggagtactcatcatcctcgtcagctacgtcgttgtcggaaccattggacggcggcaccgttggtttcggagcaaccacaatagcaagggatagctccactgtcggatgtgaagactccacctcccctacagataagttatcttcatttcctttagtactatcggccatcgtttcgtacttctaacataaaaaataaactatataattaatatcgagcccacatgtcatattaacaaatttaaattcgcccacattgccatatattaacagagtaattaatatccgccgcaaactattttctctgtcatttcacacacttttttcccggatgtaggttttagtggaggatcactctcttcagtgccatcgaattccgactacatcttgtggtacttgtgatttgtgcgtaggaaccgtcggtgccgcatgtatacaagcttatttgaacccgggagaggggcggagcccaatgggccaggggttcttaggcaccgggcccaatttttatatttagcggttacaaccccccccccggcgcggaaaggcacgtggcgcacgcagagggagccgcagcagcgcacgcttgcgggacggcaccacgtgtcgcacgattttttccccaccaatttttcctattcttttctggttttttctttctgttttttcttttggttttttccttgtagtttttttttccttttttatacgtacgggacgtaaagtttctgtatgcgtatacaaagtttgtgtacgcgtatacaaactttatatatgtggccgatttttgtttccgcctttttttctagttttttctttttgtttttttcggtttttttgcttgcaggtcttttggttttttgttttttatatgtatgggatacaaagtttctatatgcatatacaaagtttgtgtacgtgtatacaaacgttgtatcccgtacgtatagaaaatttgtacatgtgtacaaactttatatatgtgatgtattttctatatttttgattttttaatatatatatatatgtataaagtttgtatacgtcgtatataaactttgtatacatatgcaaaagtttatatacgtgtgtatatttttgtaagtagtagtagtatagtatagtagtactactactatcaccacctagctgcgcgtgtgggccccactagcagcagcagcagctagtaatccaagctgcgtgcacgggcccgctagtagtagcaacgctagtaacagtagtagtaagtagtacactacagcagtagtagtaggaggagcggactggtcgcgcgctcgcgcattaggggtctcccattttcaccacatgagaacccctcagcccaaattcgtgcaccacccctagcccatgagcgagtcgtggaaggctaggcccatcaacacggtgcgtcgtctgggccaccggcgggggagagagcgacgcctcgtcaatccaac

SEQ ID NO: 11771 - DNA, 1501 bp, Oryza sativa
agagatggagcagaaaaaggtagccttctctccagatgatcatttttctttttataaaagaaaccagatagccatcttcattactgtcaaatattaaaaaggaataggggatcaaactttcaattgagttggtccacaagacatatatttactagtgaaaaataaatctagtgatgatcctaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaaacaaaaagttagaaaaatttatgtatagaaatactatatataaaaaatttaaattcaaattcaaatttgaatcgggtatgta

SEQ ID NO: 11772 - DNA, 1501 bp, Oryza sativa
ctcccgacgtgttcccctccaactccctccgcagtcccatccacctcccgcctgatcccttcccgcgccgccttgtctctcgttcgctgccgggacgcgtttgtgcgcgcatcggggacggggaggactaccatggtctgggacctcggtctcgcatgaaacacagcacctcgaccgacgaccatcgatcaaatggtgagcaaccagcccgaccttgtcctcctccgcgatgcccgctacaacaacctgtatctgtatctgactaacggtgaattgctcataacattattcagagtttgttcataatgcattattaagagttgagagctagatgattgttctgcatatcgcataacattattctgcctgatggattatttgttgatatgattcttattcctgattctggtgttcccgataacagcagaacttatgcatttctcatttcgatttatctttatgatggtggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagt

SEQ ID NO: 11773 - DNA, 1501 bp, Oryza sativa
aagttattagtgacagcatatactcaaccatcactgattaagtccaaaggggacacacacccaacgacgcacaggatgaacataatccggattgaattctttacataagtatatccaatcggttttgctaatttgcacgtgtgaacgtatcggaatcgggagtatttatatgtcaaaaaatatttttaggcgtgataatttagtgtatatgggtatttacataagtattatatgattaatgtacacctcaaaatttcctgcggcggagacgtgagcttctccaaggtgtggcccaggtgccacgctgccacgtgctgtgcgcgccgccgtggtcttgccccgtgcgagcagcagccgcagcggccagtggcggcgtctctccgtctcaagcgaagccgggatatatccaggtacacgatggtcggcggtggcgtcttgtttgctctctcttggggtatcacgcctggtactcaggtaccaagttctgatatctagctaccaactcgatactagggtataaggtaccagctggtacctgggtaccggatagcagttaggagtcacttaaagtaccctgtagtaacggttcccgttgtctagtctctctctatttctttacataccttgaatttttggcacagacactagttataatacgatttttgggtatatgacatgactgttgggcacatacactaaataaaataagacacatgatttttatgtatatgccttgaatatttggcacatgccctgaataaataatacacgtgatttttgtgtacatacgctacactaaatacataatacacatgaatttctagatacatacactaaatatatacataatgcaccgattttttgcatgtgccctaattttttttatcacatacactgaataaataatacacgtgatttgttgggtatatacctaattatttaaaaatgtgtatataccaaatatacctaatttttttaatgtgtatataccaaatatacatattttgttgggtatatgccttgaatgggtatataccaaatcgatgtttaaatgcgtatatatttaaatgtatatatacctaatcgatgtttaaatgtgtatatacctaatcggtgtttaaatgcgtatatacttaatacgtgtataaatccaaatctgggtatataattattttttccttaaatttgttcctcaaaattaaaaagtgatgggtaatacatacattttaccacatacccaaaaataaatctccaagaatttcttgccatatactctccaagaatttccagctatataccatgtgtcaatcacattccatataaaaaatactgcacaacactctttattttatatggttaattcctatcatatttgttgcctaaaaattggacatgacacgtacatccgtaaggaaattactaatcatagatggcaagtatagctatttatctaaacatgcatgcatatcgttactacccacaataatagggcaattgcatg

SEQ ID NO: 11774 - DNA, 1462 bp, Oryza sativa
aacggttccatttgccccttatgtcgtcggacccaggaaacaactctgcacctcctcgcagcatgtagatacacaaggagagtctgggcggcactagcggagtgggcgacgtgcgagcaactaaatcctagccaatggaggcaaacttcaacggtgctagattggtgggaggctaccgcaaacatacaagagacacctaagaaggcactccgcactttgatgttgttggtcgccttggagatatggaacgaaaggaatcgcagaaccttccaacagaaggagctttcagctacctcccttttagccaagatcaaggaagaggccaaaacttgggccttagcaggagcgagaagtcttaatagctgctttcttttagttagctcggaccaaaggtcctagctcctttcttttttcctttcgctttgtaaagttctccttctctattcaatgaaattggcgctcgtcgattcgttcaaaaaaaatagactaagctgattctaagaattcaaactttgtttcaaaacaagttgattcttacagtttacaaaaattatccaaaaataagttgatttatatatatcctcttatctattcttggtctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcagttatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgattccatcgtcgcatctgatctcaacaccactctacatacagtatctcttagccaagccaggtgtactaccacacactggcagtatgtacagtactgcatccagctatagctagctgcctatatatacggtgatatgcagacgcaggtagcagcatcata

SEQ ID NO: 11775 - DNA, 462 bp, Oryza sativa
agaaatatgacaaggcatggccttaaactttaatctttgcacctctctttatctcttaaaggcattagaaacatttaaagcttactaaggacaaagggggaatatttttttttggaaaccgaacgaagggggaagataactatataagtattccattatttgagagaggaacacaaaaatttcacacacttttagttataagcatgtgagtttggtgaagcccaaaatgctagtctatataggtgtcaatgggtcatatactcatatggtatcttcgaggatatatatacacacacacacagaggatgattgagttgtatttatatatttaatctttctagtgactatttttgttagaattaacgtatctatcattgttcttgtctttggatttaagacggtcctcaatggttatattaataattatgtaagactattaactaaaagcctctcttttccaga

SEQ ID NO: 11776 - DNA, 1501 bp, Oryza sativa
tgtatatcgcccgctttacggctttagacgctagcttatctagtacgcagaatatctgacggacgcagaggattgagacctggaagctaggctaaactaaacaggtagcgaaacgcaaccctttccttgacagttatccgattacgcgcctttctatcaggcacagcagcacgggcagccacaagattcaactaaaatttagttaactgcacgcctctttttcgtttacgtcgccgtcgccctatccaaattcgcccacgtttgatatagatgcataactgcaaagcgagaattccatttcttcatgcgtcaattggtccctctcgtcttctcctaggccacactattcttgaccatacctatgaaatcacaaaacgtatacgaccttatttggaacaagtttttatcaataaaccctttttgattttatacacgacaggaaacaattattctaaaattttctctactgtattgctaaccacttattttagctagaactttaaaaattttaatatattctcataattaagtagataacacgtgacaataatataaatcaaacgatttgacaagttttccggaaggaaaaaaggctgcaaaagccgatctggctgagtgcggttgtgtaactgtaacttttttcttctaatatatcgacgtacaatcgtttttgcgcgttcacgaaaaaaaagctgcaacctgcaaaattcaaaggtttgcgtgggagcttagctgaattccgccgatcaaattctgtttccacaaaaattgtccgctccgacggcgtccgcgcacacgcgcacgcacgctccccgcgccacaaaaccgggggaaaacgagagaaaaacgcaacgaaacgctcgccccgcaccgcacggaacatcatcatcatctcgcgctctcacgcggaccccgccgttgcggccgcctcacgacgcgagcgcgccacatggacatccaccatggcgccaccctttcccctctcctcgcttgtatatattcggcgcgatgccgtcgcagccggtgccttcgtttcaccctgctcggaaaaaaaatcctaaaagcttaatttctttctttgttcttattactgtctcacgtgagacgcctgagctcaactgaatttctggccccctcttcatctccgtgagcttcgctgccctttttctttgccttctcttggtggtttaatttcatcagttttcctccatttccttctttagccattgttccgattgccgtctcttgttgcatgtgcattccttctctgaaccgtgcccccccaattcgtccgcgagctatacaaatttggattcgttttgttcgtttccagctcaccctgtaaatcgtttctcaagtcattcaggcatactcacatcgcacaaacatatatataccccaagattttgaatccatcaatttgcagacgccataggcgtacaagttatccattcaagcgctccaaaaatttgccaagaagtttgccttaaatttggattca

SEQ ID NO: 11777 - DNA, 1501 bp, Oryza sativa
taaggtagacaaaaataaccatcatggcgactctaatattcttttctaggcaaaccgcagtagttacaatatcaatatgaaagaaccaggaataatcgactcttttaggactctgaaatatttatatcaaaaccatcccaaattatagtagacaagtcgacactaactaaaataatcgaaagttattcaaaaggacagatgaataagcccctgctaatgaatacaaaattaagagtggactttgtgatggttgacatccccttttccatggttactacggcctatagtatcttggcacttgaaaaattacgtggttgtcattgacaaacaattaccaccttgacaatgacttgcactattataatggggcagtcaatgggctatctctagtagtgttcaatttgaagttatgttataaatctgccgtccacacgacagtagtatatgcagattttccaaatacccgaccgatcaacttaatttgttggtattgatgtttgaaagcaaacaaaacattatcgccattttaaaatccaatcttaaccatacaaggggcgacagagaaaatgcttcgaaagaattgtgctaagaagtcaaattgttgctttctctgcagtaaagcttctcttccatgcgaagctgtaattgtttgacactataaataaaagaagtacagcgagaacaaggtaggatacatatatctaaaggataaataagagaaaataggttggcattcccaggaagagttcaacttgccgaataccaaaaccgctgtgtacagcctacaggttcctctgttcccgcagaattatcaactagttcttctcacttctcagcacgatgaaactaaaaaaactgaaaaaaaaaacaattgcctcttgcaagttgcaacaagtcctaaattctaatccttttctaggtatgccattttgccaagggtttgtccttttttaaccaaaagaaaaaaaaagtaccaaaaggcatgagcccgcccattaatcctcgttttcattgaaaacaagaaaccaacaggtttcttttgaaaaaacagcattattttcagtgtaagagaatcaagaatagtcctacgcatcaaagagaccatataggaggaaattgaaaggtatagtagctttattcaccagagcaatggccggggcagcggccggcggaggagccgtcgttctcgtgggattggaggtcagagcggcatttcttgagcaatttcttgagccgcttcagccccacgcccgggagctcctcatccatccccttcatgtacttctcgtacttcttggcaaacttcatgaatccaaatttaaggcaaacttcttggcaaatttttggagcgcttgaatggataacttgtacgcctatggcgtctgcaaattgatggattcaaaatcttggggtatatatatgtttgtgcgatgtgagtatgcctgaatgacttgagaaacgatttacagggtgagctggaaacgaacaaaacgaatccaaa

SEQ ID NO: 11778 - DNA, 1501 bp, Oryza sativa
cttgtgacgctgaccggtggggcccgcttgccggcgcggcccctcccctttgatgacgtcagcaaccctcttttcctttggaaaaataaataataattgcgtcataattcgttaataattctagaaactcatttaaatggctcaaaacttctaaaattcatatctaattcattcgaactctgaattgagccattcaacttgcaaaattcatctaaaattgagctctacatgtttgtttagtttttatgtactgtttccttggtttttattagagtttttcctcgttttgcgtgccagcgtgtagaatctgtcgtttcggaagttcgcggtcgcgaggataagagttcagaagatccaagtgaagaagcaaggcaagtcacacattccccttgagcatgttgatcctaatttataaatgttttactgtttgcaaataaacatgcatgttttgctaattacatggggttagggttttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgtttcatggtcgtaattatccaactaaaatgcgactgaatggtgggctgtgggtgcatggttttgtgagtcgcacccatggcaattaaggaccggttcacgggaaaccctggaagtcttacagcgcttgccacaagcgggagtgggtaaccgcttgatctgaagtatagctcgaccctttcctaggcaccggtggcgagggtgggcgtgatggagttgggtcggccggggtgtccggttgtctagctgccggattcaccgcggcgcaagaggggaccgcccactgccttttgaggagtgggggtgaaaccttagcgtggtgtggatggttaggggagggttatgcgaagggtctcgtcacaatcactcgacatggtgacgtgagcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccatgttaataaatcgacccaatacactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaagccatccttgtatccccttgcacgtctgcatcgttggtgtggcttgctgagtacggtggttgtactcagtcttgctattattccccctttttccagaagtgtagtgcttctgagctgaagat

SEQ ID NO: 11779 - DNA, 1501 bp, Oryza sativa
ggttctggcttcttcccatttataccgcattcgtcccacggtgctagttagcttgcacattaatcgatagttgcacacacgtgcttgagttgtaactgaacttttgtgcccacaaatttccatcccctttaaacagtttcacttgaccaaatgaaccacattagcatggtcagcattacaatttgcttgattgaaaaatggaaatgttccaggtgatgaatttaaaacattcacttgtattaaagctaacagttttatgttcctgtgctttgtgatgtggcatttgctagctacagctagctgtgaagtggattaattatggggcaattatttagtcatattggtaaatagatatagagcaaatggggtggtagctatatattttatatttcatgtttgtaacatatgtattttgtggtatatatatgggttcctgtgttgatggggtaaactgtgtttcaaacaatgctgtatttttaattcatatttgttgaagccttgtggaaaaagcgccaagaagtgaaaaacctctgtataatctactactagttggcatactggaatgtgtattcgttttcctctctgtgggttaatgctatctgacgatgtccgagagaagtttatgaccataatcacgttgttcatggaactgagttaactttaaactagatgcagatttgaaatgtatgtgatctccaccaaatgaaaaagctgtccatggttttgtggaacagttgactgctcattgttcataatatgtatatagataggtcaccttttttggcttctgagttgagatgttaaagcttttagaattttgatgtccttgatctagctttggagtgcctatttccttttactatttattggatgcatatggcctatttccttttactatttattgaatgcttatgtctgttccttttaattccttcactaaaattctctcctggtgctttcacatggtgtttcttccacttctatagtttatttcaagacatgaaaccttatgttgaaatagatagtgtatacgagtgagtaatgataatgatgttacttctgcagaacgctgaacatgaaagtcgtctgcgaaggtcagcacagtccaaagtgccatcagatcctaacatatggtttcagatgcgtgagaactatgaaaagataatccttgctgatcatgacttctctgaaaaacgtgagatagaatatcttctgtggcagttgcactacaaaagaattgaggaattccgagctcatattgtctctgctgggaagaacaatgccaatcctgatcggatcaagaggatcagatcttctgttagaagtttcctctcagaagcaactggtttctatcatgacttgatgctgaaaattcggtctacttatgggcttccgttgggctacttctctgagggtcctgatagttctgttgttcctgataaagatgggaagaaagtggttggggtgaaaaaaggcttgttgtcatgctatcgctgtttga

SEQ ID NO: 11780 - DNA, 1501 bp, Oryza sativa
tgtatcgggtaagatctcctaaatatatcaaacagcgatagcatgacaacaagccttttttcaccccaaccactttcttcccatctttatcaggaacaacagaactatcaggaccctcagagaagtagcccaacggaagcccataagtagaccgaattttcagcatcaagtcatgatagaaaccagttgcttctgagaggaaacttctaacagaagatctgatcctcttgatccgatcaggattggcattgttcttcccagcagagacaatatgagctcggaattcctcaattcttttgtagtgcaactgccacagaagatattctatctcacgtttttcagagaagtcatgatcagcaaggattatcttttcatagttctcacgcatctgaaaccatatgttaggatctgatggcactttggactgtgctgaccttcgcagacgactttcatgttcagcgttctgcagaagtaacatcattatcattactcactcgtatacactatctatttcaacataaggtttcatgtcttgaaataaactatagaagtggaagaaacaccatgtgaaagcaccaggagagaattttagtgaaggaattaaaaggaacagacataagcattcaataaatagtaaaaggaaataggccatatgcatccaataaatagtaaaaggaaataggcactccaaagctagatcaaggacatcaaaattctaaaagctttaacatctcaactcagaagccaaaaaaggtgacctatctatatacatattatgaacaatgagcagtcaactgttccacaaaaccatggacagctttttcatttggtggagatcacatacatttcaaatctgcatctagtttaaagttaactcagttccatgaacaacgtgattatggtcataaacttctctcggacatcgtcagatagcattaacccacagagaggaaaacgaatacacattccagtatgccaactagtagtagattatacagaggtttttcacttcttggcgctttttccacaaggcttcaacaaatatgaattaaaaatacagcattgtttgaaacacagtttaccccatcaacacaggaacccatatatataccacaaaatacatatgttacaaacatgaaatataaaatatatagctaccaccccatttgctctatatctatttaccaatatgactaaataattgccccataattaatccacttcacagctagctgtagctagcaaatgccacatcacaaagcacaggaacataaaactgttagctttaatacaagtgaatgttttaaattcatcacctggaacatttccatttttcaatcaagcaaattgtaatgctgaccatgctaatgtggttcatttggtcaagtgaaactgtttaaaggggatggaaatttgtgggcacaaaagttcagttacaactcaagcacgtgtgtgcaactatcgattaatgtgcaagctaactagcaccgtgggacgaatg

SEQ ID NO: 11781 - DNA, 1501 bp, Oryza sativa
gcagaagtaacatcattatcattactcactcgtatacactatctatttcaacataaggtttcatgtcttgaaataaactatagaagtggaagaaacaccatgtgaaagcaccaggagagaattttagtgaaggaattaaaaggaacagacataagcattcaataaatagtaaaaggaaataggccatatgcatccaataaatagtaaaaggaaataggcactccaaagctagatcaaggacatcaaaattctaaaagctttaacatctcaactcagaagccaaaaaaggtgacctatctatatacatattatgaacaatgagcagtcaactgttccacaaaaccatggacagctttttcatttggtggagatcacatacatttcaaatctgcatctagtttaaagttaactcagttccatgaacaacgtgattatggtcataaacttctctcggacatcgtcagatagcattaacccacagagaggaaaacgaatacacattccagtatgccaactagtagtagattatacagaggtttttcacttcttggcgctttttccacaaggcttcaacaaatatgaattaaaaatacagcattgtttgaaacacagtttaccccatcaacacaggaacccatatatataccacaaaatacatatgttacaaacatgaaatataaaatatatagctaccaccccatttgctctatatctatttaccaatatgactaaataattgccccataattaatccacttcacagctagctgtagctagcaaatgccacatcacaaagcacaggaacataaaactgttagctttaatacaagtgaatgttttaaattcatcacctggaacatttccatttttcaatcaagcaaattgtaatgctgaccatgctaatgtggttcatttggtcaagtgaaactgtttaaaggggatggaaatttgtgggcacaaaagttcagttacaactcaagcacgtgtgtgcaactatcgattaatgtgcaagctaactagcaccgtgggacgaatgcggtataaatgggaagaagccagaaccaagggcatatcacaaaggggacaagacataatgtgcacagttctgctgcattttccctaatggtaaaagtacatacagaaaaatgtcctacacacatgcatgaacaggtgacaaaggcaggtaacaaaagatgtttttaggagaaagaaaataaccaaagatgtaactattgcattgtttacaagaaaatataacagccctggacaaaccgacaaacacaattagacaattgcagttacagatagatgaaatagtgagcattagataggatcgtatgatctggtgcgaggaagacaaagcaatgcgatgtatacagcgatagcacacacagatagggaaagtcaacgctcagtaagcaatgtctgggacgaaggacagaaggaacagtcacatagagatgactgtaaacatggaatgagatggatggtgacaggagat

SEQ ID NO: 11782 - DNA, 1501 bp, Oryza sativa
ggcgaattacttcccgtgattccctctccctttccccccatttttccctctctctctcgcgttcaaacgggcggatttgcccccgcaaatctcgccggcgccattgatggcggccgacctcccgcgccggtttccttcccctccggccgctctctcccccttccaaccctatttaaaccctccccgcacttccttcgcccgtttccaccctttgccgtgccttctcctcgccggaatcgagctcgcgccatcgcctctctctccgccgtcgccgccgagctccggttcaccgccgtcgtcgccccggaccgcctcccacctcggcgccgcctccttcggcttcaccgcatcctcgccgacctcgtccacctctctgtttcggttgccgaccgccggagcgccgctgtccccgtcgacctgagccgcgccaccgcctccctccgctccggccgcctcctccgtcgccgccgtcgccccggggtgagccgtggaccgtcgcctcctttcccccttccctcccctctctcggccgccgctccgccgcgccggtggtcgccggcggcgatcatcggggcacaggcgcgccgtctcccgccgaccgcgccggcgtggccgccctcgggtgcggctgacgtgtggggcccacggcgccggccggtgtgagcccgggtgcacctggtccaccgtggactgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttattttccattggtcgtgtagacgctgcagcttcagaagatctgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgataatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggatggattattgtggaattggattcacacctccccctctattcaaaatcctcaaaatggttttaggctgggctcggggtgcatggttttgatagtagcacctcggccatataaggaccggt

SEQ ID NO: 11783 - DNA, 861 bp, Oryza sativa
tttaactttgtttatttcttaataattattatttgtgctctgaaaattccactaaaatttatttacgcattttaggcttttaggaaatttacaaaaatcctctaagccttatttgacttttaactttgcacattttaattgttggaggctttcacatggattttaattattctaggcatcatttaagggatatattttagagtcgttttgggacgtgacaggggttttgttggcggttgttaaatgccattctcatacctccaacatctgcataaagtcgagacaataaaacatccaacatagtaataggtgcttaatctcacatattccacaagtgttggtgtatatttgtatgcagatgataaaccttgaagttgggaggaaaatcagactaaagtgaggagaattatgtatccatacaaggaggggttgtgaacttcattgaaacatcagtaaatgaacccaaaactccgagaaatggaaacaggaaggcccaggaagtccaccaaccgaaggccagaccaggagggcccaacccaggttcggccgaaccctagtgatcaggggcggagcccaataagctgagggggattcccaggaacccggcccaaacttggaaatcacttgttacccctatagtttcaccatgtaggaaccccctcagcccaaaccaaggaacccccttcttgtccagcccagaatggaaaaggcccaagtaggcaagcagcagacacaaacacaggcaggcccattcgatggagtcctttgcgctgctcgaggcttgccctggaagcctcacaatcatgggagtcacgacgcggtcaagcgggcattagcacaacacatcgtttcgtcttcagg

SEQ ID NO: 11784 - DNA, 1501 bp, Oryza sativa
taagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcccggatcatagtcacccccttataaacaaggtatggactccccagcgacccccgtgggcttatctccgccacttctcaacctggtgctctgcagtgaaccatgctatacaaaaggtaaagccgttgcccacgctggtttgtggttggcacggttaatgtttcacaatagtagctcgcgaaccggtccttaattgtcatgagcacgactctcaaaaccatgtgctcacaacccaccattatccagttttagttggcaaataattaattaaccaatcacaagtaattaattaaccaatcacaattgaccatcgtgagctaccattaaatataaccataagtgatagtgaaacattagttatcccaattgtgtgctaatgtttctaagcatggcaaagcaattacctctaatatctagctgaaccaatatataaagctcaactagtcaaattataatctcccaaggtaacaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaatgaagaaaaagactaataaaaaccaaataaacagtacataaaaagtaaacaaacatgtagatcataattttagatgatttatgagacttgaacggcctcattctgacttcaaatgaatttattatgaattttacaagattaaatctatttaaagcccatttaaaaagaattaaataaatttaattcaatttatggacaattttaaaatgtagatctttattttacacaacttttgcaacttgaaccacattaaactgagttcaaatgaattagttatgaatttttaaagattaaatcggattaaaacacttatattgattttaattgaattatgacgcaataatgaattatttttaaaaaggaaaagaaggattattgcgtcagcggctagggtttgcggtggaccgggtgcacggcagcggctcacggaaacgaacggccgagatcaaccctatccaaaacggacggccgagatcaaacggtccacgaccggcttacggcggacgatcccgatgacgtcagcga

SEQ ID NO: 11785 - DNA, 450 bp, Oryza sativa
attcctgcagccctgaatagtagctacaaaatggattaagcataggaatgatccaatatatggctctctttttttaaaattatgtggtttaatgcatgttgagctattggctataggatatataaataagccagaaaaataaacatcaagttgcattcactacctgcccagatgaagaaagtatgcagctgagctgtgtgccaaagactattaaagtacagtgtgaatacatgcatggaaagtttgcgacaattgaccacttaattatatttagtggaagtaattaacatctactagaagcaacgtgacagtgcaggaccaagtctaaagtgtctttccaacctcgatctctcgtaatcgagcttagctatagctctcatgatttaactgctataaatacctcagcaagcaacaagtctcagcacaagacattaattaattagcttgaga

SEQ ID NO: 11786 - DNA, 1501 bp, Oryza sativa
ataggcactaaatttgtactaagcattagtcttgacaaacttctcaaaattctcccctgacactaacagggatgataatcttaatatttatgagtgatatgccaaacataacattatattggccttctcccaggttaaagatgcctcttgagtttagggaaaattagtcacaatagctgcgggagccacaaggaatcctttgtgatatataggacctgatacctgtgatactcgtgcaagagaatagttaatatgtctattccattacaatgggatcccgttttgtagcagccctctagagattaacctaaacaatcaagactttcctacccaatcaagagatgcagagtactcaaagctaaatgaactaattacgtaaacccacgcgtacgagacttacctaccccttcgagtctgaattttatggcgttagattgatttcctggttaatcgtcactcgtgaactatacgtctgaatggtacccttatcaagcttggatatcagtttcaagctaccagtgcttggacagcagtaaacaagatgtacaccacttgaataattgtgtgtttaattaacaatgctggtaccccatcaaggatttataggcactactacagaaaaggatatgtgtcggttgccaaccacatatgggtgccgaatttggcaacaggaacctttttgagttctctcaaatgtgccggtttaaggtcctaggaatgaaaaaaaaaagagaccggctcgatgcatgcatcgaataagtccccttcaccccaaccagatctgattacacttttaattacatttaatccaagaaaatgcaagaacactaataacacaagaacatcaacaacacaagcaatgagaggggaggggagggcgctaccgccgggtggtgcggtggagagagagggatagggaggaggcggagaggataagggggagagaggggggtaataaaaagagtgagtgaggggcgatcaaaagggagagatataggtggaaacaagtcgtgattcggcttattctactcagtctgtcggttttcttaacaagtgccattttttttataaaaacaaacctacaatataaatatagttatcggttcttgaaaaaccaggacctaaaacatattataggtaacggtttttatttaaagcggaccctatctctcaacaaaggtaccggttctagccgatggtgtgccatggatgcgcgttttgggtggaaaacgcacaatagctaggtttcggttttaacatttccggcaaatatactgccgatcgttatgttattgcatgcgcttctacaatttcattcaccaaaaggctaatatgctggagtgcatgctagcatgatgatcaacattttaaatcatttgcgctattctaagctagtaataggtatgcactgtgcttttgctagccacctaatagaaacaaactaaagggactaaaagtaacgcactgatctataaatatcaattgtttgtacaactatata

SEQ ID NO: 11787 - DNA, 1501 bp, Oryza sativa
gtatccttaaaaactttacacccaaagaactaaacacacccttatatgtgtacactgccttagccaggtgagtgcagtagtagtattgttgcagcgaagtacttcctccgtcccataaaaaatcaacttctgggaatgaatctggataagcatttatccggattaatcgttagagttttttttttggacagacggtgtagtgtgtttactgtttcgcacgctaccactctagcagtggcatggcatggcagcacagcgcagcgccaccccgaattggtggtgactgggggtgatcggcgaaccgatgctccaagctcaaccatgccaaaaaaaaaaaaccgcacagaaagaaaagaaaaaggtgaccataaaatcagaggaacagtagtaggcaaaaaaacgtctcggatcgaagaaaaaaagatctggaaattaatatactagcatcagctcgtagctggccgccgatcatcatgatatatacatatatatatatcgatggcgacgacacgagcattgcatcatcagttcatcacttgcaaagttgcaaattaagagctagcagtgaagacgacaattaattaaccaagccattgatatcaatagagaagaagaagagagcgaggggaaattaaaaaaggaagaagaatttatccccccaggtgtgtggcgtccacagtaccaaacacacaacacagatagcggcagctcaggctaagattttgccttcattttttttaatgcaaaactcaattcatcccttaaagggatatccccttattttttttgcatatcacttaaaagtcataaaaaaatttgaaaaaaaattagttggatagatcaatatatgatatatcacttcacaaacatacaaattcaaattcaacttatacaagtagaaaaaaataacaaatttaactatgaatagaacgtgcaattcatcatcaatttttttatttttgtttcgaattgtataagtcaaattttaacttgcatatttgaaaaagatatactatcatgtattgatctattgatctattgatctatcttgataaattttttaatttttttataactttttgaacgatacgtacagaacgagaggatgtatgctcgagggataagaatccactctcttttttaatttcatttgaggcatgtggtgatgagctaggctaagggatagagcggcacactgaattgaagctagcacacacatgcaatttcatcatgcaatacacacagcgaacaaggtggtcttcctcatggcgggagggatcggggtgggtcactacaccttgctgtgcgggtggtcgtcgtagagcagcgtcggcggcgagaacaccgagtagctggtgtccagcagctgcgacctgaagacgtcgtcgtcgtcgtcgtcgtagccgcccccgcccccgccgccgccttcgtcgaacgtcgccgtttccgccggatgacgacccggcgccgcgcccgcctcgagggcgtcggcgtcgctggc

SEQ ID NO: 11788 - DNA, 1501 bp, Oryza sativa
tgttataaaccagctataaacatattttaaagagataaaaaaagctattaaccagctataaacatattttaaagagataaagaaatagagagaagagcagcgggttatggatctatagtcaactgcagcacggactctaagacgtaatgtgtgtatgacaggtgggaccagatactaatattataataagcaactattgtatgaattggctatagatgatttatagtcattagtgggctgcactattaaacttgctctaacaaacattttggcaagttggtgtgactttttttttcgagaaaagacggtgtggtaatgatttgatatgaacgtacaggtaggaatgaaaacgactcaaaaaaagacgggaaccagatctatcattttcgttccatgttttttattaaaaaaatagaaatagaaaatcttgtgtataaaaacggaatagaatattattgaatgtgaaaacatgatgaatatttattggaaaccgagttttcaattttttttctaaaacaatatataaaaatttaaaattttagcagctaatagtaccactttccactttgtatcataaggataacatcacggtttaaacactttatcaagtccaatttttcatctttgagacggtaaacattctttggaaaaagttctaaattagtttttgagatattctctaagaaagtttccgaccgatttctctttctgttagatagtgctatttctgcatccctttttgtttccaagaaaaaaaaatccaaatttgttttcggttttgacactactggaaaaatcgttttttcaagcagccaaaaatagttttcgcaggcagaccgcctgtatgcaaaggcatgcggaaatagatgatttccacatacgggtcgtgggtccgccaggcgacatctccatctttgtaggcagtagattcacccgcctgcaaaaaacatttcagtgaaataaaaaaaaggcgcgccaccgccagcctccccctccggccaacggctctcctcctccatctgcggccatccccacaggcattgatgccgtcgtcgtcgcatcggcgccgttggtcatcgcgcggcgtcgggataggaaggagccaagccgccgcctctcctcctcgtcgccactgcctccactccccttcggaagaccggccggcggtggatccacacgcccggggtgagccggcggtagatccatagatttggtcattttataatccttcaaaactaaaatttttgggtattttacacatttcaaacgataatagcatggtaatggtgtgggaggtatcactaaaatcataagtcacacggtatattgttagcgtaccatgtgtaatggtgtgggttttccgaaacttattggtcgatacgtgcaaacaaaccgtttattatatgtgttttggaatccttcgtgtcgacatgatagacggtgaggaactaattacaataatgccaatatctttaacgttcacttcgtcaccaaatttact

SEQ ID NO: 11789 - DNA, 1501 bp, Oryza sativa
ccgcccacctccgcggccacggcggccgccgcggccggggccgctgcggcgtggtcgtcgtcgccgcgcttcttgcgcatcgagaagctgaacggcttcttcaacccctgctgctgctgctgctgcagcggctggccgctgctgttgctctgattcttggggatctgggagagcttctcgtacagcggcttcaccttcttggcgtacttcttgatcacctccttggcgagcgacttggacggcggcttcttggcgttggcggcggcggcggcgggggcgggggcgccgccgcggtggaagacggaggagaagcgggtggcgaacgacgagaggtactgcttgccggtgcgcttggcggcgaacgaggcagcgacacccggcggcggcggcggcggggcgaggtggcggtcgtcctcggtggcggagctggggcgggaggaggaggcggcagagtccgggagcagcagcgcggcgcagtcggcggagaaggacgacgacgtgctgccgttggagtcgcgggaggaggacgagttggaggtggagtcggaggccgacgcggaggaggtcgacgccgacgagagcagcagcgtgcgcaccatggagatgcgcggcgacagctgcagcggcaggagctggcccttgtagaacagctcgtccgccgggcacagctgcgccgccgacctctgcttcgacgccggcgacagcgtgaccgtgaactcgaactccgacgacgacgccgacgacgacgacgccggcgacgggaacgacctcccgccgccatccttgcctcttgacctgcccatggtttctcgctgctgccacgtaagctacgggctcatggcgcggcgggtggaggaggaggaggagtggatcggagacgagggcgaggtgagcatggcgaggcgaggtgggagggaaaaggtgaaaacttttccgggattacgagtctgaccgctttatgaggagaagatgcggattgtcgcatgtgggggtggcccccgaagccgttggatcgattccggatcgcgatcggacggctcaggaggctgtcctggctgtagcccaaatacaaaatgaaataattagtggcaaaatttacaaatacccccattgtttttcagctaataatcgggggagttggctagagtttttagttactttattttttagaggcaaacaacaacttcactcttgtgcgctaaatctttatgtaattaatttttagtttctttccccctccctctgtgcctcccctttgtaaagtgtttttttaaccaaatgaataaagttcaggctagtgttcaaacccgccgtagtttaaaaaaaatagatgtatgttgatactccctccgttttttagaaaaaaaggcaatatcggatgggatttgaactcttatagggttgttcaaattcgttgtttatattacttcctctagctcataatataagatgtgcgaatattctaaaatttaaatttaaaaatatttgaccaacaactatt

SEQ ID NO: 11790 - DNA, 1501 bp, Oryza sativa
tggatgtataattttttagattttgtgattcattgcatcgcatggatctaagatgtataatttgtataatctgtgatgtatttaatttgtgtgtagtttttaggatttgtgatgtagttgatctgtgtgtaggatttgtgatgtatttgacttgtgtgtataagtaacttaatatttgaaatgttgatttgggatgtgcatctcattcgattcgggagaaaatacatagattaacactagccattagcaaatcaacaacaaaataataataataaaaagatctcgaggaactgtcgcttcccctctttagtcccgattggtaacaccaaccgggactaaatattccccctctttactcccggttggtaacaccaactgggactaaagatcgagttccggttatttgaaccgggactaaagatagcgatctttagtcccggattcgtaatcctgattgaaaaatcgggactacaaagggttctaaaccaaaagtaaagagcatttctccaccagtgatagcaccttaatatgcacattcttggaaattattagttgactaactaaagcacggtgcaaaaatatacatcttctaacacactggtttactgattaccaatttcagctaaattacaatgaaatattataccgtgttcatttctccaacaacggttggattaaattttggatactcgtggcacgtttttcaaaccgctaaaccgtacgtttcgtgcgaaatatttatatatgaaagttgctctaaaatattagattaatctattttttaagtttataataattaaaacttaattaatcacatattattaccacctcattttgtgtgaaacacttaattttcaacttcgtcttcggaatattcaaacatcagtggtagtgtcattattggttaacattgcagttttttcttgaaattgacgtgtacgcacactaacaactgcaatgctgctagttgtagtgaagttgtcgtttactgcctgtgatttatgaagagcaattgatgtgctgaatctgctgatccgacacgctcactacaatgctgctagatgtacgccctccgtcacacaaaaaacgaatttagaattaaatgtgacacattacagtacaacgaatccggacagatacactgttacaaatcatcaaataggtgtcgccactataggtgccagtagtgctaaaaccggcacctataaacctttacccacctccgcggattgaaatcgcaaaaaaaggcacatttaagtaattataggtgtcggttccaaataaaaaccgacacctattatattttgtgtcagttttttttgtaaaaaaggcactacaaaaaccgacacctataaaaaattatatgcgccgattttttaaataaaccgtacccaaatcgagatgagccggcgggccccagcaggacgagataaggataagggtgccgctagtggcttctcgatctctctctcgcccccccccctctggcgtcgtcggcagt

SEQ ID NO: 11791 - DNA, 1501 bp, Oryza sativa
cgttttaaattggcacatactgtatggtttaagtatgtactccgtataaacatatctttctttttttctttaatttttttttcatcgagtgctctctctgatccagatacgctagattggacggcccgagcatctccaacagcctctccatcagactctccaagttaaattttggcaactttagcagaaaatagtactccaacagactctctattcagatggccaagtaaaatgactggtcaaactcctctcccaactagccaaatttggccattcaaacagactagccaaatgtgggccccaccatctctctcctctctcatgccatcctccctctttgtccggcacagttgggacatgcggcccctccctctccgtcgttgtccccatctccgcccgtgcccgccgtcgcgcctccgttgtcgtccccatctctgttgtcgttcccatctccatcgtccccatctccgccaactccgtcgtttgcgagggagcatgaggactcatcgcttgccttccccgacgcatgccgctgccgcctccccacccagtaaaaccccacttctgccgccgcgccttgccaagccaccgctgcaggagagtggcacgagggagcggcgggctgcccctgcccctttccctcgcccacgagctccatatccagttgcctctacatccgcgggtctatatctatggaggtgaactcctcttcctccgctccgccgccgtcgccgccctccatacccgcctccagcgcctgggctgatgcctcgctgctcctcgatgccgcgtgccgtggtatgccaacgcaagagaagaggaagaagggaagaaagaggaggaagaagaaggaagaggctgacatatgggtcccggtgtcatagagtcaaagtagagagagtggatggagaggctgttggagtaaataactagtttgactagccaaatcggatggagagttggttatataaatgtttggaaagtctgattttgagaggctgtcagaaatgctcttacaagttactccctctgtttctaaatgtttgacgtcgttgatttttttaaatccgttcgtcttattcaaaaaatttaagtagttattaattcttttcctatcatttgattcattgttaaatatacttatatgtatacatatagtcttatatatttaaaaaataatttgaataagacgaacagtcaaatatgtgcttaaaaagttaatggtgtcgaatatctagaaaaggagggagcacaaagcatttgctgctgtcttgctgatcacacctttcctcgtcgtggccgtccgattcagcccagaaggccagcatccaaccgtccataccgctcgttgccctactctttgctcggctcgggtgggtcccactctcagtctcagccgacgccctccttcctcccctcgcttctccgccgccacttctcctcgccctcgcgcactccaccgccgccgccggctctcgtctccgtctccaaccaaagataa

SEQ ID NO: 11792 - DNA, 299 bp, Oryza sativa
gcacgcacgtcaggaacgcccgttgggttatttccggtcgtacaagttggatcaaacgaaaatttcccccccttttttggggaaaaaaccccccccccccctttttaaaaggggaaccggaaaaggccccggttttaaaaggggaaaatttcccccaaaagccctttagcaatattttcaaaaataaaaatcctttgttatttgtgaaaactgtctagtctctctctgtcttgctgcttcacttatcatcaaaatctgacatttgaaatcttgcttttctttttgtttttgtttgtaga

SEQ ID NO: 11793 - DNA, 1501 bp, Oryza sativa
catgacacttggtaaccattgaaaaaccaagccaatccccaagatgacattttgaggatggccaacatcaaaatattgctcgggcatggcaagaagtgaggaaaggttgggctgatgagataagatctcctaagagatgagaaagggactcagcaggaagaggaatgaatcatgagagaaacacaaaggtcaaccttctacaaatatggaacatggattcttcacctcgataagtatctctgactccagaaccgtgcaatccagcccatctaacgggtgcacccacttacacttccgtcctcactttttgtaagagggttaacccaaagagtgatatgactggagggataagaccttataagttgatttcattcttgctagactagcaatgcagtactaaacatgcgtacacaactctcacgggccatcaaaattgggccgcatgtcacactaagcctctgggtgatgtcatctagcaacgccggatccatccccttcctctgacttcttgaacccaaaccatcctctcaaaacttctcagaaacacatgagcagtaacagttaaataacgaactttacagcaagaaacttaagcggaattgaaatttttttcctagagctctggaggcactgcaccgctgggggtccacctcaaagaagccatgctatttaccggcgaactcgacaaactccacatgttccctccatacctccctttagcgcttggtggggatggactcctgtgcgactatctgatgctcctagcggatgcgcataactgacatcaatgtcggcacggtcccgccatggtggctactgaagctcctccccctcgtccctgctctacaagaaagatggggggaataggatagagaggggaggttaagactgcaatgtcactcatgtgtgaggcacacttataatttttatttatttctaaattttaaggtcagtacgtaggcaccatgtaagctaaaaaccatcctccatatttccttaggacatcgtttacactagttttgggagatgagggatgcattgtacccggttctgcgcgcggtcgaggaccacgatacaaactcgacggaaagatgagggacggacgatagacttattacttattcaatgcggaatgtgcagttagtgttatcactgggcctgatctaagtcgaccgggccatgcttccgaaagcacatctgacccgaaaggcccaactgtagcccaatagactaaagcccagcaaattgagggcatacaccgtcatcatccggcaggcacgttcacacgttcgcccatatccatcacccatccatcgacgatgacgcgcatccgatgtgtgtgtgtacgtgcacacgtcacacgtctatccgccgcgcgcggccgcacacgacgtcagtcaagcgcggacgcatccatcatatcatgcatgcatgcaggcgttagttaccgaggcggtcatatccatccatccatccatccgtcgatggtgaggtagtggac

SEQ ID NO: 11794 - DNA, 1501 bp, Oryza sativa
attttaatggtttgttccatattttgtaaatcatggatttatggtttgatacacgttttcattgattcttctacgaccaccagccaggtaatttcaagctattatatatatactgatgctacatattactcaacatgatttacaaaattagaaactgtttcattccgttgaaaatatatttttaacagttacgtgggatatgcatggtgttcattattttatatatcatgtactaagaacatattgatgctcttcatcaaggttaaaaggtggatctacttccctttttcttttattggtggctaaagtagattgatgctaattattgacaagctggcaagaatattgaactctcatatctgcagaactggctacaaattcataggttctggatcatggagaagtaaaccttgatttctatttgtttttttttcatggccgtcttagtatagattgtaaaatatgtacaatataagttgcaattactacctgtgatgtgctgacacagttttgattgactatccttctaattaatcatcgccccattggtcttcctgggtacagctaggtattgaaatacaaatgttgtttattttactcacgttgttgtaattgtactatgcaccgagatacccattgttagtgtaacattgattataaaaaaattatggtacgattacatcaatcaaaattcagaacatcgtgatattctatcgtgatattctttttctgatcgagttgttgttgtatagcactgttgcaagctatgttgttttcaatcatgcttttttttttcttttatgattaaagatcttggatgatgcccgcgcatcgcgcgggggggcacggctagtagtattgcaaactgagcggacgtaacgaaatttctcctatcacggggcacatccatgatagcctatatcggttacattgacaaacgctcggaaggccggagggcccgtttggttggggggagtttttagaaggaattgggagtttagagggatgaggctattaactgttttgtttggttggaagacatgtgaattttggtgggatggggatggggaattgaggaatgaaatctctccttttcaatacctgggtaggggtgtggtaatttggagggaattcctcctttacttcgcctaaacaaatcttagccatccgttttcattaatgatctaatctccaacttaactccctattaatttctaccacctctaccaaataagagactgagatgaaaaatcaaattcccatcttaatctcaccatcaattacctcgtataaactcccaatcccctcccctcaagttgccaaacaagctggaaagggtataaaactataacgggccctttcttgtttttctagtggggacaaggataacggcccaagtaaatccaatctgaagagaaagcatcgaacgggccaggaaaaggcccatacctaggcccacacaaccgcgtcccctaccggtgccgtcgccggctgcccaaac

SEQ ID NO: 11795 - DNA, 1501 bp, Oryza sativa
ggttctttagtgcgtgggtacgcaatatattacatactacaataaagtactctcaattggtcctgtcattttttttatttagtcttatctaaatgtttaggttcaattgacaaccaaatcgacttttgcaatcttctgccacatgaaatgccatgccacctgataggctgccactatctatctattatattattaaaacagctttgaaaagaagcaccacgttcgctctgggggctagaaattcccacattaatcggagaaaaagaaaaaaaaagaaaaggagagtccaagtaaaaatacaatctaaaaatagctgaaatttggaattaaataagcaatattgaaagaaggttctatataagaacccaatacgagattaatcaaaatttgaaataaaaataaaataaaatccaaaattagaaaaaaaaggagaatccaagtagaaatacaatctaaaaatagctgaaatttgaaattaaaaataaaaaatattaaaaaaaggttccatataagaacccaatacgagattaattaaaattgggaataaaaataaaaataaaatctgaaattagaaaaaaataaaagagagttcaagtaggaatacaatttaaaattagctgaaattcggaattaaaaataagcaatattgaaagaagaatccatataaaaacccaatacaagattaattaaaattcagaagaaaaaaataaaataatatccaaaattagaaaaattaaaagagagttcaagtaggaatacaattttgaaacaactgaaattaaaaataaaaaaattaaaagaacacaatacgatattaattaaaatttgaaaaaaaataaattctgaaattaagaaaataaaaataagatttcaattaggaatacaatttataaatatctaaaatttgggataaaaataaagactattgaaagaaaagactatctaaaacacatgacgagataaattaagtaacatgcctataaaagagtagagtggtggcggttgatatgtcatataaaaattgttaataaaacaccaaatagatcctaatgacgattaaaaagaggagggacgactggcaggccgtgaagcaaacgagcaaggcggttgccaggatttctaaaaagtaaaaaaaacccattgattatcatattcgatttttaaaatatcaatgcctataaaaaggagaagcagcgagcggagtgtataagagtatagttgcagagccgccaacggttgaggagacttttagaaaataaaaaataaattccaacgatagttatattcgatttctagaatcacaatgacaataaagagtaggcggcggacgggccgtagaggagcatagtggcatcgttttacgggacttctaaaaattataaaaaatgaaacccaacaagacaataaactctataaactataaggtccattttttaaaggttcggaacttctaaaaagtaaaaaaaaacaatgataatcatgttcgattttaaaatctcaa

SEQ ID NO: 11796 - DNA, 1501 bp, Oryza sativa
ttcttagtgccactgacgtgtggggcccgcgtgtcggcgccggctgccccttgctgacgtcagcgaggtccatttcctttgagaaaatatttaataattgcgcaataaatcgagtttaattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccaacgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatcagggtttacctatctgctcgcttgtgccatgtttacttgatatctgtcctttgtcaaccttgggtgataaatcgactagcttgtgttacttaggtgacctagctagaactatatgcttagccatgcttaattaccactagctcagtcgatgggataattgcagtattagactttctagtatcttgttgagctgcgtgctcgagacatctggccatgttttatggtcgtaattatccaactaaaatgcgactgaatggtgggctgtgggtgcatggttttgcgagtcgcacccatagcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagttcaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagat

SEQ ID NO: 11797 - DNA, 1501 bp, Oryza sativa
tgatgggttatttgcatgaatttcgttggattggcatgcattctttggcaagcacccaggcttgagcttgcatcatagttttttctttgtatatgttcgtccgtccacacttcgtacacacatggatgctgagctcaagccactcagtgctggcagagctcgagcgcgtgcagcgtctttgggtattggctggccggagttcagggaggagcaagaagggatggaagagatcccaaagtttcactttggaccaccccttaactcatgttttcgctttggactaaataatattcccttaaccgttgcatatctggttgaggtctgtaaatcatgtttagagagttttgttaatattcgatgttccatagaccataatgtgtaataaccttgaggtttgattctatgaccaatatacattgccccagtatgtcaaatttttatggttattagacttgatgtttttagttaactgatatgcatcatattaccaaatgttgtacctaaagttggttctaattaatctctttcctggctttttttttttagtgatgcagttgggttttatacgtgacaaatggagaaatgagtacagtagtagtagttgtacgtagttttatataaataccagagtgagatggctggctaggggtgggttccactcccaatggcatgggcgaacaccgtccggtggggtgggtcacagcacttgccatggcacacgaaaagtgcgggctatgaaaggttccagaggcgtcgatgtgagatcggacggtgcatcggaatgggtgggtccacaagtcagtctcaccgtacccgtacgtgacagaagtgagcagtgtataaataccgcgagaggagaggagattgcttgttgctacagtgttccattcacctttttcctcctcgcctcgccgtgacaagcgattggagagcgccgaaaggtgagcaacaaaatctctccctctcctcctctcttcttcttcttcttcttcttcttcttcaattcaatctgtgtcctcgctgcgatcttcttggtggatgtagtgcgagctgtgttgtggtggtgtttgcctgctctgcttatgtatgtgctgatatcttctctgggagatggatattttttttcgggttttgggtgatttagtggttctggttggtttattttcgccgatgaatcggaagtggcggacgagcaccgcaatttcatggtgatctcggttcgcctctctcctctccgtgcttgcaagttggaagtcgacgagcgagtcatgctcgttcgttttccaccgcgcgccggatggattactctggatcatcgtgtaattctagataattgctggtgcatgtgagtgtgacgactgaggttggagagtagttgtgcgtttgtttttgttcattcttgcgttgcgtacgtgttgcgatcgatcgggttttggtttgttgcgtacgtgttgcgatcgatcgggttttggtttgattttgccgatgcgctagtactagt

SEQ ID NO: 11798 - DNA, 1501 bp, Oryza sativa
  unsure (1)..(1501): unsure at all n locations
ataaaagaacctattgagaccacacccttcgtctcacaaaaaatcaagcacatctccaaaactagtctagattcatcgctagaatttttttcttctggaacgaagagatgttatagtggcatacaacttcttcatccttcctacttctttctctcacccatctctttccctcacctctctctccaacagggcggggagcgcgatggtcgagctagccatctccaccctgcgacccccggacgaccccattggtcccagtcggtgcttcatggttgagttgtcatccttgccttgtggcccacatggctgagctcgacgtcttcaccccgtagaacccgacggccccatcaatctcatcggccttcgtcgttgtctggccctttcatgggacagatgcagtggaggctgttgggcggtttgcgggaatgaccccttccaatctagtggcacgatgacgagtagcaatagcagctacgcgatgctatgcctcagggcgtttcggcctaccagagacaaggtggtgaagatccaattccaccccacgcacccctggctcgtcgccgccaacgccaatgaccacgttttcgtttaggactggcggtctggcgccatttctctctaagtcactgtctcacatgaacccactaatacgtgggtctcactattgtcttcttgtttgactgacgtatgagcccacatattttttttagtttttaagtttgctcttttttttggatcaaactgccatgtaagtgtcacgtcaatgccacgtgagacgaagacctagtcaaataagccacacatgcgctatatcaatcaaaatactgccgcgggatcttgtttgcactggttttgtataagtcggggacgaattgtgtctggtttttcagtttaaagacgacaatcggattgatcgtcaaattaagggacatcaaatgaacttattttcgcagagaaaaatacggcccagcccaacaggacctcctcttaccaagcggccacactcccgaccaatctacaccatccgtccccaatccaacggcgacgcaaccgacaccacccccgcggacgcggccgccggtcgcctggtccgttcgagccgcctncagcctataaaaaccccggctccctctcccctcccccctccccttcccccccaaggctactcgcctagcgcccgccacctaggccggggcctcatcccccccaccttttctgctcctctccccaataaaattccccgcacgaatcgatccccccctcggatccggatcgcctcgcccaccccctttccgccgctcgtcgatcgcgatttttttttcttcgccggatttttttttctcccgatcggtggggagggctctctctctctctctctctctctcttcaccctagggttagggggagcgccgccgcatttcggtccgccgccgccgccggagtcgaggagctagggttttcgtcggtcgggggggggaaaaaggtggggggttgagattga

SEQ ID NO: 11799 - DNA, 1501 bp, Oryza sativa
gcaagcagacgaccaccaacctgctcacatgggccaccgtgctgctcgccatgcacccggactggcaggaccgcgcccgccgcgaggtcctcgccgtctgcggcgatgccgccggcgagctccccaccaaggaccacctccccaagctcaagacggtacgcacaccaaaccatatccatggcccagtgggggtattcccgtaattccacgccgacaaaagtctcaccttgttggttctcgctgtcatcttcttccagctcgggatgatcctcaacgagacgctgcgcctgtacccgccggcggtggccaccatccgccgcgccaagttcgacgtcaccctcggcggcggtggcgacggcgacgccggaggcatccatatcccgcgcgacacggagctgctcgtcccgatcatggcgatccaccacgacgcccggttgtgggggcccgacgcggcccagttcaacccggcgaggttcgccagcggcgcggcgcgcgcggcgaagcacccgctcgccttcatcccgttcgggctgggctcccgcatgtgcatcggccagagcctcgccatcctcgaggccaagctcaccatggccgtcctcctccagcgcttcgacctcgcgctctcgcccacctacgtgcacgcccccaccgtgctgatgctgctccacccgcagtacggcgcgccgttgatcttccggccgcgccaatctcagccgtccaattagctactattactaggtaggagtactagtattgctagctaggaaaagacaggaaagcccctgtccgttgtgtgcatagtgacacaggaaaaggccaagagacaactaacaaaaggctctgcccgtggcaggggcagggccggattccgaaaatgccctcgctaacagactagtggtacgatcagagcacaacttttagggatttgatgggtcagaaactctcagaagagaagaagagagacagtagtagggtagtagcagtagccccacacatccactgctcggttgcttccatttgttctcttctccttcgcgtggattctggtgtatgtatcgatcaatgcatgtacctgtatgtgtgtgttgtgtacaggggtgtgattattttgattcgggacacccggcacttcacagcaaaggagaattccatttggaaaaaacatacaaaaaagaaaacatagagagagagaggaagggagagatcgagatttgattaattggttgtacacggtattccagccttgtgctcctctcctttctagcgtctggtcggtgtggttgttgtgttgacaatctattcattcatcgatcgagtagaatctgtaaccgaagcctgctggagtagctcctcttcacatggtactggtactagtagcagcagcagctgcagcatatcttattgaccaatgaggttttgatttcatcaatagctagaaagcccaaacatttagggaaatgtttgtgctttagggactctcgttagatttttgactttccga

SEQ ID NO: 11800 - DNA, 1501 bp, Oryza sativa; identical to SEQ ID NO: 9880

SEQ ID NO: 11801 - DNA, 1501 bp, Oryza sativa
tctgttcttcactgataattgcttaatgcttagcgcttgatttcctcgatcttacaaggaagaaatcgaaaaagatcggctgcttcccctgctctcatgcatccttctagggtcatttctctaccgcaacagcaatctaaaatgttactaatttattatattattaaaggaatagaaaaaaaagtctccacgttcgctctcatggcctagaaattctcacattaatcagagaaaaagaaaaaacagagtccatatagaaatacaatttagaaatagctgaaattcggaattaaaatataaggaatattagaagaagagactagagtccatatagaaatacaatttcgaaatagttgatattcggaattaaaaaataaggaatatttgaagaggagactagagtccatatagaaatacaattaggaaataactgaaattcgaaattaaaaataaggaatattagaagtagagtatagagtcgtagaaatataattataaaataactaaaattcgtaattaaaaataaagaatattagaagtagaggatagactctatatagaaatacaattaagaaaacaaaatagaaatttagaattaaaaaataaggaatattagaagtagagtatagagtccatataggaatttaaaactaactaaaatttggaataaacataataaaattaaaagtagagtttagagtccgtataaaaatacaatttataaataactaaaattcgaaattaagaaaaacatgggaagaagagtttaaagtcaatataggaatacaatttagaagtaactaaaattcaaaatttaaaattaaagaatattgaaagatgagtttagagtccacatacaaatacaattagaaataataaaaattcagaaataaatataaataatattggaagaagagcatagagtctatataaaaatacagtttacaaaaaattcggaattaaaaaattgaaatattaaaagacgagtctagagtccatataggaatatatataatttacaaataactaaaatttgatattaaaaataattaataactaacacgtatataaaatacaatataatattacacattagtattttgtaaagttattacaaaatttaaaattatattgtcattttaatatatttgaataatataatgagaaaacatatatgctattatttgagagaaaatataatgatgctagccgcgcaatctgcgcggaccaccatgctagttaatactgatgttataagctagtcaaaaaaatactgatgatatagggtacctagcaagcaatggggtaaggttatcgatcgatgaatgcatatcataaattttcaatgaaaagatagagcgaaaggatcacgatgtaaactcgtgaagagaatgattcgtgtacattgacacgtctgaattctgagaggaacaggcatgccatcaggtttcggccagccaaggacaggtaatcaaggccatctgtagtttttaaattctgg

SEQ ID NO: 11802 - DNA, 1458 bp, Oryza sativa
  unsure (1)..(1458): unsure at all n locations
gacgggnaatgattgccncctcgcagnagcncatcactcggagaggagcgtggctgcgatgtgcggaaagccggaaacaaaaaccgacacgatacggagaaaattaatcggatgacgtatgaattttttttttttgacaaaaacaccttgaatctatctatctatctatctatctatctatctattatattattaaaacagctttaaaaggaggcaccacgttcgctgtgggagctagaaattcccacattaatcagagaaaaagaaaaaaaagaaaaggagagtctaagtagaagtacaatttaaaatagctgaaattcggaattaaaaataaggaatattgaaataagtttccatataagaatctaatacgagattaatcaaaattaaaaacaaaaataatataaaatccaaaattagaaaaggaaatgagagtacaagtaggaatacaatttaaaaatagctgaaattcgaaattaaaaataaggaataataaaagaagagtccatataagaacccaatacgagattaattaaaatttgaaataaaaataaataaatccgaaattagcaaaagaaaataaaagaagagttcatgaaggaatacagtttaaaattagctgaaattcagaattaaaaataagcaatattgaaagaagaatccatataagaacccaatatgagattaattaaaattgagaataaaaataaaataatatctaaaattagaaaaaattaaaagaaaattcaagtaggaatacaattttaaaacaactaaaattgaaaataaaaaataaaaacattaaaagaacacaatacgatattaactaatttttaaaaaaaattctgaaatttgaaaaataaaaataagatttcaattagttatacaatttataaataactaaaatttgtgataaaaataaagattattaaaagaaaagaccatataaaacacatgacgagataaattaagtaacatgcctataaaggagtagagtggtggcggttgatacgagatataacaattgttaataaaacaccaaatagaatcctaatgacaattaaaagaagggacgtcaggcatgccgtgaagcaaacgagtaagacggttgcctggacttttagaaagtaaaaaaaaaaccccattgataatcatattcaatttttaaaatctcagtgacaataaaaaggagaagcagcgggcggggtgtataagagtatagttgcagagccgccgacggttgacgggacttctagaaaataaaaaatgaattcaaatgatagttatgtttgatttttagaatcataataacagtaaagagttggtggcggacgggctgtagagggacatagtgacatcgtttgatgggacttctaaaagttatgaaaaatgaaactacaagtccaatttttaaaggtttggaacttccaaaaagtaaaaaagaaccaatggtaatca

SEQ ID NO: 11803 - DNA, 832 bp, Oryza sativa
  unsure (1)..(832): unsure at all n locations
ggaggacgcgtgaacattttttgttataatcgcgcccaccggtgaaagtaataaagtaccctgctcgctagagggggataatttttcgtgtgattcggggcccaagaatataagtctagagctgacagagaaaacgggatagattattatgtgttacccggcgggcgggggttttatgtttctaaccaacgaaggcaaaatattttacggaggaaaaagggcctaagaagttgttttttcctcgcaaaaggagataggattttaacaaccccgcgagtggaggagttaacaaagccggtgcggctgttatatagattcgaaaagggtcccgggtgaaggtttgcctcctcctccctgccagatccggcgggaggagggnggggggaggccgttgggggcggcggggnngnggatgnnnggngnggntcccctcccctcccatcccatcccctcccagatccggccaggggagggcggtggcagcgaggcgcgtggcggcggcgcccacgattttttttttgctttttcaacgcatttttgcaggcggaccattgccccgactatgaaaatcatcgattttgacagtcgttgggctgtaggcggtcccccctgcaaaaatcacttttggccgcctaaaaaaaatactttttctagtattgtgtacctttcaagttttgatgagaaatggaaaaaacgccatgcaataagggtgtattagatctaaacttcgactcgatctataaatacaagctgcgggcgcagcgacaagatcaccaggtagaaaaattaagaacaacgataccagtagtgcaccacagcttcatcgcaacaa

SEQ ID NO: 11804 - DNA, 1501 bp, Oryza sativa
agagttatgatacattgacaagtgctactaagttctagtacagtggtaagtactactagagtgctgcaactgctaggctatagacccgttctagttctaaagaatggagtatttgatttgttgttaaaataaacaccaccaaatttcactattatttttttagaaacatggtacaaacgtagatgcccacaacatgtacaccctatcttatgagcacctctaaaaaattgagccggtatatattgaaattgacaaagtcaccatgggtgtcttgctgtcgacgagtacatcgcttactactaaaagaataattcactgtaagcattattattattattacgtgtcaagtctagaatttgaacttgggtaggctgtttccactgcaagaaatctaactagttaagctacgcttacttcacattattattattattacactactactactattactactagaaaaaatgcccgtgcgttgcaaagggtgaatgctattttaattttattattgttttatggtttagctaggagggaaaaaatatccgtgtgttacaacgggtgaatgttttttttaatcttattattgtaataggttttagctatgatatgaaaaacactgtgggaattcgcttagatattttttttagaaaatcatgagctgtaattaggagtttggctttcatatcaagttagcatgcgagttattctaaagacatttctatacgactgcttttgtatttcaaaagcaaacgaacttaaaattcgactaaaaaacggatctatattttaaaaagtgaacgaacttaaaaccaactcaaatatggatgacgtaccaaaatatcggtaaaaacatatttaatttcaaaatatcggtaaaaacatctttaatttttataatagtagagaagagattattattattattagaggtagagagaagttgatctatgtttggtttgaccacttacgtagtttcttagattttgagatagtacgagagttggtttcaaagtcaccgaatttttgtatgtttgcgatgattatagtacgtttggcttttaaaggcattattgttaagagacgccgtgatttaggaattcatgataatggacagacgtgaaataatggtgatgtacccgtagaaagtcctctgatttctctaaaaaaaaaaagaaagtcctctgacgaacgagtctcggattcgattcggttcgttcggatagggccgggcccgtccagacagctttgacgcgccttccctaaaatttcgccttttggagattagcgtcagtgagattagtttacgatacttgccccggcgcacgtcacgatatcggcatgtcacataccgaacagcttacagctcacccgtgactaaaatgtgtacgtgcgactaaataaaatgtacatgtactgtacgcgatctataaatacaaagcggaagaagataggtgcatatgccacccacacaaagcaaaccaaagtcatcataagctgatga

SEQ ID NO: 11805 - DNA, 1501 bp, Oryza sativa
gtattcgccatactgtccaatcgtcgttctcactgtacttcactaaatttcaatttgtactagtccattgaaatggtgttggaaatctagggactaatcggaatattttgatccaagatacattatactaaacatgatatgtgtgtaatacagtgatccagtgatagtgttaaacattaatatgctaataataataataataataataatagcatcatttagtaacatatttaattttaaaataaagagaaatacccggaaattgctctggatccagagacggtggcgttgtccttcccagtcccaccgttctcgttcccgtttctcggtgttgactttgctggtcaacatcattcgaagcaaagttgttgatggaaaggaagtacagatggccgtatggcctgaggcccgatggcccgcccaaggcccggcgactttggcccggtctagacacggcacggctcgactccgatcgtgcccgtgctggcccggcccaacagccgtgccatgcttgggctgctacctcggcacgctgggccggcacggcccaacctgaagttcagggatgcgatacagacttattctcaaccatatgtaaggcacgtcacaaagaatagggatgaaaaatagacttattatatgagacggctcaaagagtagggatgtaaaatagacttatttttagctatatatatgtcacaacccaaagagaagggagaaaaaaatagacttattttaaagaaggcacaatgggccgcccgtgccttcgggacggcatggcacggcccgacttctgatgggtcgagcctagacttgaggtgcaacccgtgagccatcacggcacggcccgaagtgccgaccgtgccgtgccgcccggtcaccttgggccgtgcctcgcccatgcctgggctgggccgtgtcgagcaggccttatgggcatctataaaaggaagcagtgccgacggtgatgcagagaaagcatagagcagccgcacgaagaacgtgcgctccaaaaaaaagtgattgtccacctactcgtgtaggtactctggtggacgtagttccaaaggcctgctcgtcacgaatacccgtgcaggcaggtactcaggaccgaggaacaatcgaagcagcatagaggcagaagaacaggaggtgtccacccgagagaaccagacagaagaagggacagagagaagactgatcgagcgtcttgtctcggctagaggtaggagtaaagtcacacgcgagagatagggggcattacgacgttaaccgtgcttgatggtgtaaaacaatgtatatcttatcttctagttagttgtgttgctagctagataatagggtagttgagatggataacatccgttgttaacaacctgatcatatccttttgtaagtgccacgtcaagggctgttcttgacaatataaatacaatcatgcggccttctctgggaggtgagaacgtttccaactttacatggtatcagagcctctctcttc

SEQ ID NO: 11806 - DNA, 723 bp, Oryza sativa
  unsure (1)..(723): unsure at all n locations
acttccccctccctcctccgnccgaatctggaaggaggggaggggaacttcccaccccggcgtcgtcgcctctgtccggcagtagtcgccgtcgtcgcaccgcgcgcgctgtcatcgccaccctgctcgcacggtagctgccgcggcccttaccagcctccccctccctcctcgggccagatctggaaggaaggggggaggggtttcgccgccgccgcccctgccggcctcccccctcctccggccaaatctggaagggaggggggaggggagccactgcgtcgtcgtcgtcgtcaccaccgccccgcaccgccgtcgttgtcaccgccccgcacacgccgtcgtccccgcccgcacgtgccgtcgtcgccgccgtcggtagagggagggaggggagggggacggcgccccaacgttgaggtgaggggaggggaggggagaggaggggaaagtgttgagggtgagagagagttgagtgagtgaaatgagtggtggggaagggtggaggagaagataaaacttagaattttttggggtaggtacgattttcgcaggcgcggtttgagtggtccgcctgcgaaaatgattttcacaggcgtcgcttaagtggtccgcctgcgaaaatcacagcgaacttcaccccgatttatatttttgtaggcggtcatttggcttcaagggtcatattcgtctgtgaaaatcagaccctcatattgggaaaaa

SEQ ID NO: 11807 - DNA, 562 bp, Oryza sativa
atagcgcacacgtggagcagatgcgatgcgagcccccgccccgcgctgaccgtttgaccacgacacgtgggcgccccgagaggcggcgcggattctgtcactgcttacgtcacgcttcttggacgcacgcgcgggcccaccgcgcagtgacgtggagaggggaggagggggggggcgttccgttttcgggaaggggccgcagggtgggccacacggcccacgcaggcgccgccgccgatgggccggcgacacgtggggtgggggagcggtggggcggcgagggaaaagggacgggtttttttttttttctttgttgctgtgcgcgtgagcgcgagggggacgtggtgggataaggatgcggtctcatgcggagatagatgacgatgatgaggcgatgagttatgtgtgtttggtggcatagttggggggttacaggtgagtagtggcagagccagcaaatttactctgtgacatcgattatcattactatatattttagtgggattatttgtgtaaatttcaacggataaatatagaaaatttaagaaactctaaacgatga

SEQ ID NO: 11808 - DNA, 222 bp, Oryza sativa
gtcggtcggttcaatgcgcacgtgtggggggcggacgtagttttgtctttgagggttcatggggagaggggtgggagacaggctgtctccagttgtcttgcggctcggtgggcgccgagcctccagccttggccggccccaccccgagccgacgtggaacaagcccggggtgtgtaatcgctgggtgtacacgcccccatatcgattccattccaccacagc

SEQ ID NO: 11809 - DNA, 821 bp, Oryza sativa
caaccatcaattcttcattcaaaacaacaataatgctagcaaaaacaggtcacaagttgcatattattcctaagaaagttccagcatgaaatcttacttcatctgtataactataataattactagtacatatggtagagaatggtaatagtgagggggcagtgctggtggatgatgacatggatttgcacgtttggaacacttacttcatcacctcctaatgtaatctgacattccaaacaattatggcatgagcaagatagccaaagcttgggttcaacaaattctaatagatcgtgtgcacatagtatgacaatcactgccagcactaatatggtgtttgggattattaaatagtgttctcaccagatcttgcaaatatatatatcacgtccatgctgcagcttctagtagatgcaaatgaccttcgtgtgagtagctaactggagctgcctaaatccacaaaagtatacagcggtgagtcagttcacaagaatatgaaacaataagaccaacgattttgcactggcccaaagtatcgaactcgtggtgtgcataaagaaatagagtgctaactattgtaacctgccatcgattggcagaaacaaattcagcaagttcttactatgataagcggtcgttgattggcaggaacaaattcagccagtgaatccatcacggtgaggtggttgctgctggtgctgaaactgaaaacataggggatgcgcgcgggcaaagccgccagggaccacccgttcaacacggatgatgcactcatgccagcgccgcgcggctggaccggatcacgtcagttgacaaca

SEQ ID NO: 11810 - DNA, 208 bp, Oryza sativa
aggggaggggaggggagaggtgaaggggaggggagaggagggtgaaggggagaggtaaggacacttagaaaaatatcaactgatgtgtcatatatatataccacgctaatttttgcaggcgcacctcatgtggtccgtctacgaaaatcattttcgtaggcacgcccgatttatatttttgtaggtggctgtttggctctaagggtca

SEQ ID NO: 11811 - DNA, 1501 bp, Oryza sativa
attgttttatcctttagatgattaatctacggtccaaattatctccctacttttcttctttcataaagtcataacaccttactttttacgtttgcatcaccattgtacatactaattaaatttaaattatcataaaccacattaatttacttaatctgatgttttctagctattttacacattattttttttattgttatcatactaaattctcgcaacaatgcgcggggtttcacctagttaatgtaataagcatttccatcatagagtggctttgtaccttgattttatagaattttcatatgaattaatttagctcccacaaaatactctaaatcggctatgtatagtttggatgtagatccgggttcttaattattttcaaaaattaaaaatactctaaaatcctacattaatcccgaaatatatatattccctgggttgatttttatagggcgtgatttgatttggctggtttccacaatggactttgacttggtttttaaaatatgcccatgaactttgatgctatagctaaaagagcgcgtcaaatcttcttatgctataaactaattttcgcatgaaaaagcacctgagtgttcagtatcaaatcccataaaaaaacaaaccggcccattggtatgacattttgtcctgtccatgacaagtgacaagaaaagttgcttgctttttttgctttggccctttgatctttagcgttgtcaaacattttgtcaaaaagaacactttcattatagttcaaaggtaatgtgtatgtcaaaaagggaaaggacagacggccttaaccggccttatccagcgagcgcagggaattagtggaatgttatgatagaacaagaaattaattgacactacttgatgcgttttaacctttttttgtaattgaaattgaagcgttttaacttgaagtgatgcactctcaacatacactcccatgtcttacctgattgagttagaaccatgaagagatcatatatacatgcaagcaattttaactctctttttttttaggaaagcaattttaacttctgaaacaacaacaaaataaacttcaaacgttttctcttttcaattatactcctaaaactaaaagacacacatacacatacatcgatcagtacatcaacacaccaaactctaaatgctccgctgtaaaatgttgagagttaggtcagcttgtaaatctgccaaaggggaaaagaagaaagaacattgtatatgctccgtatggtgcctgcacgtaatacttctgcttgtgaataaaaacagtataatttgggctctttttgtagtatatactacaggatgaacacattttttaaaaaaaatatatacttgtgaatcaaaaaaatgaaaccagtacgtaattgacaagtcaagcagcactgccgtttggactataaatagacgtttccaggccagcttaaacctctacataaacatgtatcaacaccatcactaattaccagcgccggacaga

SEQ ID NO: 11812 - DNA, 1501 bp, Oryza sativa
agacttctaattgcagctcatgattttttttaaaaaaatatccaagcgaattcctaaagtgaatttcatcctagataaaccgtataacaataacatgattaaaatagcattcacccgttgcaacacacgagcatcttttctagtaaatataaaagtatagtagataagaacggaacggaaaacccttcaacggaaatagaagatgttggactttgatccaagaaagacagtgtcttatctacccgtatctcacaagggctgctcgtggtttacttggacaagttatctctacccacatataaatactccaaacttctcccgcgcctcaaaagcacttcaccatcgcccctcaaaagcaccttgccatcaccacctctacaagcaatcccccctgcccaacacgtcatgcagcgcaaaatagagttagatctggcatacctgttgttgacctcatcctctctctcctctctgattcctccttcaaacatgctgccctaggcatccactccctcgcttggatgtactttctgctttctcatctgcttagaaggcaccttgccatcaccatcactgccaaacatgcattcttgattcacccacatggccacatcatgagtggagggctagatcgaactggactgagctattgtgatttttttgggttgaaccactagtcttgtccggttttaatagctatagattgcgtaggtgtagcttgaggcatctatgatcacacactccgatgacaataaggtgtgtgctcgagtgaggggagttcggttgtgggcctttggttggccctaagagatggaggagagagtcgaaagagaaaagaatatacatatatatatatatatatatatataatgaatgataggtgtgtctagatagatctttttatataaattgtctttcttatattgttgattagatagcaaggagatataattcgtccggttttaaagttcacagatatcgaatgtttgttgttgtagttcatgggaaatcggactacgctcaaagtttagggagtaaatcaaaactgttccttttgaaaattgaggttgaaaaacaaccgtataatgactaaaattggatttcatccttcttaattttgcactatcaaatttctgcattccaagcatgctgcaggccaagaaccgacctatatgcaatgctacttttgattggagatcactcaaaactgggagagtaccatctctacacagctctcccttatctatcatcactctcccttacatatatcgatcactgcgtacatcacttaaattgaatttgaattcattaataaaagggttattttaattccatgcatcgatcgcatggcacgatgcaacgcatccatctaaacgagaaaaaacaggatgttgctttgttctcaagataattgcgtgtgcgcagcaattgttaatgagaaaaaaaacaattagcagatcgaaaccctagctaagctagctctatatatacagttacattatgt

SEQ ID NO: 11813 - DNA, 1093 bp, Oryza sativa
gcatgaagttagagtggccggctcggaaaaaaccgtcttccgcactgaaatcaaagaaggtgtggagggaaaagccaaagacgcccgctccatcccctctagaagaaggctcctccagctgccgcgtccaggtgatcgcgggacattggggtgagcccattgtaaaagttctgcaggatcagccagtcgtccatcccataatgaggcaggcggccacgtactcctgcagtcgtacccatgtttacggaatggatcatcccttgtctgctggaaactggaaattcgtccacgaagggcattggttttgcccatcaggaagaacttcgagaggaatgtcgtagagtatttatcccaggtgttgatagcagcacgattggcatagaaccactgcttcactcacccgaggagggagaacggaaacagccgcagcctgacagcgttaggactgactccctttatgttgtacatactgcatatctccaggaattgctgcaaatgagcatgggcatcctcattagccttgccacagaacttcaagtcgaaatccacatctcctatgttgacttgcggcccgacgaccacattgtcagcagcgaactcgcgaagagtcttgttggccataatcttgaaggtcggtggcgctggtacggttggtttctctgtcggtagagttttctgctgagcaacgactcgcggcctaacgctccggaaaaaagcttctggattttctttgaagttttccggcaggttgaaaccagtcatgaactaccctgtttacacgacaaaaagtgaaaacaaccaaggttagcctgcaaatgaaaatgactatacagaggtaaatataaagtattagtttaagtaatctctattatgaatcttccccggcagcggcgcttgaaatgcttgttggtatttcttaacgacattactagaaatataattcgcagcaatggcgcagaaacacttctggtatagagttcatccgtaagcgcacggatataccattgtagcatttcacccgagagtattctaagggtatcgtatttattttatcccgtgggaagatcatgtagagagaactcaactaataatt

SEQ ID NO: 11814 - DNA, 590 bp, Oryza sativa
agatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactcccttatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaa

SEQ ID NO: 11815 - DNA, 1501 bp, Oryza sativa
cgggtattccttcgcgcctatatataatcctaagttaatttcctagggagggtattcctccgtatttagccccggttggatggtcatgacgggttgtcgtaaggaactcggcagtcaggggtggcttctcgaagtaccaggagggcatcggatagagggtattagctagtatatcagttaactagaatgtatttatactatgtatattagaagtataggaatagatttcctttctctttactttccacctagtttagattatttattatgaggatgggtagttgaatgcttgtgtgtcactctacccttggattatcttaatccctacttagaatatgattatcgcaagtaatatataaattattagttgagttctctgtacatgatcttcccacgggataaaataaatacgatacccttggaatactctcgggtaaaatgctacaatggtatatccgtgcgcttacggatgaactctgtaaccataatataccagaagtatttctgcgcctttgctgaaattatatttctagtaatgtcattaagaaatacaacaagcatttttggcgccattgccggggattatatttctagtaatgtcgttaagaaataacaacaattaggccccattttataggcaagagagagagccgaccacgagattgagtggaaacggtgccggagatggtggtgtcagcggcatcaatggcggcttttgaacaagatccaaatcctggcgattggaggcaccattcaagccttgttcggttaatgcccatgagggaggaattggagaggatttattccccacctattgtggtgtggaattattccccctcaatcccctccaaaccgaacaaggcctcaccggggaaattagggggatttaaagagaaatcaatgggtattaaaacccccaattaatttggatttaaccggcttgaatggagcgaatttgagggagagataggctagggtttatgggagagagaggaggccggcgggaggaagaagacgaccggctgcctagcggcttgggctgggcgaggcaggggtggcccagggcagggcaaggagaggcccgagagagaaggaagagaaggaggggacttcggctgcgggccgagggagaggagagcgactttgggccaggggagataatttttagtttttctttttaatgaactcttataattgttttgtttcttaataaatattttcggtgctctgaaaattggaataaaaattgagggctccatttagaccaaggaaaatttaagaaaaatactccgggccacaatcgaatttatcttgtacgcatgatgaatttatcaggccatgacaaccgacaaccgatgactattctaagcctaactccactactacaagagagaatacaatatgaaatgagagaattgctccttgaagttagtgttaaaactgaagaaggaaatctccttttataactctcaagggcggttgagtatgacggttatggagg

SEQ ID NO: 11816 - DNA, 223 bp, Oryza sativa
catgagtgctttgcttcgtatcattctacccatataaatgtcttaacccctgcttagactttgattatgcaagtggcatgtatatattattagcatagttctctcttaaaatcttcccttgggattaaataaatatgataccttggaatactccagggtgaaatgctataatgtaatatccatccgcttgcggattccttttgtaaaccatatatataccagg

SEQ ID NO: 11817 - DNA, 1264 bp, Oryza sativa
tcatgattgttgaagtgtaccccaacttttcctgggacggggatcaatgcactagcatttgggaaaggccacactagcttatttgagcgcagcattggtcctgtagtcttctcatagattccagtatgtctttagtactttacttttcttgtaagactatagttgcaataaaagaattatcttctttattatattgtgttcatagttcatatcatagtttactagttacgtgttcgatgaatagattatacttcatttatgtgcttcactagcttatgctagttgatctatgctacgataatggtccaatgatcttaacgagttgcattagttctaacttgttcattcgaagggtgagagtcccgggggaattaatgaaattatttattaagatatgcatggtgcttaggttagttaaatgccattggatgcgagtatgccccacggaaagtgaggtaggcggtagatggtggcagtcctctccatccattgtattcctccacgtccaggtatgacgtaagagttggtaaaatgccattaccacgctgacaaaccaactaggagtggtctctcggtagttcttaggtgcctagactaagtcctagccttgtaagcatatatgtatttagtgtaaactaaacattggtaatatagaagtacatatatatggaccttagctttctatagtttttctccactgcctaatgtgtcattattagagatgaatctcctgtgtgacacactatctcattgtcatttatcaattaaccattgttcaaactattgtaaagtaattatagcttgattaaggatgtatgaactctatctttataccatcacgtccctgcggaaatataaatacgacacccttggaatactcatgggtgaaatgctacagccgtatctgtgcacttgcggatttatctctggccgtaaaaagtaccggtaagcatttctggcaccatcgccagagaagacacttgttaaagatttagttatatacattcataatcattctatgattagtgaaccttggtccaaacaggttaaccttgatttgtttcctcttcttgtgaaaacaggtagtgtatgaacggtttcgacttgccgacaaatttcgttgaaaatctagagaaacttgcgagaagagtcaaacctcgcgtcgttcctccacaaatcaggttctcggcacctgaaccagtcattttcgcaccatcaaattccaagccgatggcttagaagaccctctgtgattactcagcac

SEQ ID NO: 11818 - DNA, 1501 bp, Oryza sativa
aacaagcctgcttttcggcagttagtcagttactggccaggttttagttggtggaagtgcacataaagcttccaaatgcatacataggaggtgtattaatcaatgaccaactactatagctacagcctaatatatcccagaaagaacacaccaatcagccaatctcatttcaaaatgactgtaagaattcaagcatgaagataaatgccggcagtgatatgatataaaagtctttccccttcaatttgactacacagcaaatctatttcatcagaaattagaaagaaaacccattagatttaactgagaacaagtactatgccacaaatatgcggcggtgtgggagtggacgaccggcgaaggtcaatggcgaagaaccggatctgacagcaatgtggtgactggcggtggcggtgaatcgtgtacggctgatggagggaagctagtcggcaacacgagtattggaaaaagggatgagcggaacgaacatattcgagaatcaacctcgaggtcgacgatcggcgggcggcaatgggcgatcggcgggcggcgtggtcgtggtcgacggggatcgaccggccaggcagcgatggcgcggccgcggaagacggcagcgactcgtggcagtgtcgaatcgggctatgcagcgcgaccgtgagggcggcgaggcgacagtgatctagcgagagatggaacgcgatgcgaggggacgtgttgcgggcttgcggccttgcgggggatttggcggagattgcgtcattggaggggatggggaggaaatcgcggcaatactggcggcacggatgcggagtgggagagaggaaggtgtgggacaggcggatctgggagggaggagaggatgactttagatcgttggatgtgtgatatgatgaatgatgaatgagtaaaactatttgttgaactataaggtagactacggagagggctctgggtccacatgtcattgggttagtgttttagtctctcatctgagcacttgggtttctagaaattatgcataggttctgaacatatttttccatgagtgatacttctacagtttggaccctatgtttcttgctatttatgtgccaccgtccttcttcttcctccagaactaacgatagacagggagagggatggcagttcgtgatggttgcggccatggcgctacagagggcggcgtctctattaggagtaaggagatggtctagggactacttcaaagcttaccctgtggtgtggagattatgggtaccccatacctacacggcatggttatccgactggttataggggataacttatatctatggaatatgtaacagatcatgacttgagtattacgtttccctttatattatggaatggcctaaagtcctggtttgataagattgtaaagtagatttaggaaaccaataccgtattggttaaggtttctatcttgtaatcatgccccccctcctatataagatgggcaggaggccctctagggggcata

SEQ ID NO: 11819 - DNA, 1209 bp, Oryza sativa
cctagaagttcaaagtgtatttaatggaatttgattcgggaatttggaattggattcaaagattgtaatggactataaaagggactgtagactttggtattctgggagttatttgtggacttggaatgagagatttgagatctttaatggcacatacactaatattcaaataagaaccaaattttgaaaatagttttgtatgtaaaataggtttttaaaagaaacggaaaatcaggatgttacaaacataccccccttaaaagaatctcgtcccgagattccgctgctaggagaacagctctaggtgctcagctcaaagacgatcttcgcgttcccatgtggcttcatcttctgagtgattactccattgcaccttataaaactttatggtcttccttcttgtacaatggtcctttccttcgagaatccgaatcggttgttccttgtaagtcagatcgtcttgtacgctgattgcctctaagggaacttgctcttctgggatgcggagacatttcttcagttgagacacgtggaacacgttgtggacatctgtcagtcctacgggtagatccaattggaaggcaacttctccacgtctggcgatgatgtgatatggaccaatgaaacgtggtgccaatttccctgccataccgaatcttttcgttccacgtagggtgatacccgaaggtacacgtggtctccttcttgaaactcaagatcccttttgcgattatccgcatagtcttctggctggactgggccactttcaaacgttctcgaataatcttaatttgttcttcggcttccttcagaatatctggtccgaatatcttcttctcatccacatctgtccaacagagcggggtgcgacacttgcgtccatacagggcttcattggaggccatttgtatactggcctgataactgttgttgtaggagaactctccatacggtaaacagaggtcccaagtacctgcgaaatccaatgcacaggctctcaacatatcttccaatacttgattcactctttcagtctgtccatctgtctgaggatgataagctgtgctgaaattaagattggtgcccattgcttcatgtaacttcttccagaagtgggaggtgaactgagtaccacgatcagatacaatcttcttcggggcaccatgccaacaaactacgttggtcatatacaactcagctagcttctta

SEQ ID NO: 11820 - DNA, 1501 bp, Oryza sativa
ttgaggaatattattagtttctcttcctatttgagtgcttccaaataaattccctcaaactccacctccaaatattgcactcaaataaattaagatatctcttttgtgaattctctccgaattcaaattctttgcaaaacctagcaatccaaatcaattattcaaattagacttcttcctttttgtaattgggccgaaactcctctcattgttccttttggcccatctccttcttcggcctaggacggcccagcctccagccgagccgcccttcctcctcttgctggtgcacgtgttgcacacgcgcacgccgccgccaactcccttccgtcgccgctaagaaagcaaaagccggcgccgtcgtcctctttcccatgccgtcgctaccgtcaacttgccgcccacgccaagccgctgccttgccgtcgccgcaaagtagtgccgccaccgtcgccgaccaatcacaggccacagccggcgccgtctccttcttctccactccaccggcgccgtatcctcctcatctttctcctctgcgaaccgcttgaagaaccgacctccgacgcctataaatactggcgaggtcgcctcttttccctccacaccatcgagttctccgagctccttctctctcctctccatatccggccattgccgccaccggtcgatctccctcaccggtgccccattggcacaaccctcgcgccactagcttcgcctcgacgaggcaaacccatttccccacttccccttcctttcccccttcgaaataagccaccaccaccacctctccttgccgccggagataagcttttcccctagcccgttccggacatacccttctctccctctgccggccaccaccctcccaggatgcgcgatgctcgggaacaccactggcctccagagtcgccacctcctagccgctctaccaccggcgcccctcctccccatcctccctgtttgcctgtgctggaagagaagaagaaggaagagacgggaggaagaagaagagaaagaaaaagaaaagggaaaaagactgacaggtgggcccataaaaagtacctttccgtattttctagatttaattcaaatcctattctttaggagcccatatctcctaaaccgtaaatccgattccagtgaatgttggacctaaattcatctaaattcaaaatctatattttgtccagccaatattcgtcctacctcgatatcggcttaatcaaatgaaaccctagccagccagcctgctatccaaactccaaaccagccatttaccctccaactacccatagctttgttggtatttcttaacgacattactagaaatataattcccagcaatggcgcagaaatacttctggtatattatggttacagagttcatccgcaagcgcacagatataccattgtagcatttcacccgagagtattccaaaggtatcgtatttattttatcccgtgggaagatcatatagagagaactcaactattaact

SEQ ID NO: 11821 - DNA, 1501 bp, Oryza sativa
acgggatatcattatttggggttatatgctgcggatgagaggtgggccgctgatggtgacagctcagtacgggtattcctccgtgcgtatatatagtcctaagttaatttcctggggagggtattcctccttatttagccttggttgtatggtcatgaagtgttgtcctaaggaactcggcagtcaggggtggcttctcgaagtaccaagagggcatcggatagagggtattagctagtatatcggataactaggatgtatgtatactagaagtataggaatagattctctttttcttttctttccacttagcttagatattttatgagaatgagtagctccctacttgtgtgtcactctacccttggattatattaacccctgcttagactatgattattacgagtaatatataaattattagtcaggttctctctaccatgatcttcccacgggattaaataaatacgatacccttgaatactctcaggtaaaatgccacaatggtatatccatgcgcttacggatgaattctgtaaccataatataccatgagtatttttggcaccattgctgggaattatatttctagtaacatcattaaaaaataccaacagtccgcccctgaatacgtgcatcgactttgctcacaaaatgtagctgaatgtaacattctgaaaatttactattttctaatcttgcatcatgtcgggtcttatgtttttaataaccactttaaacctaggacattataattagcgagacctcctaaagctaacctacataaaatccctctttgatattcaaaagcctttgtgattttcatttaaaattttatcttgaaatattccttgatttggttttaatctaaaaccttctttcgcctaaaacatcctttatttaaatttagtttgaaaaaccctttttactgttatgaatttggtccaagaaaccttcctatattgtgctaaaacctaaaccaaagcaattccaattttattggaattaattgttagcccatcctttgatcttaaacccatcctttgattcccaatccaaatatccaaattcctcctttggatctagccaccaatttaatctttgtggcttgatttcctcttcgacacaagaatagtattattgcaaatattgtgagtaattgctcttgtgctaagaaaattccaatttatactcttcactcaacttccccttttaaccacaaatatacataataccaattttagaattcaaatcctatctattcccctcaattaattcccttgtatattaccaaaaatattttgaggaatattattagtttctcttcctatttgagtgcttccaaataaattccctcaaactccacctccaaatattgcactcaaataaattaagatatctcttttgtgaattctctccgaattcaaattctttgcaaaacctagcaatccaaatcaattattcaaattagacttcttcctttttgtaattgggccgaaac

SEQ ID NO: 11822 - DNA, 315 bp, Oryza sativa
gcacgggtccctagcgtgtccgtccaccacgaagcaacaccccccacccccgcacaagccaaagcccacgcccatctcatgcgcgcgcggtggtgtacgtcgtactagcgtaaaagcctcgccccccaccgccgcgatgcttcccccctcgtcgtcgtcgtctcgcgcgcgcgcgcggcgcatctgcgtgtacgcacgcatttttctcttggtttgttgcgcacacatcctgccccgagcggcccgcgcgtggctgctcacgtgggcgctcgtgtgttcggcaaaaatccacgggccaccgtgttgtggacggga

SEQ ID NO: 11823 - DNA, 380 bp, Oryza sativa
ctttgcccttttgatctgagaaaaaaagaatcatatatagtacttgcacagtatatcttcaaccagtccacttccttccatgcatgaacaccttagttaattacctggagtagaagatatttcttttgaaacactagctttttcccctagttgacatatagttaatttatacattttacggtcttggagatactaagtgatgtgctatctggtactgtactcccataattcttgctactttttgaactccccaaatgacaaacaaaattgtgatatttttttggtacctatcggtacattccaagggccctaaataaaacttattgattaaagttattactatatatatcgtctgtagatcatgctaaaaaacacctaca

SEQ ID NO: 11824 - DNA, 1501 bp, Oryza sativa
agcataataatctacttgtttgtttcagcttacttctaataatccagattataataatcctaagctgaatcaaacaggttctaagttaagttcagcctaggtttgaaaacgagaattgaatgtaacgaaatcatgacacaacatataattagcgaaaaatgtgtttcattttcgatataagtgtgttcaaaatgagagtttaaagtaacgagacgagatcgcaagtggatctagtgggtggtgcatgaaaaaaaatcctaacctaatgcatatatactcgtttttaatatagtatgatgtatatttgatccgtttatacttttaactttgttatattctttagggtattttaaaacaattatataagttgaatcatcaatataaaaattctagatatgtcactagatgagatgactaataactggcgaaattgtgtgctaatttagtgtagagcacactgtacatgaattgcattaggcagcttgtcacgttatctaggtacgttcacctcatgagagatttgctttctcattgcaccgtgatgcaaagcaaaaggctaattaagttgcatataaagtagtatatctgaaaattctttccttgttgacatcacatcacaactatcaaagggcactctttatctttagtgcaacattgtttgactaaagcataattaactactcgatgtggtagataattaaaactaaaccatatataaatatcagcagacacaacatcagaactaatcatgaccatgtcagggtttactatttcactatgcacaaatccgcaggggatcggaaatttcaaaatatttttgtcaaaatagaatttgaataaatcttgaacaaatttaaatagttttcgctaaattcaaaaaaaattcgggcggaatagtttcaaaattcccagaattttaaaaattttcgtactgaaattgcaaaccatggcgatgggattggaccgatatttccgaaattcctgaaaatacggaaatttcattacagaagtatcaaaccattgtgtaggtggaccgttttcccgaaattgcaggtttaccggttgctctgacaattgcagtttgatgttcaaagcttaccattcgaaatttccaaattttgtttcggtctccctggatacattccgaaatattgaatcctgatgaatgatgatgcatgcatacgcaacatttcggagtgtacctaccagttgctctgaccatttcgcttgtttagtctagcaaaaacttatcaaatttaaagaaatttgtttgaagtccaaaattgaccgttcaaaatttccaaatattatttcgaaatctttttgattgatccttgcacatggccagaacgaggaccacatcaaccggatggtgctgcgcttcctgtcgccgtcggcgcggacgccggcgctggggacgccgctgggtcaccacccgctggacgcgctccggcggagcatgctgcacggcgagtaccagtcgccgcgctgggggcacggc

SEQ ID NO: 11825 - DNA, 551 bp, Oryza sativa
cccccgcttcaatccaaacaaaatctgaatttctgaagtatactccctctatcccagtatgatcatcccttaagtaaagaacaacaagaacaatgacactaaaacatcaatcattctaaaattaatcatcatcgatgaaagtgatcgtgtccaacagaaattaattcacactctaaatatcgcatgggttaaaccaacagaaattatttttggttggttgcgcgcataccgggcattccacgatgcacatttactctttgcaaaaccaagcaatagacactttgttaaatgatgattattttgaaaaaaataccttaaaattttttgacgatgatcaaactgagatagaggcagtagtaggttggctgtacattaggacatggcccaattagaattattgggccctgtaaaggcccatgaaacgtagcactctgtcacaaacggcgacgaggcctaccaaagtgcaacttggtgaatttcacactgtactgtctgatcgctcgccgccggggccgctctcccgccggcgccgcccccctccgccgccgcca

SEQ ID NO: 11826 - DNA, 1501 bp, Oryza sativa
cttcctccatgcttgaatagcctacttcaaccgtaaaaccagaaataacctcccctatcatcgaaaattagtgcaaatcaactccttcgatggtttgcggagagctttttttttatgtggcaggctgaccacggttgactcgctaagttagtgggtggggcccacatgtcaggactctgtcttcttcctatgtgggtaaatcaaggaggtgggttgtgtgggatccactagtcagctctgcatctgcttcatctacttctctcctttcctcctcctcgttccaccccaagtgtggacatgtggcacggtggtgagaacacgaaaaggacaagatggcaaagagaggtggtcggtggagcagggctcggtggggacgaattgatccatcgggagggagggcgtggttacaacgtgttcctcactaacccacaaagtgcatatgcgcgactctgcgtcgcgcatataggatagagcaacgacgagatcacgtccaagttcgtgccgcttatccggtgctatcaaagcagtagcgtagagtgcctcttcccgaacactcacgtcctgcccttggcgtcgcggggaggcgatatccccatcgacccaggcatcgaaccgtgggtgcgcctctacttccctcgaccttgatggttgcggcggcaagaagaaactactacccgttgtcttgtacctccatagcgacaacctcatcatcggctcgcccatggatgcactatagcactggtttgccaactgcctctactcctgacggtgtgtcctcgtgttgttagttaattactgcctcacgccggagcaccccgcctgctacgacaacatgtggtccgccctacgatgggccatcgccaccgccaccaaatctgcaaagtgccgacccgttgctccacaaccatgcaggggggtgggttatcgtgctcggatataatgccgatagtggtatgctggactcatacttcatatcggccaaggaggacgacgacaaggcgaagaccgcgtgggtgaggggcaaactagaggagaggatagtccctaacatgtgtgccttacctgctgactcagcgaatcaaccatgatcgtcttgcattggttttcgaagataggagaggcgttatactaggttttgcggttaagagagatgattcaacgagaaggaagagataacggaggtaatatagacttattccatcccaaaataaaatgaaaaacacaaggaaatcacatggccacaagcccacaacaaaggcccatttagcccagcccgtctatcaccctggataccgcgacgcggcgcgcgcctatataagagcactcctccgctagggtttcctccctagccgccgccgcttcatttctcccaggtaaggtaagccagccgccgccgccaccacctccgcctccgatctgaaaccctagcctctctcctccctcggcgccgctcacgtagatcttctcccgctgcttgtcgtgcaggaaaaagggctccccg

SEQ ID NO: 11827 - DNA, 1501 bp, Oryza sativa
aataacttcacaataaaataaaatcatccatataaagtacatgataaatttcatattgacaaataaaatttcatattgacaaataataacttcactataaaataaaatcattcatataattacataatagcctaggctcgcgagccaacccgggcttgactcattttagcaacgagctgaaatggagacttgggcttggctcgtttggcatttaagctgagccgagccaagcgagctcgagccaagaccgagctaagctcatgagtccgagcttctttcccgcccctggttaggccccatctttttttctcttacatattatatattactattacaagagtgttttctgaacttttaaatggctatttttttcctaaagaaaagttatatgtatataagtttcttaatatagttaatttaatagtttgtacccccaagtttgttaagaaaaccagacaatcaattatatacagacaaaattgatcaaaataaaaagataacaaaattaccccgagcagtcaacctgaaagtaagattattcagtggcggagctagaaacgctagaagaatttagttcaaggggaccaatattgttagtttttctatgtttgctagagttataggaaattcggtgtaaaatttgaagcctggggaggccaactggccaagcccctcctgtctccgccccctgagattattgttcattagcaaaatcaagacaagacaaggacaaccccagatgcacggactgaaaccaaaacaagaaggcaatccagcctccactctcgcatctgacgtcactgctttgctgctatcttcgcttccctggcgaacaagtatattatccaaacccttcctagcaacggccgttccttgtttgacttgttcttctagtaaagaaaaccaaaaccaaactataattaagcagcgtgaagttctttcttgggaaacaaggtcgtcggagatactagcagcgatgattaatgaattcacagtacaatatcttttcatatgcagctagcctgaaatgagctgcttttcctcatgaatgacggcctatatattccatcgccttttcaggttgtaagttgtaacaattggacgttggggttacacgcttcagcttacatagcctccaatatatttggtggcaccatgagagatgtggttataatcaattttcatttacaaagctatctatttttacatattttttcttcgtatttaaatgcatgatgctattgatttttgacaaactatttataatattaaacaaattaatataaatacaaaatatataagtaatgtttaaattaccttaactgtagatgtcaaacatttggtaacgaaaatatagtatttattagattttcagatctaaccattgatttaaacatatggtgttatcttgatcattgatctataccgtttatcacatggagaatttgtgttaaataaaacatggcattgcaaatactataccgaaaaccctctttgatta

SEQ ID NO: 11828 - DNA, 1501 bp, Oryza sativa
cctgacagcactaatgtatgacggccacctgcagctacttccactatcttcactcctgtattaaatgtcacaacacaaggtggtgctgaaagattttcatcactagatgattcactttcagccccgtgtttcgatgaagataacctccgtcgctttgtgctatcctcagaacttcggctttcagcaggaccagatgctgccttggtgcttgtcctagacacctttgacctggggctcactgtaatcgagtttcctatattacctctgtaaacaacggatgtagaaaagcttatattttttatgtagaactgtaaagaaataagtagtaagcaccaccaccttggtcagtggcaaccccactttgccttttatcacaatccatagccccagttgcagaatggtctgcaatgacccttccagttggaacgcattctttccaaccccatgtgtagacatcacctttacctgcttgagtggaattcaatcagtgtaatgcaaagttatgtgcagttttcactaaaatgcatggatcaatacacaacctgttattgcaacacaatgtgcccatccagcgtcagcccttacaattgcaatatcactaggaagaggaaatgcctccggagtttcctgagaggaacaagatgtttacttcagtaacagtttataagtttatcaagaacacgttggaaacaaacaattagcccaaaggtacagagatacctcatgcttcccagcagtcacgtaactttgtcccatatcatcggtagagccccaagtgaagagttttccttgctctgcatcaggcagatacaagctgtgtcagtgtcaagctcagttgacgtacggagtaaaacgctaatagcacacaatccgaccaagcaaaaatgcaatcttctaatggttgacagaactacctaaaaacatagaataatccttggagtaatggagttgttatggaaaattagtctaactaaaagcaattccacaaaaatacactagctgacaatatcacataacacattcccacaacacaatacggggcaaaacagtgttctgatattctctgtcgctcgaccaaaaaaaaaagtcgaaatcactagctgcttgcactatcaatcacaacttagtcagacagcatattccaccctgatcaaccaccaatcaggaaaatagtcatacagcacattccaccctcatcaaccacctatccagaaaaaaaaatcggcaataactgaacacccggcactaagctgctcaccaatcaattcacagacaatcactcagattcttaagaccttttttatccaattttatactcgcgttttcatggaacccaccatatacacaaaaatccgcacaactaactactaaaccactgcacgctaatcatccccgataataaaaacctcacacaaaccacaccagcaccctactagatctcccacgaccctcttggtgccacagatcgaacgaactcgaacgcaacgataacatcaagcaa

SEQ ID NO: 11829 - DNA, 1501 bp, Oryza sativa
tttaaaaatatatattaatctattttttaaaaaaattagctaatacttaattaatcgcgtactgatgaaccacctcgttttacgtatttgcgtgtttggagtaaagtctcatgtgtaacgtggtcgatatggacaaatgagaatcgttcagttccgatcatatgcgtttctggctttctactgctattattgacgtgtgccctgctagtccattttacagccaaatctgaagacttctagtctagggatcacttcgtttgtcagaacgcgagagcaagaacagtttatctttctcgattaaagaacaacagttcaggcgttgggggttctgaataattaaatctccgtgtggaactaggattttatgtatgattagggtgacacggttttaataatcagggagttggattgctgcgaaatgaattgatgattggttgctcctccgcttgtttggaaggaggactggagctagataagcgtgttgaccacccccaaccgcttcagtcgagttgagtcggcatcggacgcctccgcgggatgaacagcgaacccggttgttcgatttcgttgggtggaatgtcaactgttcatagcaaaattgcacccgtactgtgtcaaagatgttgctctttcggcatgcatggggcatgcgatatttctggtcctcacgtagtgtagattctctttatatcatatatatactctactttatccgattaaataattttgcaaataatatttttcaaagaaacacaacattatattagacgcttccatatgtatgcgcattcaccactataaattcaaacgtatactctagccatataaacatcttcgaaagaccgtgttagcttgttaaaagtcatattaccgtaagatcatttcggatatcagaaatagaaatgggtaatgtttccctctctggcacaaggaaaacagaattatttgttggtagcataagcaaaagaaaaagcctcgtacgtgatcagttgatcacaaccggaagtactatcgatttaccattgccattgatccacacacttttccccctcacagacaggcccagatcacaccgaatgttttttacctgaggaagtgccgtactgccgtctgactgacggggactagaacggttgcattgacacgagccgcggccgaatcgacgaggaggcaggctcacattctgtcgtcgccgtcgttctctgcaccgctctgcacggagtctgcacgtacgtcgtcttactccctccgaatgcgacggcgtccccgtgcattgacgcacggtgccatacttccatgcacctcaagcgagcgatccgtgtcatcgggatccaacgaacacatgtgacactgacagtatgacacatcgatcgtgacggtatatatgttcacaccgaccgaacaaccgatatatgtggttgtaattgcctttttaagcttttttttagattataagttgttttgaatttggttaaagttaaactattgtagaaaaaagaaa

SEQ ID NO: 11830 - DNA, 1501 bp, Oryza sativa
ctgcccttccatccccgccgccatctcaccatcctctcgtcctttctcgccgtcgtcgagctccaatggcacacggcgcagaccacccaccgtggtagcccgcgccgccgtcgccgcgagctcgtcaccaccatcgccgcgacaaacagactcctccggcgttggttccgccgccggcgcggccaggttcgccacaccgacgccatcccctcgccacctccgccgccaccacagcagccgctgctacccttccatccccgccgccattttgtcatcctcccgcaccttgtctctatcgtcgagcttcgacgacacacggcgcagacggcccaccgtggtagcccacgccgccgtcactgcgaactcgtcgccaccaccgtcgcgaccgccagacctccgggcgctggatccgccgtcggcgcggccaggttcacctcaccgacgccatccccttgccgccctcgccgtcgtcgccatccccgccaccagacgccgccgccggtcgccgtcccgccagatccaggcgcagatctggcggtttcctccgccgccgccgccaacgcctcgacgccgctgccaccaccaccagacaccgccgccgcaccgctcaaccccgccgccggctgctccaccgccagatccggccggcggcacggatctggccagttccgccgccctcgagcaggtccccctcccatgcccgagcgcgaggacaaagccccgccgccgccgtccttgtggccgcgcagctttgccggcagccgctcgagcggtggcgaggcagaggaggaggaaaggggagacgagcgccggtgaggtcgtcgcctcccggtcgcccgtggggggaggggcgacacgagaggaaacaggtcaatattttgttctcgtgttttagttggaagtttatttgtgtatgaaagttttgatgtgatgaaaaagttgaaagtttgaaggcattgacgtgcattgagatttcactccaggcattgacgtgctgttggttctgcgttttcgtgtatgcttgcgtgcaggggcgcgggatttacaacatgtctcatggcatcggccggaaggagtgatgaggctaactgattagctatgtgtaactggaggagctgatcttgtgttacagtgacagactgacagtgtgtcagctacatgtaacctctcttgtgtgtaattataggagtattagtgctacttatgtaaacgtgttggactccaataggagtgaatactgttgtccacttcaattgagcttgagtgagtgattgaagcatggaaaaaaagaagcttgatttaacgaatacgatcatgatcatgcaccaatcacgcatgtccggtaagctttcattactcattagtgtttccaacagagaaacacgtgagatggttctgtcggaaatgcattcgaggcggaaggaacagatcgccgaaccaaccgtccttcgttggttgcgtaagttcagtttaatcgagatgcgatgacgaattatctaat

SEQ ID NO: 11831 - DNA, 1386 bp, Oryza sativa
ggaagaggggagaggagggaggagtatatggagtataggggaggggggctgatcgcttgggcgattgcctggcgatcgatcgcccattaggccccccatgtttggacagattgatggacaaagaaaccgaaagtttccggaaatgctactgagcgagggatcgccctcgctcgcctatagcgatcgggtaacccgccccccctcctcccccttcctccacctggtttccttttttggcaccgcattactttcctattttagtaaatttatgcacctcaagtttatacacctcaagtttacacatctaaagtttagagaccaaaagtttataagtcaaaagtttatatatccgattcaaatttgaatttgatttcaaatatttttttatatatagtatttatatacatctaaagtttatacacctaaagtttatagacctaaagtttatatatcttattcaaatttgaatttgaattatgtccgattcaaatttgaatttgaattcaaatattttctatatatagtatttctatacatctaaagtttatacacctaaagtttatagacccaaagtttataagtcaaaagtttacatactgtcacgccccgaactagccccgaacggaactagtccgtgacgctccaaattaacctgtcaatcgataccagtcccaggaaacagtgctggtatcacaggaagacagaatttcacagcaacagaggtctctttattgcagagtaggagtacagtcatgttgggctgcggacagatcccgagctcacaactgcattacaaaagggaaagcgaaagccaagacttggaccattcatcacaggcgcgacttgggaactaggccaaaaccctaaaactcatcgtagccgacttgctcctggaagaactcctcgttagcgggatccacttcatcttcttcagcaactggggggaattatttatatagagcaagggtgagtacaggagtactcagcaagccatgggaattaagtatttaatgcaggcttcaaaggaaaggctgttgtttttctgcaattgattttatttaaacccctttttgaaacaactaagtgcttctcaaacgacacggatgagacagtgcgtctcgtccggtcggagtatgtgcgatgtatcagtctttgaattgattcaaggttggcacccggccacccgctttcaaacagccacccgggcctagctgatcccatcagccgcagattttccaaacatcgatcccattccacaacagcaatttcacaaagcagtagtcaaacaaaactacgctaggaatcacctcacgtccgcccatgaccgtgggcacggctgttcgaacagtttaataacctctgcagagtgggtacactttacccaca

SEQ ID NO: 11832 - DNA, 1341 bp, Oryza sativa
  unsure (1)..(1341): unsure at all n locations
agtgcatggtgtggtatgtgtgagcacgcgtatcttctatataattaaaaagaactttgctagttttcaagcacctgcaattttgtaaatcttcaatcacctaaagttacatactgataaacatagttttacagtgctataaaatgaccaatcatttaactctaattttgttgttttatatggttttacttttatttttttatctatatatgtttgaattgttttgatctaattatttaaaatttcatgagctataaatttatttcatgtaattttataaatattcgtaggttacaataatttatcattcaacgtttttttttacatgggagtaactagaatcattgtattgccatctaaagaacaggatttttctttttgaaaatttcaggcgcttgtgatgtctagatacttccaactaaaaaaaggtagtactcgcacgtgtacaaactagtactacaatacatactgatacaattacaaaaggccccggccggtgggacatataccaaaggtcctgcactgcacgcgatgcgtgcaacaccacacacctccactccgcgatgatctccgtgatatataagattggcaaaattggttntntngcntcgaaagttcacgtttttgttttatagcaccgaaaattaccggttcactttaataccattcaaagttcaccatgtttgtatttctagcacttctgtcaatttttccgccgtcttgattgttattgatccagccacacacatgatatgacatttctacccctcattgacatgcattatacttgtacttgtgaggggtagaaacgtcatatcgtgtgtgtggttggatcaagacggacggaaaacgattgagaattgacggaagtgttaaaaatgggaacatggtgaactttgggtgctattaaagtgaaccggtaactttcggtgctataaaataaaaaaacgtaaactttcgatgctatataaccaattttgccaagataaactcacgatgcagagctcgctatagctatagctagctagctacaagtcgcttccttgccgagagctaggtagcattgccagtttgccacccatctcgccgcgagctatttatagctgatcgatcgcttgatttcacccgcggcgctctccactgatcacaacactaactgagctcacgcgcaccaagcagaaggccgcgcgcgcgcgcgcgtttggtctcgtccatggaggcgatggagtcgcgggcggaggatcagggcgtcaagcgcagggagccgtgcaagaagaggatcgggagaaccgcgggcgccggctcggaagccggcaatggcagcaggcatcaggcatcctg

SEQ ID NO: 11833 - DNA, 1501 bp, Oryza sativa
tgaaagccattttacttccaagcaagttcaaccgttgtttccattagttccttaattatcgtgaaacaagattacatcatagtagaccacctacttgcaccaacgccatcaccactcaccgggttcaacagccatgcgtgattgagtattatcaacaattaatcactcgatcgttgtccacgcttgagccagtcaccgcgtttgtttaatcaaaccttgccggtttgcacgaaaccatagtcgacgtagctataaccaacctcctccacggacattccaagccaaagattgtttacacactaacacccctactatcaatatcttataatcatatcattatcttaaaaaatatctcttaatcgtatacaacacggcaatggttaaagattcaccaaagatattctctccgtcctaaaataaatacagttctatactattcatatctaacattggatttggaccgttcgtcttatttaaattattttataattattatttttgttgttattagataataaaacatgaacaatactttatgtgtaacttattatttttattttttttataaatttttgaaataagacggatagttaaacgttagacacaaatacccatctatatacttattttgggatggaggtagtacattgagacacaccattaacgaagctactaattacaccaaccatatccgttatagagtgatgaaagataccagtacagttcgagttctaaacttttaataaggtgattgtatttatagctaattattctttcattcgtagatgatatacccgtcaacagcaagacatccgtggtgatttaatcaacttcaagatataccaaaccagtcttactgagatgttcaaaagaaatagaatgtgtgtatgcacgtttataggtgtgagtgtatgttgtaagcgcatctatactttttttttttaacaaacgaacttgtagtaccttcaaacaaacaaacttgttaggacctctttgtttaggcttagatttattggtttatatatagttataagttaatttattggcttatatgattccctatatgatctataagccgatgaatttaatgtctaaatttaatagtagagtcataccttcacctcatataagtcaaaaatattatccaatctaatctttggtttaatagagctagaatgacttatggcataaaaaacagaacgaaaaaactgtttgattgtttaagcttagtttttttaccttataataaactgatttataagtctacacatgcatttttggctttttttttctttgacaccgttctctccctcgcgacgctgtttctccccgcgaaataaagtgacgtcaccgaacgcaggcccgccgcctccgcctccgcttccgctcgcccggacccgcctgcgccggccgcacaagggatgcgctccctcacctcccgccaccggccggaaccctaaggaggcgcgtgcccacctgcggctgcctccggcttcggcga

SEQ ID NO: 11834 - DNA, 736 bp, Oryza sativa
aatggatgataagtagaattacttatcattggtctgtgtgtcaggatgaaatataactatcaaaagtaaatggagggagtattatggacaacatcctagttattgagttgggaatgaccttagagatgtcatcaaacatcaattaatttatcgctgacacctgtctcttatataaggctgagtttgaataaacttttcattttggctactctctcattttctgtaagtatgctaaatggtactctctccgtttcagaatataaggagttttagagttggacacagttattaagaaagtaggtataagtgaatggtggagggttgtgattggatgagtagtgggggtaggtgtaaaaagtaaatggtggagggttgtgattggttaagaagagaatgttggggaagaagttgttatattttgggacaaatcttgagggctaaagttgttatattttggaacggagggagtacgtttttttagaaagaaatatgtagattatttttagaaatcaaataaatttattttaaagtttataatacttctagttaatactcctacttaattaatcatatgtccctttctcgtttctcgtgagctggcgtcgtcgttgtcctgtagccgtttcacgggagtacgtacgggacgcgtgcgcgcgccaccacgcggaggtaaggcaggggaggggaggggaggggaggggagggggagccgatccggcgtcgagcgctgatccca

SEQ ID NO: 11835 - DNA, 1501 bp, Oryza sativa
ttccgtttcgctcatcatcaccggcttattttaatgggacattcccccactaaaaagctgagcggctttctccgatcgctaactacaatcaggcatccagaacgagtcgttgataactttaaaaaactactcctagtgccgtgctgtgctaccactgtaaaccctaaaaaaaaatgccacgctgtaacaaagttgttaccggttacttgaactgagtaaaagaaaagggaattgctatacgttatttgaatgaaatttgaatataaaatcttctagattttggttcattggatccatactaagattcatgcatcggcttctcttctctaactgtagtgggctccctttcttctccggtaccggcgacactcccaactccgatagggaatatacggattagggtttagggttggggtcaggataggagaggaggttggggagggggaagagcgggtttcctcggggcttaaagggatggcagtgggcggtggacttcggcgggcggcgaggtggtggcggcaccgccgaagccgtagggatggagaagggcggtgggccggcgttggcggcaggggcaaagcaagcatgcgattaggaggcgacgactaggtgatggtggatccggcagctgggagccgccggagacagggaagatgatggggcgggggcatctcgccatcaccaccttgagaagaaagagagggaggaagggggagcggggagggggagggggctcatcgaggggcccttatcggcgccgttgactcctttcggccagtcggcgaggcgggtgatagcgcggtggggcggtggcggcggtggattgggcggtaacgcgatggcaatggtggatcggaatgctcgaggaagcaaagggaacatgagaagaagaggtagggttaagggcttgcacaaaacttaaagcaaatttgatggtctaaaaatcgaatgatataaggtgggattttatattagaagaggtataggcatcaaagaaaaaaaattggtaaattttgtactcgtagctagtactggttccaaaatttaactgtcaaggcaagtacaagggaggtcggggaggatgattgggttgggtagagcggccacactattgcggaatttcgcgaggccaagtgagggtacaccaggacaccaggtactacaccagtactgggtctcacggcatctcgcatcgcgatcagcggtcaaatcccacacacacgccgtaggatccagtcaatggagagaggaaaagaaaaccaaccaacacaacaacacagaaaagcttcgccaagtgaatcacccaaaaaaaaaaaactcctctctacgactctaccaacacgccgccgtcgccggctcgctcgctcgctgcccatatatacgcgcgcctcgcgtctccacttcccctgctattactactagtacaaaaccaacgcgaagctctcgtcgcgcacaaccaactcgacaccgcggcgaggcgaaccaacgcgcggcgtgggca

SEQ ID NO: 11836 - DNA, 1501 bp, Oryza sativa; identical to SEQ ID NO: 11089

SEQ ID NO: 11837 - DNA, 1501 bp, Oryza sativa
cagccttggagcaacgatgacgctgcatgtgatggagggaggacggaaatttcgagcggtagagtcgggtaagattggctaaacctgattgcgacttgctaatacaatatttcttgggtctcgtcttcgtttccttctctttggccgagtcactaacaccagtggcgctaaagtctgcagctgcagagactatggcacactgtcttgggttaaaatatcatggcacctagacacctgtttccaaagttaagatcttaggaagaatccaagatggtttagaaaacgctaattataagaaaaaaaaaccgttctttctagaactcatctgcttgtcctgtgcgatggatcgagatgagatgacggagagtttctgatcgatcgatgtggccctgcatttctggtgaacaccaatggatgcctggcaactctactggagtgcttccaaaatggtgttgacaagaatacgttgattagttcatgtttgctttcttaatcgagatcagatcacagagctttcgatccgttaggtacaaagcatgctgagcataactctatggccgtcatttgaactgaactttaaaactgaacagacagtcagatttgcaatatattcaaccatgccaagttatgctagctctgaattcctattgcttcttcagctgaaaataaatcagatctctctcctgagaaattcagctatcagggacctgcagcatgtaaggctgcgtttgttccttcagtatgatacgtaaaacgaaaagctcatcaacatataattgattaaatattaattataacaaacttaaaaatttatttgattattcaaaaagttatatagatttttttaaaatatattgttttatagtttaaaaacgtgttaacaggaaacgagaaaattatactacggagttgaaaaaaaagaacatgcactaaatcctccttattccaatataaatctaatcgtatgcattcaaaactacatttcagtttttgtattttgtagtttctatcagcattggattctgctaaagtgctataaatcggcagcccccttccgatttccgccgtccatttcatttttacccaaagaaacaaaaaaaagtacaaacagaaattcttaaaaaaaaacccagcaaataacacgtcattaaacggaaactaatccgttacatgacgtgggccccacccagccgcgccagcccacctattcgttcggcttctcccccgcccccgccgcccgcctcgttcgcttctctcttccccttccttccattccagctagcaaccgcaagtccgcaacgcgagaaacgcaggcagcaaagcaagcgaacccaaagctggcctcgcactcacactgacagccttgctctcctcctccccctatatctctcctccctccctcgccgcctcctccccaatcctccaaaccctaatcccccacctcactctctctcgatctcgtgctctcctcctttcgcgagcgcgttctttggaggggaga

SEQ ID NO: 11838 - DNA, 745 bp, Oryza sativa
tagtatttctatacatctaaagtttatacacctaaagtttagtttatagatccaaagtttataagtcaaaagtttacatacccgattcaaatttaaatttgaattatgtccgattcaaatttgaatttgaattcaaatattttctatatatagtatttctatacatctaaagtttatacacttaaagtttatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttat

SEQ ID NO: 11839 - DNA, 1501 bp, Oryza sativa
agtttcaaacttccaatttttctatcccatcaaaactttcctaaacacaaacttccaacttttctgtcacatcatttcaattttaaccaaacttctaattttgacgtgaactatgcacacccttattaccaacccaacccaagtaggctagtagtacacataacgttgaccaagccattcaacattttttttagaacagccaagcagcatgttgaatctatgtgctactctacctgaagtcaagctgatgagctactccactcgatatgccaccaaccctagtgtgaaaaaaaaaactgaaacagccggacgccactcgagctaacggacccgaccatgtaatcggagaatataaaggacggcgggatgggcgctcgctcgctgcgtccacgtcggattttgctacagtagggtggaaattatgcgaaaaagccctccgatttttcgtaataatgtataggtccctagtgtaacattgccggccgggcggctggcagcaggaaggagcacaaacttggcgatccgacggggcccgcacgtcagcggccggatcacattagctccctatttgctgagctgctggaaggccaaagggcccgcccggcacggcccggcccaggaacagctgggcacgggctagcagccatcgggccggcacggcccgataggcacttcgtgccgggccatgccggcccatgggctgcacctcccgcccaggcacggcccaccagctgtcgggccgtgccgttccggctcgaaggtatgggtggcccatcgggcctttttttaaataagtctatttttttccctcctctttgggctatatcatatgtatagctaaagtaagtctatattccatccctcttctttgggctgacatatgtatagctaaaataagtctattttctatccctcctcttcggctgacttatgtatagataaaaaaagtctattttagatccctattctttcatccatggcacataatatgtctatttttactcccatatttttttttgtatcggcctagctgccggcccatcgtgccgggccggcctaacatgccggtggaggggcccaagcacggcccgatggtcgggccgggccagcatgggcccgacctccgtcgggccgtgccgtgcttaggccggaccaaaatgccgtaccatgggtcgggccgtcgggcctcggaccttttggccatctgcctgctggttaatcaatcccttcaaaccacagcgtagaaatgtacaccgacatctagaaaacctcctaattacgagtactactcgagcccagtgaaccagtcagtcagtactctgtagcagctttggtctacctaggattattactaggaaacacaggtattctgttccaaaaaaaacacacacactcgtgttgggctataaatactcgtgcacaacgcatgccttctgcgacagaaaagagctggacgtggtcacgtagagtgcaccactgattttctacagcgactcttgag

SEQ ID NO: 11840 - DNA, 329 bp, Oryza sativa
gagttttaagttcttggtggttgtggcaggtgatgcacccaggaagttctgacaactgatgctaaggctgtgtttagttccacgctaaaattgaaagtttgaagaaattgaaacgatgtgacgacaaaagttagaagtttgcatgtttagaaaagttcaatgctacagaaaagttggaggtttgaagaaaaaagttggaatctagacaaggcctaacttttcttcatcagcaacagaagacctcaccgcgggaggccataatctgaccaatcacaagacaaagtgagccatgctctagcaaaattagatgggtttcacatcataaaatg

SEQ ID NO: 11841 - DNA, 1501 bp, Oryza sativa
tgcagctgttttcgcggtacagggtgcaacaaaagcccatgacggcccacacctgcctctctccgctccaaacaccgaaacaagggggtgggtgcaatgggccggcgctcgaagaccgcgaactctttccaacagcccagcgcattagcccctcctcctactctctctaccttctttttaacatgcgactttctttctgtggacgacggcatcaacgacgggagcaggagcgggggctgaagcacggtgcgtgggctcctggagtggcgacggcctctccggcgagcttcctctggcgaactccctccgctcctcctatggcgaaatccaaacaagggtcagtttcgactccaaccttctcccaccaccacctcctgaccgtgccaccacccggccttgtcggcactgaaaggcgtcaacttgtcagcgcgggcctgctcggtcggtctcctcctcccctatttcgtttagctttgcccccgccaccaacaccggcccacggcccatggccgaccccgcggctttggcgccgccatcgctatctcgccgctgtccttttttcatgaccttcggtgccatccctctaaattcgatgcacctccctggctctatctccctttacctccgaaatcctaaccctacccataatctctagtgagtcttgtctttatttatggcctctttgaatcgcaggattgataaaacgtaggattttgataggaatgtaagtgtaaaacacatgattgtaaaatagaggaaaaacataggaatggccgtttgattgaaccgcagaaaaaacacaggaattagatgagagagatagactcaaagttactaagagattgaagcttttgctaaatttcctccaaaatctctataggattggccattccatagaaatttcaaaagatttaataggattcaatcctttgtttcaaaaaacttcatagaaaatttttctatagaattaaaatcctctaaaattcctatgttttttctccaattcaaaggggcccttaggttggaatttggaaagtgttcgcgagaaatcaagcggtcgcacgttagcgaattaggatttccggaaacaaaggaccgactccgcctatccatcgtcacgagcacagtgtagaacctcccagacctcaagagaccgttcaaaaagcgcgcgcccaagcggggcccaccaacgcgtccccaccgtgtcgcctcctgattggttgtcccctcttcctttcacgcgaaccggcaccctcccgacccttccagaacccccaatccgacggccaggatcgcccgcgcgcgaacgttctagacccccgccacctccgccacaaaacctctgcccctcccctcttcccccgcttcgtctcgttcgagaaatcagaaagagagagaaattccacccagcagcaagcaatccaatccgagagcgcgcgtttgcgaatattcgctttctattccgcgaggtttttggagagggaggagaaggaggaggaga

SEQ ID NO: 11842 - DNA, 1501 bp, Oryza sativa
gccacaaagatgattgttttctatgtcgttatccgacatgtcttagcagatcaatagtaggaaagatcggtaaagttagtagtcattattccgcgttgaactaacctattatagcaaaaaccttgatcactaaattaaaaaatgcaacttacacaaagtgagggaggtaaagaagaacaagaaaagaaggagagatcacaggtcacctgttgcataccgaaaatttccggcttaagatcacgaggcagattctgcttagtcttaaagaagattgaccttttgaagacaagcaggtgaaattacagtgatctgaacacactcacttggtcagtgattccaaacgttagcttcaagccttcccctttgcccctgcaaagagagtgacggacatgactgaagtgagcaacaaagtcccaaattgtagctttctttccgccaaagtgccaatggcctcagaggctcatcagttcggtgaaaagcagatatcttcagtagtagtaactctttctacgcgacaacttgttacttcctccgttttacaatataagtcattctagcattttctacattcatattgatgctctagatcatcaatatgaatgtagaaaatgctagaatgacatcaatatgaatgtagaaaatgctagaatgacttacattgtatatgtctagatttattagtatcaatatgaatgtagaaaatgctagaatgacttacattgtaaaacggagggagtagtattttttatttgcaaacaaggttggaaagtattcaggtcaaatccttgttcctgttaggattgtagtggatttgcagtaattatccaatttatgaataatttcgttgcgttgttagttgattggctggcagtgtcaggcaagatcagtttaacataagcatcacagcagaacactgagcagcatgtaatttctgaccatcaaaacaagcaatacgttcagtaactgagaagctgtagttacgaaaccaaaaaaacaaactagaaattagaagctggttttctaggttcttggctagctaccaaccaactgtttctatataacaagccctatgtaccatgaacagaattcattgagcaaaacctttcttggctcatttgaaacccaagaattctcgccgtagtaaatgtttagttcctgcagaaaacggggaaaagtctgccccattccaaacaagaacttggctgtcacaagagcgacaccttgagcttctgccaagctcaaggaatatgttgccagaagatgtttcccacatggagttaaagtatagcaatagctccaaatttgatctcttcaaaatccaccacagctaggatactgattgcaactggctgcaaattcagagcacaatttttttcgttagaacggccaaacctttgaaccggtcctccctctcctagcctctgcctttgaaccggtccggatccccccaaatcatgcggtttctttctcccccggagcaaggatgacgatcagacagcga

SEQ ID NO: 11843 - DNA, 1501 bp, Oryza sativa
catgctcaaatttttacattttggtcctttctgaaaacttattttacaaatagtcccctagaaaaacttaacccgggaattatcctttttggagcgctagagaggctagtgccgtggtccaacatggcggcgccgcgcccgtgccactgtggcactagggctatcgtggccgtgctgactgggcagaggggggggtgctagccactctggcaccgcccccccatacgacggtgccagcctggctggcgtacccctcctggaagggccgcgcccttaaaccccgtcggccctaccacctttctcctccccacagccatttgcgccaagtcccagcccgagcagcagtagttcttctcccttactctctccccctcacctctgcacctcaaatccactcaatttgaagccgtttttttgcgggattttttgtggaaatcgaagagaaaggtagactcatccattcccccctcttttttttttcatttttatcgattgaatttgtagatcggagggtaaccctagaacccctttcttgcccaaatttgtgatttttagcatatgttcttgggattagcttgttgtagtgctgtatgtgtgcaatgtactcattgctgagttggtacgggaagacttggaggggcaaggagagaagaagagacctttgtttgaaaatgatttatgggaggcaggaccatcaaatagacattgcggtagtgatgatgtggacgaagcgagggagatgaaaagggagttagtacaagaggggcttgatctaagtgaacatttgtcggagagtgtacattggtcgtcgtatggaggcaaccctgaatacccggcgcaagtagcaggccaatatgtgaatccagatgattactttgttgtcgaattgagtggtggtcacgattctgtttcagtagaagtcaatagggaggaggttgatgaggaggcaagtgttgagaaatatgatgttgaatttgctaaagactattatgatgaccgtccattccctccactaattaacaatgacaagttagcattagaggaatgtcgtgcgtttcagaaggtgtttgggagaaagccgaacattcatgagtttagggacctaacacatacccatggtgcaatactagatggcggaatcaacttagatcagttgttagaaccattccaggtggatggtctcaaaaaggatttagagttcccatccatggtaacattgaagctatggctccaggagtacgccatcgtgcaccatcgtccataccgtgttgtcaattctactacaaataggaggtatatgttaaatgtgaaaacccacggtgcaaatggaaggtccatgcaactaagaggtctagtggcacgtggaggatatcacgggttggtaaggcacatagttgtgctactgccgaaggttcagggagacaccggcagctgacatctaagttcatagcaactaggttatgcaatgccataaaattgcaacctacactctgtgcttctg

SEQ ID NO: 11844 - DNA, 1501 bp, Oryza sativa
caattacttagacaaagtaaaacaaattaactaatagtacccattttaggttaattacaaatgactacacactaaaaattgacatgatttaatttcctatcgattaaagggaagacgcacacggacaccacgcgtgagaaatgataccgggattgatcgtaagttgatgacaaggtttctgactctgaaattaccttcactatgcatgatcctaacaaattatgggtactttcaaaattcttagcattaaatttaaataaatgtagcttaagaaacaaattaaacatcatatataatgtgtaaagctaaacacatatgaggtagagggttcatggaatttaatgcaaggaaaccgtctaggttaaaagaagaagttcattggtatgcattaattagcttactatctaagactaggcttttggacccaaagaagaagtataaaaatcttatccctaaatttatttccctttactttggtcacgtgtcttctgtttataaactgtaaagatgatttccaagtgaacctataaaaaaattaatatatctttagcaacaaattaaccacctcatataatatgtgaaaagccaaacacactatgaggaagaaggtttctggaattcagtgtcaaggaaactgcctaggatagaaaaaagaggtcatttgtagtatgttttaattagcttaaaggatatattgatctctaatacttccatctttggtgaatgaaaacatatagcgaggaaaaatttggtttattcctagaagtttagatgatacaaccgtcaatatttacagacagtataaaaattcactaatttcacctttcatagaaatacagctagcacctgcaaaattcattaactcagatatgcattgtgcaatcttaaggatacaaatgaagggcacctaaaattgcactgcacccaaaataagcacatatatcctatacatttaagcgatatatgatacgctgcatcaccttccgtccaattaactgcgaccaaatctgggtttatttttacttgccaaattcgaaaacattaaattggaaaaatgtgtgcacggttggttacagcccaagattagaggtgaaaatagatcaccagaatagctggcataatgaattagctccaaataaagctggcttggaagcacgtagtataagaaaggcagcaggtaaagaaggaaggaaactgaaacgggaaaagagatcaggtccttttttgcgaaattgcggatacacccttcccgaagagccccagaacggccggtcaacggcaccgttgaccgtatgagggggggggggcagtttcgtaaattccacgaaacactgtcccactcctcgtcttcttcggattgcctatatataaggccacacctcgtcttctccattctccgtctccaagttttttttttctctctctctttggcgccgttagcttgaggcggcgaggagctcgaccacttggaggacatggtggcgaagcgcggcgccggcgc

SEQ ID NO: 11845 - DNA, 1501 bp, Oryza sativa
agccccaccttgtgcaggaatcaatagccaaacccatgtcacttttaaggttgagagaatcaatatcagcactgaacttgtatgctggattgtttgatttcttgatgtacttgatagtgtccctaactttgtcaattatatgcttaatcacagccagaccatcttggacaattaagttcaaaatgtgagcacaacagcagatatgaaggaattttccataaaaccaaagtgaaccacgttttgtaaacttggcaagcaacaggttagcagcactgtcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggtaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggcaaaatggcaactcatggacaatgatcattttgcaaataagctcacgtatctttgtagtatcataataaccagggacagaaacacaaggagcatcaagatcaacatcaccttcatcaaggctagggaaattgatattatgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaattaaaaataccaactgctatcaatatatattctgcacaagggaaggaatcaaacaagtacaacaagaaaagcattgccatcaatttaccttggcaaatggcaaacacacggtgttctgcaaccttcagtctttcttcagaagaggagcacagcaagataagtactactccatgtctccacctagtccataaaattcaatgtaaatcaataacacccatcaagcaactaaacactacacagttaatacatgtagggccctagatacatgtgggtgcaaaagaaataaaaatgtaaaacaaagaaagaagaggaaacttactcagatccgagtcg

SEQ ID NO: 11846 - DNA, 1501 bp, Oryza sativa
gcaccctgcttgcaggattgcatgtgtttgaaaatgtttcatgctaaattttagctactcattattgtaggattcagaaactactaggctagggttgcactttggtgctaattgtaacttcattctctttttctgttgtactgcatcttgacatgcttgatgaataaaaatgtggcttttgtagaattgctaacttcaatatttgttcttatccagtgttgtcgatgacagtgacacagtgacaccaagcattctaagcactggagctggtaattcatttttgctattagaaaagttgtccctttatttaccgctctttggttgtatttaaccatttcgtcccacttttcgaaattatacagatagcctcccagaaggccttgtccgcgaactcccaactgcagattcctaccaagaaccagttgctccagttacatccggggctattgatgacgaccttgaggagcttcagcgccagcttgatgccctaaactcgtcttaatgttttgtaaaagctggaccgtcatcattaacttggtttctaccaaagctcaacactgggttagaaaaccaacctgggtactgatgcttgtgtttactccgacagagttacccatttcagtggatatagcttctgttcataccaaagaggttgaagggttttaagttacttacctgtactgttttgagcttttgtgtacaattttgccttgagttaatgtagattttatgaggctggaaaattcactgttaactaatgtggacgctctgctaattaccgataatagttcaaaaagaaaagtagaaggcattcgtccagaactgtgatgtcatgctgtaataggcttttgccagtgctgtccgtaaacctcaataagcttagctagttgtgtacttgtgtgtctcggcaaaatatcttgcgtatcctgtcagtttttctattataaaatctaaacttttgcttattcaagtaaatacttattccaaaacttaatcatccactaatttcttcgatgtggtcgttttcatttcccttcgcaaaatctgagctgcaattttttgtctaattttcttgccaacaatttttgtctacataatctgatgctaagtgtacacgtgttccaaactcaatcaatctctcagccagagcaacataatgatagggagaccgtgctaaaatatactcccttcagggtttacgaaactgcacgattatcactgttacatgcacggtaaatttttcagtttttgaaaccacagtatatctcacggtaaccgcgcggttaccatcgtaacccttaccacggggttgcgtaaccgtgccaaaaacggtaagagaaatcctgactccctccgtcgcaaaatataataacttttagcacttagaatttgttctaaaatataacaatttttccaccaatatttccttcctaaccaatcacaacccttcaccatttactttttccacgtaccttcacttctcaaccaattacaatatctt

SEQ ID NO: 11847 - DNA, 1501 bp, Oryza sativa
ccacatagaacattactatacaattttgcataaatttcccagcaagagctcatgcaagtcggaataaacaaaaccgtcggcacaaactatcctttttatattttgaaatttggattaattaattatagtcaccttctacagaattaaatacacacaagattgactattcatatatatagtcgctcgtttttttaatgcatgtatatcttttatttatttgtggttgaaacaactcatggatgacgatcgccagcatgatgaaattaatgaataataatgaaaattataaatgggcagtatgggttggagatcaatgaatcatcagcaacacttggatggctacagagagctagcgatgcaccacgagatttgaaggaaaagatcccgatagtatacctgcatatagatacagatattgtaggacaatctcttgtcggaagcaacttgttctctgtctgtgagctgatatttggtcccctcttcctggtggagttcaagaatacgaaaagaaaaaagatcagagctggaggcgcttgtgagccacacgttgaatggataagctaagctaggtgcgtgccaaatgacaagaattgtgtaacgaaattatacagggatacatgacaatatatagatgcagagtgtgtgcgtctatagcgctctacatatactaaaaatttcttacaaactttttactgatgaaaaatctcaaccgcttgattaaatcaactggaagttctaaaaagtcaagaattaattgcaacatgacccaatagcattaacttgtacaaagttagtacaaacagtatagtacgtatatcttttcccataatttttttggaggaacctacaataaattgatattaagagaatttgtacatcatatatatcatcttataggtatatatacactttctaacgactgaaaaaataaacagccttaatagaactcatgggccgggaattatactgatggtctaatttgatcacaatggtttttttttgttgtaaaaggttttaaaatttttatggcatatataactagttataacatctcatcgatcctttctcaccgtgtaaatgtgtaatgttttcatgtcaacttacctaaatcgatcctttctcactgcagtcccaatcaaagctagctaactctgccagatctttgggtagctagtgtgagtttgattagctagctgcaggctgcacggacgagtgtactgagacatgttgagtaagcaaacatgtacgcatggccgggccaagcttgcactggaggcaaattaagaagagtttcttttttttttccttgtggttttctcttatgttttgagacatgtagtatagttactatcctgtaaaagaagaagaaaaaattgtggccttgcctttgaggcttggaccgcggccggatagtgagtgtgtacgatgcatccatactagaactctgtctctcgactaatcatttttttcaaaacaaactccactaaaagtctagaaccat

SEQ ID NO: 11848 - DNA, 1501 bp, Oryza sativa
tcggcagaccaccaatcacatgaaggatggaagaagcaaattccatatgtttgtagtcagatttctgaaattttccattaagttcagtgcagtaaacattttagatactcaaaccttatatatactgatacatatttagttgtttatatattgcttaatatcttaattttacaattcatctgcacctgtggtcagtacgtgtacaaatccagctggtttgcacatgcatctgtagattactatataactcatatagaaaagaaatggattagggaacaacatgcctgtcattggctcgagcagtctaaatttcaacagcttttcggacttttcctagcacaggaattgcttcaacctcagtccttttgattgctctactgatgtttgtatacaagaagaaggacaggataagaaacatcataagtcgtgaccagactcataatataacagatatagaccagagcacatatatgaacaaaatgaagaaggtgtaatatattccaacctggtccagaacctgcaattgttagtaccagatgattcagatgaatatacctatcaagtatcaacaggagtagcaaatatccatagaactaaccccagcttgagtgatccaaacaagtcgatctggccatatgggcgagggcatgcactggaatgtgacaaggtgtggcagcagcgggggatcgacgacgttacttgagggtgagaagggaggagatcaccggcgaggaggcccatgcgatggggaaggagcagggagcccggcgagcttcttggggcgccatgagtgacggcgatcttcctgggtggcaccatggggtgggggtaggcagtgggcgacgaacggcgctcgagctccactgagccgtcggagtagagaggatgcgcaaagaggggatggccggcgcggcggagggggcggttgaggtggagtgggagggatgacgggcgacggcggcgcggtgcgttggcaggggagaggtggcataatttttgggtgagccgtggtctgcgggaggagggatgggaacggggaggagaggctgaggggagaacgtggaataatctgaaccgttggattcgttgaatggatggatggatggtaaggatttggctggttgatttcaccagttggattgcaaggggacaactcctcctttttatattagtatagatataagataccgaattctaagaggatttctcgtgcaaaaagcccaccgccagctttagataataagataccgaattctgagaggatttctcgtgcaaaaagccctgccacgtggcacatgtggttccaactccccctcccccccccccccggacagtcgtgcgatcaggtttcattagcaaaaagttaaaactccaatgataccgacctaggcaccccaatccagctttcttagtactagatgttggggcgcgcctttgcgcgctgcctgaaagacatcaacacaataagttaatgatccaagaaacaaatgctaattataca

SEQ ID NO: 11849 - DNA, 1501 bp, Oryza sativa
ctttgctgataattatttttgctgttaagcaatacacacaatagtggagcttgaactaataaatctcaagaggggccaaaataagattgcggttctttggaatttatagacattggagttatacaaaacacatgactaagcaatacatgagtacagcagctctaaaacaaaagcatctatactaaattacaacattaccgcatacttatgtttcttcattatatattcttgatttctacactctaatcgcagcgacttgtttcacaattaaatatctctaaaaataataaaatcaattaagtagatggaggaattaacaagagaatgcacccaattatgtactatatatgaagtactaatcataaaaatcttcaaacattggggtgggggtcgggtgagagcatacggatcttgctagcctagtagaagctctatccctgcgtaggctgtatatatctctttaggaattctcattgtgagcaagttactttgtattatgtatgaaatggtaatttgtaaggttccattgtgctgccaacattaccaaaggtgttcgtgaatcgttactagtactagtagtagtacagttcaattcttcaatgttttaaagctagctatcagtctatcactgcacgctgaccacttctcaccttctttgctagtgtgcattggttataagaaaagttgggagctatgagccttgagtataatctcgagccgaagaagctgctttcagggctgacaatcctgttctcgctcctcgttgtaaacagattcgatggtagacaccaagaaagaaattgtggaaacatttgtgtaaatctaaaaagacgaggcgcacacgttatcgtttttgaaactgccatcttaatggctgaagtatactacactcctgtattatcttttgtggcattcagcgaatcaaattcgttccatattctacttgttctctctgctattattatctaacaaaagcccaaatttgctaccttcagacctcagtctccaactgatagttgatgataggcgttaggttagtttactggaatattggatggattgagtggcaattgatcgatacattcgctgaaccaaaaaaataatattccagcaagcacgcaagcaatagtttacctctcatctcttccattgctcaacttatgttctgcaagttgatacgcatttatgtgttttttgccgattaaattattacgggatatataaatatagattggccttttgatgggcccatttggcagggactcctcgtcattattcttgtgaaagaagtctaacttcgaaatgcaattctccaaatacaaaaatctccaagggattagaccgcaaaaaacaactcgagtacacatctccgccttccctttctcctcctctctcctcttcccctctccaagtctcccggtctccttcctcctctcttcccggccgcctcgcctcgcctccgccttcccgatcgcaattcgcctcctcctcctcccaccca

SEQ ID NO: 11850 - DNA, 1501 bp, Oryza sativa
caacccacaacagggtgtctcaacccatagccacatatatggatttccttccctacccctagcccaccgagcacccactagcttcttcccatctcttctctttttctgtcttttcttttcgcggtttttcttcccctttatcccctcgccgcttctcctctccctcctcgcccagatgcgccgccgcctcccgctctctcctgcctatatcgctcgcatctctctctccctctctcacccgtcactgctgtctccctctctatctcggcggccgtcgccgtttctcctactctctctcgtcgccggttgccgtccacctcgccggcagccaaatccactctctcacatcctctctctctctcccgtcacctctctttcgccgccacctgttgtcgccgcctctctctcctgtcactgctgacggagagtggcgtgtggggtgcggtggccgacgacgagcggtgtgtcaggagtccagatctagtcggttgcgtcgtccccaggccgtcgtcgtcgcaaatctgtcctcgccagggccgtcgactgcgtctccacctcctcgccgcttctggttccttcccaccactgtccacctcctcccagcgacgaggccaagggtagaaggggaaatcgcagatatagaataagtgtccatgagcaccccaagcccccaacgcatagcctcgaaggagtggctccagaaaagcggagttgaggggtcaagggcgcgtgttcccctcgtgggggtcgcgcctccctctaggggcacacctcgtggacggacgacagacaacatgagccgggtgcacgctcaggggcacgcattgtagtgaggatgggtaaatttgggtataaatataggctaaccagtaccctccctagtggcaggcccacaaatgaatcaatttgcaccgatttttaaagggaataagttcactttgtgtccctctatttgtcgcccagtccgattttcatcccttgaccacaaaaccgggtacaacccgtcccccaacttacgaaaaccgggcaaacaaggtccctcggcggttctgaaggcggttttggctgacgtggcgcttacatggcttgtttaactaggtctccgtcccatgtagcattgacgtggcgcttacgtggcaattatatctcggaaaaataataaaaagcgtggccccacatgtcagctgcacacaaaaaataattttaaaaatgtggggcccacgtgggccccacataatcagcctcgctcctctcttcttccctctcccttctctctcttcttccttttcccttctctctctcctatctgggtagtggacggcgtgggtaggcggcggagtaggcaagctccggcggcggcggcgggcatggtcggcgccgccccccgaccggagcgcctcgaacagcgcggcgtaggcggcgggtgacggagaagcgcgcgcgctgggcggtcggagtcggcgagcgccgcgacgtcggaattggccggcggcgggaggat

SEQ ID NO: 11851 - DNA, 1501 bp, Oryza sativa
taccatgcgatattgcgatgcaagtcagattcttctttagttctgcaccaatcgaagtcgccaaaagcataaaagtcaagcagaaagcggcaataaatgtgttcagaattgaacccaagctgacggcgacggcgccggcgccggcgcgggatgcagcaggctatcgcccacccggatagcgcttcggtctcgcacaccggttttagctctgagatcaggggcggccagtagcgtgtagctagctgatgtgagtcctagtaagaaatgatagttttcaaccgagcgatgtgtctctgaagttgacgttgcaactgaacttggactcgcgaggaatgtgtaaactactcactctaataatgaaccatgatatacagctcggttactcttcgttattatatttcgttgtagttttagtagtggtaatgttagcgaaattcaatcagtataataatcggcttgttttcgaacttatattttcggattcatcaagaaagacaatgacaacatataactttaaggacactaggataaatgacagttaaggctgtgtttgcaactcctttttcccgacccatcttcctcgttttccgcgcgcgcttttcaaatagctaaacagtgtgttttttacaaaaagtttctatacaaaagttgcttaaaaaaatcaaattaatctatttttgaaaaaaaaatagccaatacttaattaataacgcgctaatggaccgctccgttttccgtgcggagggaataagttcccatccaccccatgcgaacacagcctaaatatattttcgccaactgtagatgaagtttgtctttatccttataccagtagtctaagtagtttctctagttaagctatgattttgtaaaatcaaggtcatctaacttatattgatttacttaaacgccgtgggaatgcttggaatttactgcgccacgtcatgcgattttttcagaaaaaccctcctactttcgtaaaatattgcccacgtctgagtttgtgttcaccgtacgatcgccgtgaggctcgatctgaccatccgtgtggctcagctggcggatgtttcactgccctcagatcggtgatttgggaatgaacggcttagatctcatgctttcaccctcccccacaaaaccctagcgctgcccagccgcccccaacctcgcgccccacccccacgcctgatggctggtgccgccgcctcgccctctcgctgcaagacgatggtggcgccgtctcctttcactcgccctctctccgcgggatggcggaagcgccatctcattccccggccgcgccctctcgccgcaggcactgtctccgttcccttcccctgacagtttgggtgtcgccgaatctcactgggattagttcgccaccgtagggagttgccgggactggttcgtcacctctgcgacctggcgacctgacgatctgctaccacgcattctactcctccccaggtcaactttacactccctttgcctaatcctctta

SEQ ID NO: 11852 - DNA, 1501 bp, Oryza sativa
cgccgccgattcgtccctcccgtcgggctcctccaggtccttcccctccatcgccgaccggtacaccgcctcgagcctcccctcggcctcctgcagcagcgcctcgtaggcgtcgtgcgtctcctcgagccgcaccacggcgcggcaggcctcgaggtccccctcggggacccgccgcgagcccccggcctcggcgtcggtcgcggcgacgatcgcgcgggaggagtcgacgagctcgtggtcgggccgcgggccgaggacctggagcgcggagcgcgcggccgacacgtcggcgacggcgcgggtcatggcgcggagcacggacgggtggcgcagccccggcatacgctccacgagctcgaactcccccgcggtggagggcgtccgcggcgacggcgtgtgcacgggcggctgctcgatgtcgaagtcgccgccgccgccggccgggcgggccttggcgagggtggggaggcgggagagcacgtaggagaggatggggtgggcctgcggcgccggatccatggcggaattcgggaggggatcggcgccggaggaggagacgagagtgaaggctgcttttatggcgtagtggcgtctggctcggtggtattttgggcgattttggggggaggcggcggcggcgacgacttgggtactgtagtagttgggtgccctcccctttgcctagcgccggctctgaggctgagctcgaggggaaattggtctctgttcgtaccaaaagaaaaaaaaatcagagttcaaatttatatcatccgattttttagcacaattcaatgttgttgtagacttgtagtacagtttgaagctttataatgtcgtaagccaattttctcgtttcgttagcaagttcacttctagttgtaattcatttgcaattgcagactgatccatacggtcttcacggtgttagagatccgatacatttatttattcttttaaagtgatcgagaaagtgttataaggctcgttttcttatctcagataaaacttctattcaagcgtgccttaatcatatagattttgccgagaaactggttatgtgattaacaatgataaaaacctataaatataacattttatatagaattagacatttttatgatgagtaactcgattagcattcaagcctgtacacctaagatgaaaccgagggatgcacacctcaggaatgtacacttggaaatccatacaaaccgagcgccaccaccatgactctccccatgagcggtgcggtactgcggtggccagatcaacagcaccaggaagtcgcatgcacccacgttccgcagatgatgatcttgtctatccaacgagaagtcacgcccatgttcaatacggcatcgcccgatctaccaacagttggccacctcccaccacatcgtgccggctcgacacgaggaaaaaccaccggaattcggccggctggtcacgcgcgcgcacgcacagctcggttcgggctcgacacttgtacacttttttg

SEQ ID NO: 11853 - DNA, 1501 bp, Oryza sativa
gctcccggggccgcgtccaggcggcgctggatattatgcgggagatgcgagaacgcggaggaatcgcgcccaaccagtacacctacggcacggtgatctctggctggtgtaaggttggccgggtcgatgaggcagtgaaggtgttcgacgaaatgctgaccaagggagaggttaaaccggaagctgtgatgtacaacgccttgattggtggatactgtgaccagggtaagctggatactgcgctcctttaccgtgatagaatggtggagagaggggtcgcaatgacagtcgcgacctacaatttactcgtgcacgccttgttcatggatgggcgtggaacagaggcatatgagttggtcgaggagatgggtggaaagggtcttgcgccggatgtgttcacgtacaatatattgataaacgggcattgcaaagagggcaacgtgaagaaagcactagagatttttgagaatatgtccaggagaggggtccgtgcgacagtagtgacctatacggcattgatatatgccttgtctaagaaggggcaagttcaggagacagataagctgtttgatgaggctgtaaggagaggcattaggcctgaccttgtcttgtacaatgctctgatcaatagtcactccacttctggcaacatcgatcgagctttcgagataatgggtgagatggagaagaaaaggatcgcaccagatgatgtgacctacaatacgctaatgagggggctgtgtctactgggacgtgttgatgaagcgcgcaagctcattgatgagatgacagagaggggaatccagccagaccttgtcacttataacacgctgatcagtggctacagcatgaagggtgatgtcaaggatgctctgaggattcggaatgagatgatgaataaggggttcaatccaacgcttttgacatataatgcgctgatacaggggctctgtaagaatggccagggagatgacgctgagaacatggtgaaggagatggtggagaatggcatcacccctgatgacagcacatacatctcactgattgagggtcttaccactgaagacgagcgtgccattgatgatgagcgactggctgcagcagatgctgcgaaagtatgagccatctattaagcagagaggcattttgggcagatagagcagatcagttcaaatacttcatgccttcaaaaaaggaggaaaatcaaatgcttgaacgacttgctcaacctctgccatgtgtgcaatatcatgttaaattgcctggccattttctgactggagtgcaacataatcattttgaagcctggcgtatctggcgatgaggatcaggtggcactcacattttgtctccccgttgttcttgcccaagttgtagacgtccatcttttctcagttcatctgtggacgtatgcctgtaattttgacaagaaggaaacacatgctgttttgaagattcccgacaacaaacattccaatctagaactctcaagattcggctt

SEQ ID NO: 11854 - DNA, 1501 bp, Oryza sativa
tgagaatgtcaccatggcgaaactctgcaagttgcatgggtggaaagtccgggagaccccacgacgtgtcttcgatgctgtactattcagcaatgagctcgatattcttgaaatacgttggaatgaactaagcccctatgtctcagagtttgtgctgcttgagtcgaactcaaccttcactggattgaaaaagcccctgcacttcaaggaaaatcgtcatcgatttggatttgctgaatcacggctgacatatggtatgattgggggaaggttcgtgaagggagaaaacccatttgttgaggagtcatatcagagggttgccctggaccagcttattaagattgcaaaaatagaagatgatgacctgttgatcatgtcagatgttgatgaaatcccaagtggccacacaattgatctcctgagatggtgcgacgacattcctgagatccttcatcttcagcttaggaattacctctactcatttgaatttttcctggatgacaaaagttggagggcatcgatacacaggtacaggtctgggaagacaagatatgcacacttccggcagacagatgagcttcttgctgattcagggtggcactgcagtttttgctttcgctacattagtgattttgccttcaaaatgcaagcttacagccatgtcgatcggattagatttaagtacttcctgaaccctgaaaggattcaagatgttatatgcagaggggcggatctttttgacatgcttcctgaagagtacacgttccaagagatcattgccaagttggggccgattccaagcacattttctgctgttcatcttcctagctatctgctacagaatgttgatcggtacagataccttctcccagggtactgcaggagagaaagtgggtagattttgatgatctacactcttcaatctgatgtgcaggcctgtcactgccatgttctccacctccgagattggctggccgtgacggttgcatctgatatgattggctaacttagctggatgattgcttgggatgagtggctatggatgatttcatcatccttcactgtgcaatctaacaccggacgaccctacaggctacagcatagtgtatgctcggtcgtggcatggttaccttcccagaggagctcattaccctgtggtagccaccacaagttcacctgtcattcatattacttccctgattgatacataaactgagaactgctgtagattgcaaaatcaagtgagatttcagatttatatgctgtagaactagcattaccctgcagataatccacacatgcttttattctctctttctttttcgcgttggtgttctgttcctttctttgatggctgcatccaatttctggttgaccaaaaactctggcttccgttgctccgtcgttggaaattgccgcatgattgcgtgagcacttcttctgtttcttcatccatcattgacttgagcgcttgtctggtatgtgtcctgtggtcaatccg

SEQ ID NO: 11855 - DNA, 1501 bp, Oryza sativa
tgtatttattatgatcaaaaaagatcatgatataacattgattatattttgcaaggtatctttccgtttcatattataagtcgctttaattttctttgccaaatttttctaggtttgattaagttgatagaaaaaactaacatctacaatatcaaattaattttcttaaatataatattaaatatttattttgtgttgaaaatgtagtgtataattacacatatcttataagtattctctgactatatttctccttggtatatgggttagatatatactacctccgttttttaatagatgacgccgttgaatttttctcacatgtttgaccattcgtcttattcaaaaaatttacgtaattataatttattttgttatgagttgttttatcactcatattattttaagtgtgatttatatcttatacatttgtataaatttttttgaataagacgaatggtcaaatatgtgagaaaaagtcaacggtgtcacatattaaaagacggagggagtactacatatgtctcaaactgagttcatttttcacccccacacataccaatacaaaataaaaaaaatacaatacctctacattatcaaatcctaatacaactattcatcattttgtctactatatatttatttttcactctcacaaactttataatgcaataattactcaaaaattaacttattttaaaataaataaaatgagcataaatgaacttattatgcaataaagaacgtactccctccgtcctataaaaaacaaatctagtaacaaatgtgacatattataatattatgaatcctgacatatatatatatatctaaattcgtagtattaggatgtgtcacatctagtattaggtttgttttttatgggacggagaaaatagttaagtattatggcacggatatactttttttttatcaagaggggcaaagcctcccattttcattagagtctacacagagttcaggactatggcacggatatacaatacgcttaattggcctccccttaatttatgtccctagaaaaatacccaagcgtgcgtgaggacaaaactgcccagctcgcaccgcaccgcgccacgcacgcaccgcccaccaccggggcgatggatatgagggaggcgcaggcaggcagaggccacggccaccacgcgaacggctataattaggcggttccaaaacgcgcccccacgcttttgcgcccacgaccccccgcgactcccccgctaattacacaactcgccaccaccgtaacgggcaacgcccagaagcgtccgcctccccctccctccgagggcgagatcggaacaaggcccccacccaaccaccgccgccgccgccaccggcgatcgccggcgacccccgggccacgggaggcgccccgccctcctcgccattggagaggaccttctctcctgctcggattcgtttgctctggtggtggtggtggggctttgctggcgcgaggccgcgcctgccatgc

SEQ ID NO: 11856 - DNA, 1501 bp, Oryza sativa
accagccggccgaattccggtggtttttcctcgtgtcgagccggcacgatgtggtgggaggtggccaactgttggtagatcgggcgatgccgtattgaacatgggcgtgacttctcgttggatagacaagatcatcatctgcggaacgtgggtgcatgcgacttcctggtgctgttgatctggccaccgcagtaccgcaccgctcatggggagagtcatggtggtggcgctcggtttgtatggatttccaagtgtacattcctgaggtgtgcatccctcggtttcatcttaggtgtacaggcttgaatgctaatcgagttactcatcataaaaatgtctaattctatataaaatgttatatttataggtttttatcattgttaatcacataaccagtttctcggcaaaatctatatgattaaggcacgcttgaatagaagttttatctgagataagaaaacgagccttataacactttctcgatcactttaaaagaataaataaatgtatcggatctctaacaccgtgaagaccgtatggatcagtctgcaattgcaaatgaattacaactagaagtgaacttgctaacgaaacgagaaaattggcttacgacattataaagcttcaaactgtactacaagtctacaacaacattgaattgtgctaaaaaatcggatgatataaatttgaactctgatttttttttcttttggtacgaacagagaccaatttcccctcgagctcagcctcagagccggcgctaggcaaaggggagggcacccaactactacagtacccaagtcgtcgccgccgccgcctccccccaaaatcgcccaaaataccaccgagccagacgccactacgccataaaagcagccttcactctcgtctcctcctccggcgccgatcccctcccgaattccgccatggatccggcgccgcaggcccaccccatcctctcctacgtgctctcccgcctccccaccctcgccaaggcccgcccggccggcggcggcggcgacttcgacatcgagcagccgcccgtgcacacgccgtcgccgcggacgccctccaccgcgggggagttcgagctcgtggagcgtatgccggggctgcgccacccgtccgtgctccgcgccatgacccgcgccgtcgccgacgtgtcggccgcgcgctccgcgctccaggtcctcggcccgcggcccgaccacgagctcgtcgactcctcccgcgcgatcgtcgccgcgaccgacgccgaggccgggggctcgcggcgggtccccgagggggacctcgaggcctgccgcgccgtggtgcggctcgaggagacgcacgacgcctacgaggcgctgctgcaggaggccgaggggaggctcgaggcggtgtaccggtcggcgatggaggggaaggacctggaggagcccgacgggagggacgaatcggcggcggcagccgccggggatgatgctgcggtgcaggaggaggtgatcgcggtgctgag

SEQ ID NO: 11857 - DNA, 1501 bp, Oryza sativa
tgagacacatgctcattagatctcagctaatcgttatatgcactgtgcacagagacctcataagtaatatgacttggcgattagtgaatatggcttgtatataaaacttacatatatggtatatgggatcaatgaggatatacgattgatattttaggctagaattgaccaagtatattgtacagtacatattgtgttggtatctaagtaataagtaataagtttaagagtgtgttctaaaatgcttctgggattagttactcccttattcggtataataaaaaattaacaaataaataatattattactttttaaatcataacattaaaattattaatagtatacttaataaaaaaaactttccttatttttatgaatagtgtagatggttagtgcactaatatttgccaagtttatattatatttttggtaatttttttaattattaagtatttgattggtagagtgtaattataataatttagtaatattattcttatataacagtattttcttatagtagggagtaatttttttaatgttactcataactggagttgtttttatttttcaaaatgcatttctaatttaacaatacatgttattaagtgatatacaattatataattatataatgtatattatccacttatttagatattttataaatattttgatgacgtgcgtatagtacaatacaactcaaaataacttatatttgtacaactatgggctgaagcctggaattattaatgtggtttttatctcatgtgcaacgtacatactccgaactatatgggctgaaatatgaattttatttttctcatcatgtgctcgtgaaaaagaaaaataaaaagaagacatggggcccacgtacaaaatatgtacgtacttgacgtacgtacacgtacgtgccatgtgtggctttttaaagataataaatctaattgacatttttatgctatatctaatggttaaaaataatattgggtccaccagattaaataaaaaccaacggccagatgttttgcttttttttataattcttctaatttattagagaactacgtggcggtataggagcatttgtatgggtgccacgtgacggacttttagtatataataactaggaaggtagcccgcgcaaatacgcgggcaccttattgaacagtgtttgaaattttgtgatgaatgtttatgtataggattttttttatactcttctaaatctatatttatcaatatttttttggattgttttggaagtttgtttcgatcactggacgtacgagcgtgcgttaagagggaacatgtttctggatatttgtctatatgcatatgtaactatagaggtaagttggaccgatgggaacgtcagatcctttgaggggggtgtcttagacatcctagtgcaattaggatgtggtctatgtttttttattgaaaggatttgatatgtgttgtccataagcattgtgtgcacatgattagtagtactat

SEQ ID NO: 11858 - DNA, 1501 bp, Oryza sativa
tctgcgtctgctttgtacctactccctccgtccaaaaagagcattccaatacaaatttagtgaggagtaaagatgatcaaaatgctcctcattatcgaaaaaattagtaatggtgataggtgggtacagggttttcgagagataaaacttctcgttttatatgctaagggtaggtaggatgatagaaattggtttcttttgggacaaaattcaaactccagaagttgagttttttttggacggagagagtaatatctcctgtaaaaggatgaaacacattgatccataattgtcaaagcatcgaagcaaaatgttcgagtctacgatctgattcgtgttcacatagttgactttgcgtgagcattgttgtacattttcttcgactaggcatcgaaatcaactgcctgcagtttgttcaatgaatgcaaaaaagtatgaaaggtatagttggatgccgtacgttatatcaataatatggtttacatactactatatatgggggaataagaacaaggatgtatattgctagtatagtagtatgtaattatgcatttctactcattgcatgatctaatctacttatatcatctcattgggtgtttttgtctatttatcaggacttgctattttctacgtcaaacttatattgttgctaaatttttctataaacttgataaaacctaaaaagtttgaaaaaaaaatcaaaacggcttataatatattataaaatgaaggaagtacatacaagcttgagcaccgttaattcctaaaatcaaagcaaacacaagcttaagttgagaaaacggaatgaaattataatattacaaaattaaggtaaaattagaattaaaattgaaattaggggtaagaacttccatatactgtgaatataagtgcacactgactagcaaatatcacaaaaatgtctataaataattggacatttacttctaatagtattacacatatctacaaagtctcatatttaaattcattatattttagccgtaacaaaaaaagttaaaaaatctgatagtgttaaggataaaaatctgtcagaattttatcttttttttacagctaaaacataatgaatttgaagataagatttcgcacgtaggtgtaatattattagaagtatgcgtctaatttttttaaaattttgtataacactataaaaaatgcccatgcgttgcaacgaggaggttatttgaattaccttattattatacggtttagctaaggtgaaattcaccgtggaaatttgcttggatttgtttttttataaaattatgagctaaaattaagagtttgatcgtctcaagttaccatttcttatacgactccttctgtatttagagaacgaacttaaaaccatctcaagcatggatttgtatttccaaaagcgagtgaatttaaaaccgactcaaacacagatgacatatcaaagtaccaacaaaaacatctttaatttttataatagtaaagatttatataaaaa

SEQ ID NO: 11859 - DNA, 1501 bp, Oryza sativa
aagtagagcaatccccaaatgatgcttccacaagagtatcatctccatcagatttggacttgtcatgtctttcctttagtgttgtccaaataagatgagcatcttcaagtggcatgatggttttgaacacatcttcacttaaagcactaaacaaaacattagtagctttagcattgagatgtgtgcatttcttttcctcttcaaatgatagctctttatcattaggaggagaaatactcacatctacaactcactctatatgcagacccatggccctaaacacattaagcacacgagtactctaagatatgtaatttgaaccatctagcaaaaggagttcaaggaacatttcacctcttgtcgataatttctctccaggcggtgaagcccgaaatgagagatctcgctctgataccaattggaaggaccttgatgtcgcctagaggggagggggtgaataggcgttcctaaaaattatcacaacttcatagcatattagaatgatgagatctttcagttcaaatcgaaactttaggtatgggattggaagtttcggtctcaaccgaaaagttcagcggataacggaataaaacactagctatgaacttgtagctcgaacaaacaaaatgtatatgaacaaaaggtgacaaataagttatctatccaagatataaggtcaccaactatattaattaaccatgcaagtagaacggataaaaacaagctcaagcacaatatgagagaatgcaagaatgtgcaaaccaagagaggagatgcgtgattcgtttcccgaagttcagattcacggatcctacgtctccgttgaggagccacaagggccagccctatttcaaccctttcctcacgaggttgcacaaatgcactcctcggttttactcttgatttctttccttgcggaggagaaattgaagccttcacaaacattcggtggccgaccacaaccttgggtgctcaccggcgacgcctagctgtctaggagaccttaatccccaagagtaacaaacacaatcgaaaatttgcttgctatgaactcgagtgctcaaagtatggagcgaagctcactagctctcaacttcttagtctctcaatccaactctctccccttcttaaatccctctcacaaagaggcaccacaaaggtagggaaatggggatgactatttggctttgaatatgtctaatacttcccaagaacagtagccactcaaaggagggatggaggagtttatatacccgagcccctcaaaaactagccgttggaggccaagaatgtgattttcggaagttccgaaatgcattttcagataagtccaaaaatttacagaagccaatctcagattcgcagccatttttggaattttcgaaaattttcggagtttttcaaaaattttcggagtttccgataatttttcggaatttccggaaagcacagagtaaaacgaccataacttttcgctcgggagtcctttttgatgatcttg

SEQ ID NO: 11860 - DNA, 1501 bp, Oryza sativa
tgagttggcaaattcatactcatttggtgctgctccgcccttaaatcttcaagccctgactaattcagctatcatccgtgttgatcattcatacctttataatttaattccgacgcaattgctatggcgtcgagtcatccaagctacacaattccatacatgtcttcaacaacaatataccgatgaggctgaacggcagggtgggcggagtctacatgaagactatgtcagtaacatcggtgcacggaccgacgaggccgtggaccactgccggcgcccacacacatctactccaccatcaccatcatgcatgggagaacgtgaagcgaagaccgacgacgcagtactcccaagtcaagccactgcgatcggagacagcccaacataatttgggtttggctccgattgtcggcgcatatacaagagggccacccagttcctggaacacgtctcatcgttcccaggctaggctatgcccctaacatcccctaaaactgttggaattaatgaatgggccttagcccactcgaagattaattctttggaaaatcacaaaagcccacctcatgggatggcatgcatgtggagtttagtaccaccttgcttattctaggagagggggacctccttaaaagagaggatgccctcctagtcacttgaagcatgtgtggtggagagaagaggggaaacacacgcgcgcgctcgctcgcctcgcctcgcttggccgggcagggcaggcggcgcgcgtgcccgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcggacccttctctatataaaccgacctgccgtcttcacgcagcatatgcgaaaatcaatctagggtttgcctcctactctgtactgcgccgtcgctcgtagactactccatctcgctcgccggcgtgcaccggcgatcgggaaagcaggttccggaacctctgctttagacgttctgcaccgggagaaggcggcaataaggtttttgggaagcgcttcgcgcgactgctccctgttcgttcatgacggctcgctttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 11861 - DNA, 1501 bp, Oryza sativa
tggattataccctccacatattatatctcatatgtttgggaattggcttgttggtgttaattaaaaaaatcaaggaacttatccttgttggaccttccactgtttgttgggctctctggcttagtagaaatgaaatggtttttgatagatcacctcaactacaaaggcatgatgatcatatcaagctaataaaagatgcgtatcataaacttgagtcgacgatcatgcagctctttgccaactttggatagagattcaccaatagaattctgtagttgtgggatctttaccttgtttggtttttattgtttgaaccttgtaataattggttgtagctattagagcaaaagtcaggatgttttattccattatctaaaaaaatctcactttttctcttatcgaattgcatcaaaatgaatattcatttagacacaattgctcttgatgtctttcttcatacttgttcacaagtgagcaactgttttctcattggtcatatgaagggtgtcatcgcaacagttgtgttaagaagcttttatggtccaggaagctaccagttgaagtgcttactgaaagttcaagtgccattagtttggttttggtgattaatgacaaattcaattacatgagactaatattgttataaggatgaaatgcgtggagatcaagctatatgtatcactctttctctccatgcacatattgatatattcatatataatattttcatgtgagactaatgttttgtttgagccatatcttgtttagtctctttacattgagaacatggagatgatgaaggtatgtttttattttaatgtctatatttgataaatgccttctattcttgtataggataagctctcaatgtttaatatcttgttatgtatactcttgcttcacacaaatattttgtatgcatacatctagggggagcaaatcctatactttagttatgcatgtaatcgatccaagttattcactttcatttaattgagatctttagatttgagcatatatttgagtatatgacacttctggtgttgattaatactcatcatttattcatatcctattatacatgcgatcggttggttaacatgtggaggttgacaaccagatcattgggactaataattttattgagttgaatgaaaaaaataggtctcaaggattgcaaaggtgttaatgctcaaatgatataattacaccaaatgataccaagaatgacaaagtgaagatattgaatgtaacatcctgaaaattacttattttctaattaagcatcatgctggttcttatgttcttattaaccttttaaacctaggaaaatataattaaagagacctccaaaaattaacttgcgtagaatctctctttgctatttaaagtctttcgtggtttttattctaaaattgatcttattaaaccaaggtatttactttgattcgatttttcactttaaaccttcttttgtaaaattcctctatttcaattcaat

SEQ ID NO: 11862 - DNA, 1501 bp, Oryza sativa
gtcttgtgccttagcccagaagctatctgcacgtcggttactgcgcggggcccatcaaatcatgcaaggcgcccttgtcattcgccatttaatggatgagaacttccgggttctcgttcacaccagaaaatgggaacccgggttagttcagagtggttggaccagctctgacccgggtaagaggctgtgaagcccctcatcattatgatgcgacgggacgaagcacgccgctcgccgcgtgacacactgacagggccggggtacacagtcgccgtcccatcggtcattccaccggtcacagaccggtcatatgcacagcacgccgcattaaatgcggcatggcacggttgcatagaccgctttaaatgcagttaggtgggcgttaggccctgtacacgtgggctgatacgtggagggggtcggggcagctcgaccccaagcgagggcggcctcctccctctagcttggagggggcagccgccgcgccaccctgggctcgacccccctcgggggtagccacgtgggtttgggggcggcccaaccccaagctgggagggggcagccgccgcaacaccccgggctcgatccccctcggggagaggcagcggcgtcggcaacgaggtggcggcggtttggagagagagagagaggtcgaggtcgagagagagaggaaggcggcggcggctctcaccatagagatgcggcggcggaggaggcggcgacgatgacgcttgcgagacgacggcgagatacgacggcggcgtcggcgcggggatgccctaggcagtggcggcgaaggagaagccgatcgagatcggggaaaaaacttctaagtgttggtggagaatacgagggtgcgcatcgggaatatatatactcctagttctttagtcccggttggtgagaacaaccgggactaaagatattttcccgctatttccaaattctttttaaacccggttagggttaagaaccgggactacagataatagcactgaatattgaatttcattacatatgtgtttctaaaatagtaaataatgcattaaaattatttaaagacgaaaaattaatgacaattacttcgaaaaattcttgttgtctgtagtaaattaagtggataatacgtaataagcacatgaaagatttaaacttgttaaaaattctaataatcatatataattagcatatgcatgatattaaattgttaaaaattctaattaacatatgtaaataccacatgcatgatttaaaattaataaaaattctaataatcatatataattagcatatgcatgatttaaaattgttataaattctaattaacatatataaataccacatgaatgatctaaacttgttaaaaattctaataattatatataattagcatatgcatgatttttaaaaattctagcatataactagcatataactaacacacacatgatttaaaattgttaaaaattctaataatcatgcataattaacatatgccata

SEQ ID NO: 11863 - DNA, 1501 bp, Oryza sativa
aggccaccttcatctaatagtagacctttagggccccacagggtccccataggtggagatgcttccctatccccggcatgaagtttgggccctgccccgcattacccatggggaagattttgcccctgctccgttgaggcggggatccggccccaacgggtaaactactactcatactggaactctaagtcattccaaacactaggagggcaacacacttcgggttggcaacggggtcaggttgggctggaacggccccgccccgacccccgacttcactccctacccccggtcctgactggagatgtggggccaaatcaggcccctgtccccgacccttccggggacccacattaggtagcatctccatccaatctgcaccaaaaatacaagacaatcatcaattcagcaagaacaaatattatatgtaccataaaaaatagcatgaatacttagaatagcatcataaaaatttcagtaagaacacatattgatccatcattccatccataaagcatgcatgaccacaattccctcgcggctcgctggccgccgcacttgtcccctcgtgtcaaggggtgaccctctctagcgggaggctgtgaggccccccctttgagagttcggccgggggtagcgggtgagattcgaggatttggtgagcgaaactgtgtgtgatcttgatcttggaggctcctccaagacgatgaaacaaaagaggtttatacaggttcgggccgctacgaagcgtaataccctactcctgtgtgtatgattcttctgtgcttaaaaagtccctgaatccctggtatgcaagctagggttagacaagctttggctcagggatcctcagtccgatcccccttcctcgctaggcatggtccaacttttatactctaaggggataccacatgtgctgcgagtgctacctagggagaagggaaaatattctctatattcattacatgtcttgtgccttagcccagaagctatctgcacgtcggttactgcgcggggcccatcaaatcatgcaaggcgcccttgtcattcgccatttaatggatgagaacttccgggttctcgttcacaccagaaaatgggaacccgggttagttcagagtggttggaccagctctgacccgggtaagaggctgtgaagcccctcatcattatgatgcgacgggacgaagcacgccgctcgccgcgtgacacactgacagggccggggtacacagtcgccgtcccatcggtcattccaccggtcacagaccggtcatatgcacagcacgccgcattaaatgcggcatggcacggttgcatagaccgctttaaatgcagttaggtgggcgttaggccctgtacacgtgggctgatacgtggagggggtcggggcagctcgaccccaagcgagggcggcctcctccctctagcttggagggggcagccgccgcgccaccctgggctcgacccccctcgggggtagccacgtgggtttgggggc

SEQ ID NO: 11864 - DNA, 1501 bp, Oryza sativa
ggaagcggcggaccggggtctacttgacccggtcgcggccgaggtggcgccgacgtggcgcctacgtggctgccacgcgggccggcgggaggtagacgacgacgccggccggaacggacggcggacgacggcggcgagcggggagcgaaccatggcgatacaggcgaaggcgagcacaccgggatgttgcacaggacgaggggagacgagccaatggctcggattcgccgggggatgctcgacggcggcggattgcggcggcggcaaccggcggcgggagaagggggaaacggcaatgaggtcacgaggggccgattcccggcggcgagagcgtctacgcagctacgggaacccaccccttgcgccggattaggaggaatcgcatcgagggaggccggcgacgagaggcgcttccgagctcgggcggcgacggcggcgagcacacggtgagcgacggcagcagtcggggcggcgccggctagctacggggaggctacacatgctactatcgaaaactaaggggaagagatggattgaggagggagaacggggagatgcactaccgtgcggacggggcgcagtgacgatgggtcgacggcacgggagcgatctctccggcctcgggccggggaagaggaaggagagggtgcgtccggagtccccttccgcgtcctaacgcgcaccgactcctttggcacacgtgacggcggcggtcggcgatcggcgagacagaggggacggcaatggtgcgggcgaaaaaggggaagattgggaggggaaaaggaagggagggcgcctgggtttatagggcggcgatgtcggtttggaaaccgaccttgggcggtcaagggagggagctcgcgctcggcggtcgcggccaaaacggcgacaggggggggaaggatgacgccggcgggagggaaaagggaaaaagggggagagaaagggggcttgcctccttgccactttggcgaaaaggaggaggcagagggagcgatgcggcagaggggggggcggggctcagcctccgtcccttgtaagctagcgcgcggcggtggcggggccgggtcgatgacgacggcgatgacggtggaccggtttggagtggagcggcgacacgggcggcagacgcggggcaggcttggcaggcgctgacggcggcggcgactagccagtcggcccccacggcgcgcgcgcgcgcgggcggcgcggcgatttgggcggcatcggcgggaatggcagcgagagcgggagggagggctcggcgcggctcacggcagagcggggagagagagagagagagccgcgcacgcaggggcgatgggccgagagggattcagcccatcgaacccgagggaggcaaaatagacttttgcggagggatttgatttgggaaggatttggattcgggattgaactcgacgatagatcggagatttgagatctgagatggcatggacactagacaataagcaaagaaacagatttcgcaactagggtt

SEQ ID NO: 11865 - DNA, 1501 bp, Oryza sativa
ccatgaggtgtgtgttgcatgtgagggagagaagctctatttatagccttgtaatgacggttgtatggcagttaggggccgctaactgcgcataaccgtcattggggagcgctgaggagtcgccacgtggaagatgggtgtcaggtgcaccaagattggttcggccgaacccattcaaccactctgctcaccaactttggtgagggactgacatgtgggcccctatgaaggtacccgggtgtttggtcccactttgagtcggtttgagctgacttgagggcccctaaatccgtgtggttgcacgtgattcactggaggtgtttttctttgcatgccggcttaatttctccttcactttggcgtataattcatgcatccacattaattttccaatcctaatacaactacattatttattattggtatgcgtgtaagacatgctaagggcctatttgggggagcttaagattctgagaagcagctggttggtagtcagcttctgagaatttggaaaagctggattttccagcttctggattctagttcattttctagattctacaactacagcttctcagaatctggaccaaaagctggactgtttgggggagcttctgattttgatagaagttgcagcagcaagaagctcccccaaacaggccctaaggttccctttattagttgtgctagttggcggttgaaactagtacttaataaccgtcaataatgtcccattcaattataggttggtttttatgggatggagggagtaagtgttaagcaaactgtttttatttgagtacccccttcgtttcgtattataagccgtttgattttattcttagtcaaacttcttaaagtttaaccaagtttgtagaaaaacatactaatatttccaatacaaaacaaacatattatcaaaatatatttaatattaaatttaataaaattaatttcatgtcgtggatgttgctaatttgtttcctataaatttggtcaaagctaaagaattttgactaagaaaaaggtcaaacgacttataatatgaaatagagggagttggttgtaaatggtactcacttagggtccctttgatttggaggaaatatataggaattttgggatgatttcaattctataggaaaaatttctataaatgccttttaattaacggattgaatcatttctaatcatttgaaattcctatggaatgaataatcctatagagattttgaaagaaactcagcaagagctcaaagctcttggaaaatttactttgagtgtatctctctcatccgattcttatgtttttcctacggtccaatcaagcggtcattcctgtgtttttatatgttttgcaatcatcagtttaacacttctattctagttagaatactgcgttttttctatttctttgctttctttattcatataatttaaaggaggccttaaaaattactcatacatcctaacagggagtcgtagatggttagttctatat

SEQ ID NO: 11866 - DNA, 1501 bp, Oryza sativa
cactttgcttcacccatacgagtacttctgcaacacacaactcaatgtgtagcatccttcgttcaaatgcatgtctaccataataaacatgcaccttgagttcattgatgatgtgtaacataaatatggtcatatccgagcagatgatgtattgatcacaaccctatcctcgaatccaaacccgagcgcttatcgtgccaccatcggaatgtatttgcgagaatcccatcacgcacatgttcacaaattaagttttacatcatgtcgtactttactcttgatgcttttctataaataccctgctagagtggaggaaatcgtgatgatgtgaaccaccaacttgtccatccactggcaccgatcaatgatcatctactagtcagtttgaaggatgccaactgatgaaacccgttacaaaagaaaaaaagaaagaccataattttcaaaaaaaaaaaacaaagaaagaccatgctcagccttgggtacctgatctaaaggaaaaattaggcgcccattatccattgttgggcacacgctctctgctaggagcatgtttggttgcttgactacactcagcctagtgcaggcaactaaacaggcatgccccctctttgtttctctatgctacaatttaaaaggacactacttgtgtagttagctagtttctcatcttgtatcttcctcactttaaatggtttttctcccaaaccacctatcctatttacgatctaattataataaatatttgttttgatttaatatttataataagatcaaacacgactatattctgataaaaaatatatgttttaactgttaaaatttgatgcttcatttataagaaacaaatgttttaactagaatttaattatgttgcacatttaagttttttgttacaagaattttttcaatgttgcacatggtattgttttaatgtgtcatttaatgtttacaaatataacagatttgtatttttttaattgtttcagcaaatagattggaatgtatcaatatttacaactccatgtttcacgtatgatataaaaaaatgtttcaattaggaatatattatcacatatatttttttcatcagaaatataatcatgtaaaatcttgttgtaaaggtttagttacaatgaattcaacggtgcaattagattgtatatcgaataaattatttaggagaaaaaattatttaaaatttgataaagaaagttgttttttgttgagagaaaattgatgttgtgtagcacatcatgcatggaaaggttaaggtaacaatgagatgtttttttcttcgatatgttaaaatcgggcagggtactaagacaaattcatccaagaaccacatttggcacttttatcaggttagtatatgcccttcgatttattcgcagaaagaagggcttactggttcaaaccaaaatataagttaaaaggaccaatatccttctttgcttatatgaattgcagtcaagtaccgtagcagagattttcttta

SEQ ID NO: 11867 - DNA, 1501 bp, Oryza sativa
ataattagtcaattttattattaactagtatagattatggcaagaataattataattaacatagaataattagtagtttatgttttcattcaatccgtcctcttctaaaaaaatgaatggccatatccaccctatcaaaagaaaaaaaagattactatatcccttataatatggatgcccatatcctatctacaatcttgatcatgaaccaaagacacccttttatactctttgcatttcaaaatatggttctctaatgtttgttgcaagaaatagatatgtaaattttgtgaacaatgttactatcactttgtcggatgaagaaatgaccaaaataaaagttgtatgtcttgatgagttctacagcttttatgttcatgactttttcagctaaaattatttactacaaaatatcatttgaagttttgaaattcaaattttagttgataaaacaaattcacaagaaaaaatgaccaaaataatagcagaaaaaacacaataaaatgatagagcatgattttagaaacatttaggaaaaagaatcatccaatttagagttcatatgagtgagataaactaatttcaaattttaaaattttattttcgcatacggctccttaatacacccgtatggaaaaattgatttttctatgtgggctcttaagtggtccgcatgcaaaaatgagcttattttggcgtcttaaggagtcgtatgcgaaaacaccgacgcagcaagttgtggtccgtttgcaaaaatcatagggtctcatacacaaaaatcttttgtgtagtagtgatgggtttttatattccgattaatattcatcaccgtattcgtttcgcttattcgcttcgtatttctattcgataatattcgatttcgttttcatatccgggttttcgattccgaaaaaaattatgaaaacgagtatggtaaagctagtttttgaccgtattcaatccattttcatccctatatattatgttatattattacttgcatgtggcagcccttagtttagttgagtttgtttcctctttttgcagcaattcaatttagaaactcctgtcttttagtcaagccacatacgcgtaaagcaaatcctaaactccctcctatcctaccaaaactttagtttcatgcttcgcactaacatgatatcattttttgaacttatctgacatgacaacaatatttccatcactcttactgtaggctaacaaaaaatgcactttacaaagtttaaaaagggatatctatgtattggacaacccaccaaccacataaaaccaaattaaagatgctccacatgtactttattgcatcatcttgctaaaagaaatagatatacctcatgactctaattaaacacgtcattctgcatagatagataaggtaatattttccttttttatatattctcctttgttttgggtatataaaccctcctcctcctacatagctagtcatcagtagagagaagctagcaggtgactacca

SEQ ID NO: 11868 - DNA, 1501 bp, Oryza sativa
acattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagagaactgcaggaaaaaatggaacaaatacgatgctttataagtgatgtggagcgaaggggcatggaagactcatcaatacacaattggatttctcgtctaaaagatgctatgtatgatgctgatgacattatcgatttggttagctttgaaggaagcaagctattaaatggccattcttgttcaccgagaaaaacaattgcatgtaatgggctttcacttctctcttgcttttccaacattcgggttcaccatgagattggtaataaaattagaagcctgaacagaaaactagaagaaatagcaaaggataaaatat

SEQ ID NO: 11869 - DNA, 1501 bp, Oryza sativa
gttgaatctttatgagatgactgtgtattctcaagtgttacaaatattttatcctttgctatttcttctagttttctgttcaggcttctaattttattaccaatctcatggtgaacccgaatgttggaaaagcaagagagaagtgaaagcccattacatgcaattgtttttctcggtgaacaagaatggccatttaatagcttgcttccttcaaagctaaccaaatcgataatgtcatcagcatcatacatagcatcttttagacgagaaatccaattgtgtattgatgagtcttccatgccccttcgctccacatcacttataaagcatcgtatttgttccattttttcctgcagttctctaagatcttcttttacacctaaaattagtattgcctcctcggtaatgatctcttgcaacttcttagcacatgatccaatcaaagaatccagtatggttgccatagagaaactcgtcgagggtgatgctccaatatatccaagtttttttttttggcgtaagcaatatatccaattaaatcatgcaagagtaataccgtctgaaaatggacaaaagttgaattggtttcagagtatctttgtagctagcaagttattttgcaatctgttttgagcaagtatatactgattactgaagctgaagaactgaaatcattaaggggtttacctttcggtggcttctttgtatcaacaggcaaacgagaaagaagtaaccggctcaaattgcggtgttaattttgctcaagttgacaaagctaacttgcttggtatgaaagccgagctgaggctgaagtgaatcggatcgacaggaacggcagtggagcaggcgggtgtcttctggaatgcaagatgatgaccgagcgagccaacgtttcgattggctagctcctaacgtgacaagcagaaaattgttcaaaccctatgttgtgagagaaaactcagctgagcctgagagcaaggcctttgatgcgtgcagccgaggcatcgccggtcacaaggaagacaacgagcaagttcccattatgagattatgtctcgtggactagatgggctggctctcttatgcagtgttcaaatagtacaatggctcttttatccgtctcaccatttatgtcccactgtgcatgaggagtttgttttccagtgtgcaaattgcacggaacaagacaagccatcttagataaagatgtttgaacaagtttgcaaattgtgcaaatggcagtctgatgtatgaacaagatgtttcagctgcatatataaatttctccatcgtgctactaaaaagattcccatgtcaggaaagatatttggactgaaattcattcagagtactccaccctagtaaatagagaaagaaagacctcctaataccgaaggtatcgagaaataccaaattttacattagaaaatatggtacttcttccgtttcatattataagactttctagtattgcccatattcatatatatatattaatgaa

SEQ ID NO: 11870 - DNA, 1501 bp, Oryza sativa
ttcccacattaatcggagaaaaagaaaaaaaagaaaagaaaagtccaagtaggcatacaatctaaaaatagctgaaattcggaattaaaaataagcaatattaaaaaaagtttccatataagaacccaatacgagattaatcgaaattcgaaataaaaataaaataaaatccaaaattagaaaaggaaaggagagtccaaataggaatacaatctaaaattagctaaaattcggaattaaaaataagcaatattgaaagaagtttccatataagaacccaatacgagattaatcaaaattcgaaataaaaataaaataaaatccaaaattagaaaaggaaacaagagtccaagtaggaatataatctaaaaatagctgaaattcggaattaaaaataagcaatattgaaagaagtttccatataagaacccaatatgagaataatcaaaattcgaaataaaaataaaataaaatacaaaattagaaaaggaaacgagagtctaagtaagaatatgaagagttcatataagaacccaatatgagattaattaaaattcagaataaaaataaaaataaatctgaaattagaaaaataaaataaaagaagagttcaagtaggaatacaatttaaaattagctgaaattcggaattaaaaataagcaatattgaaagaagaatccatataagaacccaatacaaattaattaaaatttcgaataaaaaataaaataatatcaaaattagaaaaattaaaagagagttcaagtaggaatacaattttgaaacaactgaaattgaaaataaaaaaataaaaacattaaaagaacacaatacggtattaactaattttttaaaaaaaataaattctgaaattagaaaaagaaaaataagatttcaattaggaatacaatttataaataactaaagtttgtgataaaaataaaggctattgaaagaaaagaccatctaaaacacatgacgagataaattaagtaacatacctataaaggagtagagtggtggcggttgatatgacatataaaaattgttaataaaacacaaaatagaattctaatgacgattaaaaggagggacgctaggcaggccgtgaagcaaacaagtaaagcagatgctgggacttctagaaagtaaaaaaaaaccctattgataatcatattcgatttttaaaatctcaatgacaataaaaaggagaagcagcgggcggggtgtataagagtatagttgcagaaccgctgacgattgacgggacttctagaaaataaaaaatgaattccaacaatagttatgttcgatttttagaattataatgacaataaagagtaggcgatggacgaactgtagagaggcatagtggcatcgtttgatggaacttctaaaaattataaaaaaaataaaattacaagtccaatttttaaaggtttggaacttccaaaaagtaaaaaaacccaatgataattaggttcgattttaaaatctcaa

SEQ ID NO: 11871 - DNA, 1501 bp, Oryza sativa
attcacagattcagatcagataatatcatcaaggtaccacagtacctggtgcaaacctgagaaatttgcagagggattgtaaagtccaaactggaagaaaggtttccaagaagattgagttgttaaatgttcagtttgttcttgtttgtttgtctgtagaattcaaaaattcagattatgtcctgaccttgacttaaaatatacaaatgtactaaaattcagattagttctcctttgcaatggattgggctagcactatttggggattgagaagcactctaaaaatatgctttactgaacttgacgatcccatgtcagacgcttgccgatgttctgtaagctatgctgttctgcacacaacttatttattcagatgacagaattcagttttatactcgctccgtcccattttaagtgcagttgcggatttccatgtacaacgtttgaacatccgtcttatttgaaaaatttataaaaaaaattataaaatttataaatttggtggtacatctggacagccagaacatgaggagcagcggtgccgccccatgtaaagtttgtagctctaaacttgatttgaccttttcagaacgggtatataaggttatattcagtttaaaaactagctgggtggcccgcgcaattgcacggctagcatccaaacaaaatcatatattttttagtatgtttttacttaaaatttattaaatagctatctcattgttttaagactttaaaagaccaaaccttactatcctcgtgtttctgattatatagtttttaaaagtcacaccagttgctaccctttatgtcatctccttctttatttgcttgctcgatttaccactatttttattcattcttcttggaacctttataaattggattttatagttttagagtttattgtcacgttgggtttcgtttttataatttctagatgtcccatcaaatgttgccattatactcctctatggcccgtccagtgtttcttctctttattgtcattgagattttaaaagttgaacataattatcgtttgggttcatttttactttctagaagtcctaccaaatcatcagcggctttgccattgtactcctctacggcttgtccgctgcctcccttctttattgtcattgagattttaaaatcgaacctaattatcattgggtttttttactttttggaagttccaaacctttaaaaattggacttgtaattttattttttttataatttttagaagttccatcaaacgatgccactatgcctctctacagttcgtccatcgcctactctttattgtcattataattctaaaaatcgaacataactattgttggaattcattttttattttctagaagtcccgtcaatcgtcagcggttctgcaactatactcttatacaccccgcccgctgcttctcctttttattgtcattgagattttaaaaatcgaatatgattatcaatagggtttttttttactttctagaag

SEQ ID NO: 11872 - DNA, 1501 bp, Oryza sativa
attgatgtaggatttgagcttgtgcttctgcttatgaaacatgtagctttgtgctaatgaggccacgttgtttttatggaagagttgttgcatgagtactgtgaacagattagtctgatgacatatgtgtggagaaatatccttccattctgcaaggtggtccttccaaggcatgaatgcatctttacacaaatgtgatgctaaaggcaagcaggccctctctcttttgctctcataaatccaaaacagaaccaaacagaggctaaaaagcagattatgattaaaagcatgctctcatttacaaataaaagatcaagatgacatggtgatcactgagagatatttataggccttaattggaacttatagattcttgtttgttgtctagtgtggtaatgaactaaatcttctgtttcaacattgtttctattctagaataaaatcatagactctttgattggacggtccaagataaaccaacaaaaaaaattcaggttaaaagggatagaggaagaaaggagatagggaaagttgttaggtgcttttcatatgggaaagttcctctattttcatctctactagatttgaaggtacttgttttgggagttaaagctaatggatatgttcagatgttaatcatagcagtaattacctttgtaaattctaaaagcagtctttacaccagtacagtacagagcctagtacgtcaatacctgctccaaagtagccgtgccctgtccttgaaaccgctttacttctttatctgacttttgaagcacaaatcacaaatatccatcaccaccaactttcattcagtacaaacaccattactaaaaagaaagggaaaaaatgatttattacttctctcattgtacaaacacacagttacatgctcacatgcacaagagaatgaaaacaccaccagcacgcagcacacaaactggcagccaccgatttttttttaagttttctctaggactagccagcagcagtgactgcaatttactacttcttccatcccaaaataaatgcagccataaattttccgtgccaactttgatcatccgttttatttaaaatttttttactactagtgtttttattgttattagattataaaacatgaatatagtttatacatgacttatgttttttattttttttaaaacaattaaataaaacagacgatcaaaattgaagaaagaaactcatggcacccgagacattgattgaattttaattaatcttttctctgcaaaccaaataatttatggaatactgaaaacgtgctgtaaatttttaattgaaaagcatatacttttctttgcaaacaaaaagtataaaaaaaagagagaaagaaattagccattttcttgctcctctcctctgggggttggttgcaacttgcagagcccctgagattgtgcggttgggtttatataagcacgctgccttcgccatctccatttccacaaacaccttgcagttgcagaggaggagt

SEQ ID NO: 11873 - DNA, 1501 bp, Oryza sativa
ggcagcgaccgcctgcagaacggcagcgtcgccgccggcccgcccgccgcgcacgcgaacgccgaccgcgccgcgacggggacgacgcccccgccgaccgccgccccggcgagcaccaggagcgggaggagcaggaggcgccgcattgtggaagtgaactcctcctctgcaactgcaaggtgtttgtggaaatggagatggcgaaggcagcgtgcttatataaacccaaccgcacaatctcaggggctctgcaagttgcaaccaacccccagaggagaggagcaagaaaatggctaatttctttctctcttttttttatactttttgtttgcaaagaaaagtatatgcttttcaattaaaaatttacagcacgttttcagtattccataaattatttggtttgcagagaaaagattaattaaaattcaatcaatgtctcgggtgccatgagtttctttcttcaattttgatcgtctgttttatttaattgttttaaaaaaaataaaaaacataagtcatgtataaactatattcatgttttataatctaataacaataaaaacactagtagtaaaaaaattttaaataaaacggatgatcaaagttggcacggaaaatttatggctgcatttattttgggatggaagaagtagtaaattgcagtcactgctgctggctagtcctagagaaaacttaaaaaaaaatcggtggctgccagtttgtgtgctgcgtgctggtggtgttttcattctcttgtgcatgtgagcatgtaactgtgtgtttgtacaatgagagaagtaataaatcattttttccctttctttttagtaatggtgtttgtactgaatgaaagttggtggtgatggatatttgtgatttgtgcttcaaaagtcagataaagaagtaaagcggtttcaaggacagggcacggctactttggagcaggtattgacgtactaggctctgtactgtactggtgtaaagactgcttttagaatttacaaaggtaattactgctatgattaacatctgaacatatccattagctttaactcccaaaacaagtaccttcaaatctagtagagatgaaaatagaggaactttcccatatgaaaagcacctaacaactttccctatctcctttcttcctctatcccttttaacctgaattttttttgttggtttatcttggaccgtccaatcaaagagtctatgattttattctagaatagaaacaatgttgaaacagaagatttagttcattaccacactagacaacaaacaagaatctataagttccaattaaggcctataaatatctctcagtgatcaccatgtcatcttgatcttttatttgtaaatgagagcatgcttttaatcataatctgctttttagcctctgtttggttctgttttggatttatgagagcaaaagagagagggcctgcttgcctttagcatcacatttgtgtaaagatgcattcatgccttggaaggacca

SEQ ID NO: 11874 - DNA, 1501 bp, Oryza sativa
tccgctctgcccgcgcgcgtgcgcgtgagccgcccgcgccgagccgagtcctccctctccgctccctcgctgccacttcccgcgcgccgtgttcgcgtgcgcgcgcccgcgcggtcgccgcccttgccgcgcctgcgccgtctgtgccgcctggcccccactgccctaccgcgcagccgcccggccccgctagccagcgcgcgtgcccgagccgcgcctctcaaaccgccgcgccgcccgttgcttcccgcgcgcgcgtgtcgtggtggccgaccgcccggtcgccgccgccgtcaccctctgccgcgccagcccgcgcctgtcgcccgtgtcgtcgcgccgctccaaaccgtcccgccgtcatcgccgtcgtcatcgcctcggccccgcctccgcgcgcaagccaccaagggacggaggcagagcccctcctccctctgccgcgacgcccccgctcccctcctccttttccaaaagcggcaaggaggcaagcccctttttctctccctcttttcccctttttccgtcaccgctggcgtcatcctcctccctccgccctgtcgccgatttggacgcgagcgccgagcgccagctcgcgccttgaccgcccaaagtcggtttccaaaccgacattgccgcccttaaagccccgggcgccctccctctcttctccttccatcgcctccgcgccattgccgccgcccccgtgctctgttcgccatcgccgttcgtcgttgcgcgtgtcggaggagccggcacgagcaaggacgcggaaggggactccgggcgcgccctcttcttcctcttccccggcccgaggccggagagattactcccgcgccgtcggcctctcgtcacagcgcccctcctcatcgcggtagtgctccctccgttcttcctcctcgctccacctctccctcttagttttcggtagtagcacgagtagcctccccgtagctagccggcgccgccccggccgttgccgcctctcgccgggtgctcgccgccgtcgccgcccgagctcggaagcgccgctcgtcgccggcctcgctcggcgtagctccgcccaattcgacgctagcatcggattcccgtggccgcgtagatgctctcgccgccgggaatcggcccctcgtgacctcgtcgccgtttccccctttttccgccgccggatgccgccgccgcaattcgccgccgtcgggcatcctccggcgaatccgagccgttggctcgtctccccttgtcctgttcaaccatccggtgtgctcgctttcgcctgtatcgccgtggttcgctccgccgctcgccgctgtcgtccgccgtccgttccggccggcgtcgtcgtctacctcccgccggctcgcgtggcagccacgtaggcgccagctcagccaagaccgggtcgagccgaccccggtcagcccctcctcgtgcgcgcgttccaccgcgagccgtgaggctgcgcgtgggcccgccgcatccgcatccaccgtgaaccgcg

SEQ ID NO: 11875 - DNA, 1501 bp, Oryza sativa
tataagtcagcaagtcaaatgttcttatcgttttctttagtcgatggttcatcgattctgacatcaagacaagaagccaacatactgctagccatgttactttcctcttggctcacatacggccatttgaatggattagattcagaaataacactatatctcgtctttctttcttacttacatgagttgaaatattcttggcctttttttctctacttactagggcagaattaagattttgaagatgagctgcaccccaatccttaagagatactaggaggtactccctccgtttcatattataaaacgttctaacattgctcacattctagacacacacatatatatatatattgattcattaatatatatatatgaatatgggcaatactagaaagtcttataatatgaaacggaagaagtaccatattttctaatgtaaaatttggtatttctcgataccttcggtattaggaggtctttctttctctatttactagggtggagtactctgaatgaatttcagtccaaatatctttcctgacatgggaatctttttagtagcacgatggagaaatttatatatgcagctgaaacatcttgttcatacatcagactgccatttgcacaatttgcaaacttgttcaaacatctttatctaagatggcttgtcttgttccgtgcaatttgcacactggaaaacaaactcctcatgcacagtgggacataaatggtgagacggataaaagagccattgtactatttgaacactgcataagagagccagcccatctagtccacgagacataatctcataatgggaacttgctcgttgtcttccttgtgaccggcgatgcctcggctgcacgcatcaaaggccttgctctcaggctcagctgagttttctctcacaacatagggtttgaacaattttctgcttgtcacgttaggagctagccaatcgaaacgttggctcgctcggtcatcatcttgcattccagaagacacccgcctgctccactgccgttcctgtcgatccgattcacttcagcctcagctcggctttcataccaagcaagttagctttgtcaacttgagcaaaattaacaccgcaatttgagccggttacttctttctcgtttgcctgttgatacaaagaagccaccgaaaggtaaaccccttaatgatttcagttcttcagcttcagtaatcagtatatacttgctcaaaacagattgcaaaataacttgctagctacaaagatactctgaaaccaattcaacttttgtccattttcagacggtattactcttgcatgatttaattggatatattgcttacgccaaaaaaaaaaacttggatatattggagcatcaccctcgacgagtttctctatggcaaccatactggattctttgattggatcatgtgctaagaagttgcaagagatcattaccgaggaggcaatactaattttaggtgtaaaagaagatcttagaga

SEQ ID NO: 11876 - DNA, 1501 bp, Oryza sativa
gtagggttcaacgtggagaggaagatctgcaagaaccagataggcatcagccatgagtaccatgaagttttgccgtgaatggtaagctgattagaatcttatatagtcatatatatttacctttcttagttttctatgtaataagtgataatagaagaattttgttgttgctgagtgtgagtgcagtaacaacatcaggttcttagaaagccctcatccaacttcacatattctactccgtattatttatagacatttagaaggggctaatctctaaaattctgtaagactttgaggtgacaaacttcatgagctgacctagaattgaaccgattacttctgcacttcactaatgtaccacaagtgttacagtacagtcaagagaaaactcaaccttcagactttcggttccaactgtgtttttgcctttttctgtaaaaggaacaacatcattatgaaccattgtgtcatacataccacaaacgtacagtatctagattttatcatgagagtgcccgtaatatgttgattcttgttcattcttgagctagaaaatactaacagctttggatggcaatctctgcattgcttgactgaacttttgcaagctcctgaatcacaggaggtagctgacagatactgtgtgtaccgcaacatggtgcaccacatcgccggggagttcaccacattgcttgacctggaaggatgtcttcttccaggtcaggattatcggtcagagacaaaccaccagtttcttcatagttcagaattacatagaaactactaaactctgaaaggtgaaagctttaaaagctttaaaccacagcgaggggtgaggaaggcatgacgcttatcttcgtgtgctgcaaccccagctgcggtcacagatggagggagtacgtggcatgcaaaggcagtagagatttgcgttatgccatgaattggtctatgtttactttgtcaacaagagtatgagatgccatgatcctatgacagaggaaacaaaactgaagcatgtgtggccttccttctctatctgtttttttttctaattcaagggcgcagctagttgactagttccacatcatggaatcttgaagccaacagtaaagtaatcacatagaagtaaactgtagatcaatcacatggaaataaactgtgaactaatcacatcgactagacaagtggacaagcacaaaacgttgggttgtggagcatagacaagtggacaataactcaaaattgggtcagcggtattaacgtgggaaagataaaagaaaagagtggttcagcacttgtctagtctgaatgttcagctagctatgcaatatatatatgcaaggtcttaccactccctcctgcagtactgttgctttgttccactgttgtgtgtgtggcattcttgtactgcatttctaccagctgtgggtaagctcaagacatatagctgaatttacttcctttgtttccttaagataatctgtaaatgctcgttttgatt

SEQ ID NO: 11877 - DNA, 1501 bp, Oryza sativa
catcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaaggaaagaagagtctaagtagtatacaatttaaaaatagctgaaattcggagttaaaaataagaaatattaaaagaagagtccatataagaacccaatacgagattaattaaaattcagaataaaaataaaaataaatctgaaattagcaaaagaaaataaaagacgagttcaagtaggaatacaatttaaaattagctgaaattcggaattaaaaataagcaatattaaaagaagaatctatataagaacccaatacgagattaattaaaatttagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaa

SEQ ID NO: 11878 - DNA, 1501 bp, Oryza sativa
gtttgacacataatagtatgtttgaatagtccactagatattattttaattccatttactctcacaatatgttggcagtggcagagcatagtatgcgaatgaataagttgccaaggatatctcctactgatcctcgtacaaatggtgaaatattggactattctcaagggagtggacctagttcacctgttgggacgaatacttataaggcagatagatttcaagatagcaaggaatgctacaataacggcgtcactggttctcatcatctcaaggaactgaaaacttcggtttcttcatccaaccatggaagtagccaagtctctccgaaaccgcctcatcctgatgccaagtatctgggccaagtgtactctataccagcaatggatgactggtctaagtgcattgatcaaagctggctattgtccaggggtagtgttgactggaaatcagagatattggaggctgcagaatcaccccgagtctgggctgaagcgcgactgatcgattccgcagacgtagttgccttgccttacgttgttcccctataataatgtggtactcccatcatgatgcacatggcgaaaaacttccagattttgtgatgtgatctggaactcgcctgttcggtttgcttcctgctggctgtacacatgaggtcattcaaaataattctaaattcccatcgcatcgcctaacgaagatcgaagatcagagtgttatacatcaaacaacttctcagctgggagtgttactcctgcattgctctacaatttttgggtcatgtaatttgatctttcacagaatctatagcgaggtaagaaagcgaaaccggcgccgcaaaatatcttgaaactctgcttgttcatatcctgttcttctgattaaagaacagcttagcttgagattgttctgttcacttgcaatttgcaggagtaacaaacgcttatttttgcatttctgtatcttactatcctttctacataaatactgtgattatctgaacaagattccacgatggagtgtctggacttctggagatgtttatcgatgtgatttctgattctgtgatatatgaattgattcatgtgaaactccaataaaatcggaaagcttcgaacaagcattaaaatccagcacacactctattgggccggtctctgcaagcccaaattcaaattagcctgcaaggttacgtgcctgtaattgaatctctcccatatttttttgctaaattttgtttcgttttgaattcaaagcttatctaaaactatctcttcctaaaaatcctcagaccgaagtgatcaacaacctaccaataaaatcataacaacttaacaaaacacggaaaagaaaagaaaaaaaataaattaaaaaaaaaaagcagagatgtcttcttcctccctcgccgccgccgccgccgccgccttcctcctcgccgtcgccatgtcgtgccattgccatggtgatgatcacctcacctcgcgcctcgacgatttca

SEQ ID NO: 11879 - DNA, 509 bp, Oryza sativa
agatccgggggtatatatattcccggtgcgccctcgtcttcttcaccaacacttagacgttttcggccgatcgatctctctcggcctctctccttcgccgccactgcctagggcaaatccccgcgccgatgccgccgtatctcgccgtcgtctcgagctcgtcgtcctcgccgccgcctccacctcctccgctgccgccgcatctctggggtgagagccgccgccgccagatctcccttcatgcatctcgatctctccgatctcgatctctctccgtcgcgccgcccgccacgagacgccacgccacgacgacgacgcgccacgccgccgccttcgccgctgcgcaacgccgccgccgcatgccaacgccacgccgccgccgccacgccacgccacgccgccgccgccacggccccgcaacgccacgccaccaccgccgtcgccacgccgccgccgccgccgccacgccgccgcgccaaccgccgccccgatgccgccacaccgccgtt

SEQ ID NO: 11880 - DNA, 1501 bp, Oryza sativa
aatattataatggattaatagcacaaactcaaaaagggagaccggagaaataaacataagcatttgcaaagtcaaacattttgagaaattctaaaccgcatagggaaagttatcaattttcatactaaaagaaaaaaaaacaatgttctttcacctctccgttcatttcgtatgcaagtaacacatcagcttcaggatctgttgcctgctttagtggaattgatgccttatagggaccacctttttcttcctagaaacaaatggcttgagattagttcggtaggctaaaagaacttctgcgggtagataaggacttacatactcactttgcacctgtcaacactgacaaactcaacatgcttgcctcctaaagatgtgactgagctgagtttaggtattccaactagttcaaggacatcagatagctttgctcctccccatgttgctgggaacaatatgaaagaagaaaacatagtacgattattacaactatataaaattgtgtccatttcatacagataaatctaggaggacaaaacagtcccgtatcagtaatttatgcatgatataacaatcactgagcagggtactgttaatataggaaaaacaaaaggtaaaaagaaatgacttattatggtcggtaaagttatatagcatgaaaaagaaacaattctaggcctagctaacaagagataatccttgcaaatccctccaatcatacgataataattatctctataattcctgctatcagaatgtagttgtgtagtgatagcatgcctagatcccacaaagtgcattatcttctggacattagtgacgagtagtattcagtaacacagtacatcagattgcatttctaaaaccttgaagacaacactcttcagtacatactataaacatggtgtatttcttaccatttccaagagcagatatgtcccacccaacgcctctcactttccgtaccttactcattgcagtcctcctgttgcctgcacactacaaattcgatgttgtatcgttatgttactaacaatgtcaatattatccatcagataaagatttggggagagggatttgtggcaaacctgtaacgttgcagttacatcatactttgggagactcctgcatgtgaaagtttgcatcaattctcaaaacaatattttgtttagtcataacaaaacataaaatgaagtacttacctaatgtcagccatggacagctgcacattcttgttgacaataccagtaatggaaacactgtatctgttgattcagtcaaactgaaaaaggtaaggtttgttacaaaacataatgataaatggcaacttatagttcatgctgacaaccttgagaggtcatccacaattggtatcggtccatggtttctcttgtagaagaaatccaccggggtaatataagatgaaactaatgctgatcgatgaggctcagcattaaatggttcctgccaacagttgtagtaaagtaagacttgctaactt

SEQ ID NO: 11881 - DNA, 1501 bp, Oryza sativa
ggcgagaggttcgccgcccaccgtgccgtgctcgccgcccggtcgccggtcttcagggcggagctgttcggcgtcatgtccgaatccacctcgtcgtgcataacgctgaaagatatcgacgctgcaacgttcagagctctactccggttcatctacaccgacgacttgccggccgcagacgccggcaaactcaatcatcagggctcctcgatgggcgcgttcttccagcatctgctcgccatggctgacaggtacgcgctcgacaggcttaagctcatgtgtggccagaggctgttgcacagcatgacgtcggattcagtcgccggaatcttggcttgcgccgagacatacgattgcccggagctgaagaacaagtgcatcgacttctttgccgtcgaggagaatttcaggagagccgtgttcaccgatggttttgcgatgctggtgcagaaattcccgctcatagctgctgagctgaagaagaggattgtgaaaccgtagctgcatatatatcttttagtcctctatcgcgttcactgcacttgtgttatgttttttttttctaagttatgtctggctttgaacttgtttttttttatcatgtttaattatattgggggtgttatatgtactagctgaatgctcttgcttttcatcagaatttgtccaactacttcatcagctgatcttggggtttgttggaagcttcatgcatttctttggttccaaatataccaccaggcgcctggaatcgaccatattatcaattgggtatttttatcattcttaagatacttagagatgctatatattctagggagacgactccgtgtcggacgtccgatattccaccaaatatcggacgcccgactgtttacgcgtcatcacaccacctacgtatgcaatatgcaaaaaaaaaaaaagaatcagtcagtcaaatgttccaattaactaacgagtgaaatatcaagttatatagggttaaaaaaaatcagcaactgaaacatttaaaaagtttatgaaacatggtgaagatacacgttaaaacatatcgctatcacatatgaaacaaccaatgttaatggattgaaacatatgtttttctttcatcaaaatataattatgcgacattttgttgtaaagatttaattacaaagaatacaacggtgtgatcagattatagattgaatgagtatttaagagaaaaatcgttttaaatatcgttaaaggtgcatgttatatggttggaggtagagatataggcttggatatgtgtatgtgtgtcagaggctgcctgtccgatttttgtcattgcttcgaacgttcgatgagaagcattttctattttctagtgtaaaatttgatacctctagatactataataagtttcttaaggtaccaaaaattatagtgcaaaatttaggtatctcaagtattttctaaaggactgcaaaattcatcttatcatgttcatgtgccgggcatgtatccgaatccaata

SEQ ID NO: 11882 - DNA, 1501 bp, Oryza sativa
ctgtttactgcatatacctttagctttggttaattcaagctatcaagcatatgtgaaaccaattaagacaatttcttcctccttctcacaatggtattccttttagcagtttcaaatactatgtattttcatttccaagatcaaaaccatggttttattgtaaaaaaattgttattcccttttcattaatcaaccgtatcgaaaccaacaaaatattgcatttatgccttactccaccgttctaaaatatagcaatctaaaattggattagacttaatactatgaatccagattagaggaagtaagttcgtttcttaaaacatttttttatacttccattttcctgttccatgtactccaggggtaatggataaaggctgtgtttatttgttttggcaaaaaaaatttgatgtatacggacacacatttgaagtattaaacgtagattaataacaaaataaattacaaattccgcctgtaaacatcgagacaaatatattaagcctaattaatccgtcattagcaaatgtttactgtagcaccacattgtcaaatcatgacgtaattaggctcaaagattcgtctcgcaatttacatgtaaactgtgcaattggtttttttcattcacatttaatgctgctatgtatgtatccaaatatttgatataacgtaaaaattgaaagtttgaaggtaattaaacacaaccaaaaattgcaaatggataaggcagttacttctagagtccttgttccagatacctgtaccttatacaagaagccacagtacgatccagcagacaaagcccccacacctgatcccatcttatctccttcctgtttaccctgcacggcacccattatccaacttaacaatccaatgggccgtccgtccgtcccgtccctgacctgcctccccctgccggcgcggcgcggcgcggcggattccatcaaaaccaaaccagtctccgaaacctccccaccattaacctctaaaccataaagtccccccgtctcatgtcgtctcatcactcacttataatcacccccatccacttaatcacgctctcaacgctgctgtgtcacgtcacgtcacgcgcggctccgtaataagaccaccaacctcctcctcctccctcccacgtttggagctctcgtctcgtctcgcggcctcgagccctcgaccaaccaaccacccgcttcttctctcccgtctcccgaaacctccgagagctcagaagaaaaaagaagaaaaaaaagagaaaaaaaaactggtggaaactggaaggtttgcggcggaaacgagggggagggatggtggcgaggagggcgtaagcggggggtgggggtgaggcggatgatggcgtcgagggtgatggcgtcgtcgtcgccgtcgcacacggcatcggatctcgcgcggttcccggcggggaggggtgggggcgggagcgcggggctggggtcgatgaacgtggaggagatcctccgcggcatctacgccgaca

SEQ ID NO: 11883 - DNA, 1501 bp, Oryza sativa
tttacaaattatttttcgtttgcaaatatgtcgtttggtttattccctaaataagccaaccgatgggcaccataactcctacttcctccgtttcatattataatatatatgttaataaatctagcattgttcacatttatatatatgttaataaatctagacatatatgtgcgcctagatttattaatatttatatgaatgtgaacaaagctaaaaagtcttataacctgaaatggaagtagtattacgtatatataggtccttcgattaacacctattacacacacacgaatacgtgcatgctgtagatacgtacgtaggtccacactttacagatgaatcactggatctgcccttgcatatatagttgtatttgtgtccgtacgtatatatatacgtataagtacgtgatgtggtcgatcggtatagtagctgctgctagggggtgaaaatggggcggatatttcccgcccgcccaaccgatccgaggcctgcgggaggaatatgggagagaaaatgggatacccgatattatccgagttcgaacccaaatctgtaaaaaaaatatatggattagaatacaggaagggttgtattcgcccgcatgtcacatattatgaaacatatgtgaaaatctattataaattcacctataaacataataaaagattagttaatcactattttttatgagctcacgtgcaatattatataatttgttccttgatgtatcttttttagcactttaatagttttcttacattaaatattcatgagttggacataaaaaaatatccgttcccgaatccgattcgaagaaattaatatgggatagaatacgggatgagtgatgtgttatccgacactacccatatccgattccgaatttaaagtaagatgtaggttaggatatgagaatgctgtgatgagggtttcctaaaccatcggggccagggttaccgcgccccggcggtaagcacggttaccgcggtaaccgtgaaaaaccgtacgaaaccgtgcaaaatttattaaaaattcaaattattttctaaatttatttgaaattaaggaggatactgcggtatttctattaccgtaccccgcggtaatggcggtaaccgcggttaccgacagtaatgaaaactctgattgtgatccgatcttacccgccccattttcacccctggctgctgcttccatagtcaatttaattatgttatacacaatttatcacatgtacatgacacatcagtcaatttaattaggtttgaaatgtcatgtcatgagtaacatgcatgaagcttcaccgatcacgtacgtacggctaattggcctcgctctgttttagcatgcatatatatacacagttatgcacattgttaattaattaatgtcgggcatttttattacgctcgtcgggggagtgttgttaattaatgccgtctgacgactgaatttaattcatccatacgtcatttcatgacttaatactactattaat

SEQ ID NO: 11884 - DNA, 1501 bp, Oryza sativa
aaaggcttaaatgacaacatttgcagataagttattcagatattgccggcgtctgcccattgccaagccaagcatacacttaaacgggtgcaccgtgggtatcaactatcaaccgcaattctgcaaagtcgcggaacgccacctcactaaactagacagtggcagactcctagacaagcaaagcaaccagacgaacacgcggtgagactgaaagcggtgggcgtacacggtgtcggtagggatgatgccgacggcgccgcggttgatgagttcgacgacgggctccagcttccacgcgtcctcgccggatggctccacctgcacccgcagcatcccggcatcccctctctacacacgcccccacccccaccaatcaccaccaccaccacaacacaagttcagcacactggagttagccgcgacggcgacgagcagcggatagagagagagagagagagagagtaccgtgaactggcgctgggaggcgtacttgagccgcttggggttgcgcttgtggagggcgacgacggcgaaggaggcgcggtggggaggaggcaccgcggggaggcggagctgcgaggaggaggaggaggaggcggcgcggcggaaggggaggcgcgaggaggacgcggcggcggcggcggcggtcgccgtggcggtggcggtggccatcggagagggtcggggttgggttgggttgtcgccgagtgggggaatccgccgcggtttatgccgttctcgtgatcgaatccacgggcggcgcgtgcgttgggccttgggccgcacaaggcttcactcagcccacgtatttttctcgtgggctctacggtgaagtccacgtattttaggaaggaatgaactatggaagaattttgtagaaagcttataggaattgtcagcatgaaaaaaattccaatggaaacctaattgtattttaggaattactgttcgagatgaacgtttcaaatctacaattttaaagaaaaaaattgcaaaaaaaaaacaccccaaatgtcatcccgagttgagtttaaggttatctccttgttgcatatactctttagaattcacattgatttgggattcctgctattgtttggtgttttttccctcttcatgcatactagtatgttgtattacctagcatattccttaatagaaatggccttaaacatatttatttcttagcaataccaatacttatattgaatctaacaaaaaaaacctaacaaatgtcgaaccctgcgaaacaaacgcaacaactcatctcttcgtcgcttcgatgtgtaagagtggagactcatgatcaccgtcgttcattgacgtgctgaacattatgacttttatgagtaggcatgcatctgcaacggcaatatcatcagccctgtctgatatgaatggcgaccacatctccttactcgtgagcgtatgtgggatttgcagctatgatgatgagctaagcatataggtaattgggtgaaaaagaagaaatagaaaaaac

SEQ ID NO: 11885 - DNA, 1501 bp, Oryza sativa
taagcaattaaaaagttgaagtacttagacttgaaactggtacatcaaacagttaaaaagaagacttaaaatagagttgaaacgaataatgaaaatcaggagctgaaacttcaagaaagaaatatacggagtacttgacagcctgaaactgaagtactctgaacacagaaaagcatcaagccatcaacgaattagaactgttcgctagataaaacagctacagatcgaacatgaaaaaacccctccatgaatcagaacaaggtgtcccagttgcaaaatcctattccgacatcaacaatcaagcacagcaaatccagttttaaacaaaacaagcttgcaaatttgccgcccaaacagtctccaaaacgtccaatatcccactacccccagacgccaagatctgtgtccctccccttaccctgacggcggcgccgacgtccgggagcccgacggccacgtccccgacgaccttggcgacatcgaagtcgtcgtccttgggcaggcccacgactaacaagtcctccttgtacccgccgccggcgccggcgccgccgccgccagccacggcgccgacacggacgtccgcgaagccgatgctggcgagcgcgagcttcttgccgccgccgccgcgcgccaccccctcctcctccatgcccatggctactcgagaggaacgcaaatgcgcgaaaccgcagggggcaaaccgcaaaatggtggtggctcctctcctcgccgccgctcgtcgccgcttttggaggaaagggtggagaggagaggaaggaaggaaggaggaggatgctgacgtggcgaagcgcaagaatttttgtatagcggaatggagatcgaattcatactagtacgtatttatatactgtatttatcttgtatttttccctctttttctttcttgagtgaatattgctacgcgtgtttgtattgtgtgagatttttgcatgtttttgttgtgtttgttcatagtgggatgattcgaaatctcctgtattttttgggagtttctgacatcaatttgcacgtttgagaaatttgtgtggttgtatttttttttgtgtatttacaccaaggcttccttcttgaaactttcctgcattttggcattttggccgtttggaatggtggcctttttcttgagagagacctcgatgtcataaaaaaagtgttttttttcccttttcttttttttttgaaatgatttctcactcaccatgattgagagagaaaaaaataagggaaaaagcgagggctaaagtacaaaaaatgggtccttttcccgaggcgatgaccttttgggcccacaaattattattcccctgcaggatctagcttacacaggtgtgtgggcccaccacgcgtgctgggcccaccgtgatactggagtgataggcccatggacctatgttgtatgggccttacgtcagcacggcccagttgctggttttacctgcagatgcgagcagccgccggcggcggcggtcggagagcg

SEQ ID NO: 11886 - DNA, 1501 bp, Oryza sativa
atcttttataaaccccactcgcatgaaaagagtatattgctgatttttttttcttatcccaaaggaataatatctatatatacacatctaattcaatcaactatcaactgggcctaacactatgaaactagtatcacgtaaggtggagtcctattagtagcagtagttaagcgttctcttcatcctttagctttgcctaacacatgtggtttaaaaaaaagaaaaaaaagaagaaactatggttgggtcacttgaagagttccataaaaaaaaactccaaattgtaagtaatacaccattatcatccatattatccacattatcatattatagcatattatcatccattttttatggtaaaaagaaaaggaattggcactatattaccaacagtacatgccaacatgcatgcacctagttaaactccaaataatattctgaagtctcccttggcaacttctgaaaagcatccaaaacttctgaaaagccgagttcaaaaagaagcacaactaaagtaggcaaaaagaaatagagaaagagaaagataaaattgccccaaatgctatacactgcaaattacctttccctctcttctcaaaatcaaacatcaaaagaggtagtagaaaagaaacaaagttgtcaaaaggtggatagtatacaaaataaattaaaatcccatcattaattagtaatctttacgaagaaaaggcaaaacgaatggctgctcccatatgtttattcagagatgctctctttgtcccataaaaaatcaaattctgagtacgaatctggacgtatagtcagaagttagttttgtataggtggcttttttttcttctgaagataaatatgaagatgaagattaagttttttttacgtaaaatgaggtggtattaacgtatgattgattgagttttaattattacaaatttgaaaaatagattagtatgatattttagagcaactttcatataaaaattttcgcacgaattgcaccgtttagcagtttgaaaatcgtgccataaaaatattaatcttcgtctaacttttgttggagaaaagaacggaatcattgtgatggagggagcagtgtattcagactttcgtcagaattcataggagtcacacacgcaacgaacgcacccgcacgctcgcgcgtgtgaatttcgcgtatagaatccctctccacacgtgatgcagcctgcagctgcaaatccccattccccagatgtgttctggttgattaattagcgagagtaattaattaattatagcctgcgattaaattaactctgatgcttaaacagtacagtggccagtaagcttagctcggctgcactattatattactactacttttttttttctcttcgctgctaccgagtctcttctgttctctcctcaaattcgcctcctcctcgccggcggcgatccatccggcgatggattccggcgggcggtaggctgaggcggcggtgactgagctcgggagacacggcgg

SEQ ID NO: 11887 - DNA, 1501 bp, Oryza sativa
tttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggaggcagcgggcgagccgcagaggagtacgatggtaaagctgctgacggtttggcgagacttctagaaagtaaaaaaatgaacccaaacgataattatgttcgatttttaaaatctcaatgacaacaaagagaagagatagtggacggcccgtagaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagt

SEQ ID NO: 11888 - DNA, 1387 bp, Oryza sativa
aattttgaattgtggtgaagaacattctagaattgtgccaaattgaatatagtcattacaaaatatttggcttcaaaccaaatcatcacatttactatttaacctaccaaaaaattggtatggcaacattttgatatcaaaccaaaatggcccataatattttaggattcacaaatgagaaatcaagagaattccttaatcaagtaccatcataataaatgatcttggcaacgcaaaggctgcatctagcacaaagcaaacgatctcaaagacgctcttttctaactctaccaacttcctgacagagcgattgaacaagacagcacaccatgtatctcagaaagaagaggttaggagctgacgataaagaagaaatcaaatctaggagtctacgcggatgagatcgcctccggattgagctgctgctaatgagttcgtctcctgatcggggagagaatatcagcgattccggagaagtccgcgtcgcccgcagacaatattttcacgcgagtgaagtttgacgtcgaaagcgagccaaattggctctccctagccggcaaggtttttctcgccctgtacaactaactcgcccttaaaagccaagctattttactagttccaaacggatagccttgccaggcaaggctagggtgacccttgcccaggatccaaacgtgcccctagtgatctgaaccgcctatggtagatcggacggcggagggaggtcaaggttaggacagttacaaatggtaagcggttggacttcctagagagaactaccacagggcaccactgctgtctcgctgacccgtgggcccgtcctgtcggtgtgaggattgcacggttgcaccacacactgctccggcaaagcgccggcgagctcagggagcatgcaagataactaacctctgtctcggcctcagcctccggcggcgccgccggctccaccgccgcggccgcggcgacctcccttggaacggacacgcagccgacgaccccgcccttcctcctcgtccgccgcgacggcaccggcagagccgccggcgacaaggtacaccgccaccggcccacccacctgtctagcccagccgcgccgcaccaatgcgccgccgccgccgccgccgccattgttccgcctctttacacctcgcctctccctctccacctcttctctccctcctcgtgtggataaagccgcggggaaaacgaacggctcccgcgcctgacgccccgggcccacgcgagtccacgtcggatcgtacacgaccactcaccaccgaggctgacactggggcccacacagaatccaactcgagacatttttaactcacaagtcaacggctccagcgttgaacacttgaaccagatctcgccaccgcgtccatgg

SEQ ID NO: 11889 - DNA, 1501 bp, Oryza sativa
acgtacgggcagacgtacacttgttaccaccggtacttcttctgtcgtcgacggcgagagtacccgagcagcagcagctaaaacgacaccaacttctgtacaaaagcattcgaggaatcgagggatcaagaacgcgatcgagaaacattgattcatttgtcaacgatacatatataagcctgcaaattaacttcaaatactcacgaattatatatacctgcagtaatcacaagagtggcaacgatcaggagaagaaagtacagcaacatcttcagtttattcgttcctggctcagcggccattttgctattccaacctgccctttttttttctagcaatacacacacacgtaggcaaaatcaacaagaagagatcgagagatgctaagcttcctgcaatataaacgtacagatatgaatcatggactcttatatatatataggtgcatctcatatagatacagttgtctgaagatgtgatcagaggaaaaaggatatgagatgatgcatgaatgcatggaaatgtggcatcaatcggcgacagagaaggccgatgcatagtgcacgatttgtacgtagtacgattctagcggattcctgaaattacgtcgcaggcgtgcagcaacagtatcctttggatgcttttggttctctgaacctttttcaccttacctttcatttagatcgatggccgaatgagaagaacagacagctggaaagtaatttctactccctccatcccataatataacaacctaggaccagctgtccaaattcgttgtactatgaaatgtctcgtccggttctaatttgttatattatggaacggatggagtagcttttgattcacagggtagtgggatatgtatagaatagttgagtaatgtctggtactctccatcgtaaaatgtaagaacttagaatcggataagaaatattttaatactataaatattaacagtagtaatactatgatgtaaatagtagtagtattaggatgtctagacacgtagtaatatgatgtattctatcttatcctagttttttatattttaagacgaacatagtatttttttataagataaaaattggttccattgtaaaaaaaatgagaaccatacaaggtctatataaaccaaccctacgaatagactaagatcatgtccttttcttcaactttctcattttctattaacgcactttttaaaactgttaaacggtacgttctttttttaaaaaaagtctatataaaatttgtttgaaaattcaaataaaaccattttcaagttatgtctctataatctatttctttgatatgatcgtttttattctatattaacttaaaaaaaaacaactctccatctttgctagatctcaagtgttcgaaaaattgtaaaattgcaatcacctaaaaaatatatcaaattttcatgtataaatccagaaaaaatagagaaatgatcacacttaaatacaaattagtagtaattgatcaagtaaat

SEQ ID NO: 11890 - DNA, 1501 bp, Oryza sativa
tggtttatatagaccttgtatggttctcattttttttacaatggaaccaatttttatcttataaaaaaatactatgttcgtcttaaaatataaaaaactaggataagatagaatacatcatattactacgtgtctagacatcctaatactactactatttacatcatagtattactactgttaatatttatagtattaaaatatttcttatccgattctaagttcttacattttacgatggagagtaccagacattactcaactattctatacatatcccactaccctgtgaatcaaaagctactccatccgttccataatataacaaattagaaccggacgagacatttcatagtacaacgaatttggacagctggtcctaggttgttatattatgggatggagggagtagaaattactttccagctgtctgttcttctcattcggccatcgatctaaatgaaaggtaaggtgaaaaaggttcagagaaccaaaagcatccaaaggatactgttgctgcacgcctgcgacgtaatttcaggaatccgctagaatcgtactacgtacaaatcgtgcactatgcatcggccttctctgtcgccgattgatgccacatttccatgcattcatgcatcatctcatatcctttttcctctgatcacatcttcagacaactgtatctatatgagatgcacctatatatatataagagtccatgattcatatctgtacgtttatattgcaggaagcttagcatctctcgatctcttcttgttgattttgcctacgtgtgtgtgtattgctagaaaaaaaaagggcaggttggaatagcaaaatggccgctgagccaggaacgaataaactgaagatgttgctgtactttcttctcctgatcgttgccactcttgtgattactgcaggtatatataattcgtgagtatttgaagttaatttgcaggcttatatatgtatcgttgacaaatgaatcaatgtttctcgatcgcgttcttgatccctcgattcctcgaatgcttttgtacagaagttggtgtcgttttagctgctgctgctcgggtactctcgccgtcgacgacagaagaagtaccggtggtaacaagtgtacgtctgcccgtacgtaacttctgctagctcgatctctctgatgcatctaatctaaagcaagctagctgtagctccatgatcgagtatacatggctatatatgtcatggagagcttctaaccactgcatcttcttcaaaagtctctaggtcttcaaacagtttatattctcacttagattctgataaaatatatggaaatatatggttagagaaaaaaaagaactaaaaactagaagctaagaaaccaagattgtttagattcttagaaactgactaccgactggtagtttctaagaattttaagcttcttcaaaataggatctatatatataagataataagaagtaaaagatgcataccaatgtgacgaagatgatgt

SEQ ID NO: 11891 - DNA, 1188 bp, Oryza sativa
aatcttaagacaacgagataaatttttcagaaattttaagtaaaatcatgtaaaaaaataattttatatgggtgctagccgcgcaattgcgcgggccacctagctagttatattattaaaggaatagaaaaaggagcctccacgttcgctctcatggcctagaaattctcacattaatcggagaaaaagaaaaggcagaatccatatagaaatacaatttagaaatagatgaaattcggaattaaaaaataaggaatattagaagatgagactagagtccatatagaaatacaatttagaaatagttgaaattcggaattaaaaaaaataagaaatattagaagaggagactagagtacatatagaaatacaattaggaaataactgaaatttggaattaaaaataaggaatattagaagtggaatatagagtctatatagaaatacaattaggaaataactgaaattcggaattaaaaataaggaatattagaagtagagtatagagtccatatagaaatacaattaagaaaagaaatagaaattcagaattaaaaaataaggaatattagaagtagagtatagagtccatatagaaatttaaaactaactaaaatttggaataaacataataaaattaaaagtagagtttagagtccgtataaaaatacaacttacaaataactaaaattcgaaattaagaaaaacatgggaagaagagtttaaagtcaatataggaatacaatttagagtaactgaatttcgaaattaaaaattaaagaatattgaaagatgagtttagagtccacatagaaatacaattagaaataataaaaattcagaaataaaaaaaataatattggaagaagggcatagagtctatatagaaatacaatttacagaaaattcagaattaaaaaaagaaatattaaaagacgagtctagagtccatataggaatatatataatttataaataactaaaatttgatattaaaaataattaataactaacacgtatataaaatataatatgaatattacacattagtagttttgtaatgttattacaaaatttaaaattatattgttattttaatatatttgaataatataatgagaaaacatatatgctattatatgagagaaaatataatgatgctagccgcgcaatttgcgcgagccacca

SEQ ID NO: 11892 - DNA, 1501 bp, Oryza sativa
taagggaaagtcattaccgtatagttagttgagttttaattattttaaacatgaaattgaattatctaatattttaaagtatcttatgtatagaaaattttcgcatgaaatacatcgtttagcagtttaaagagtatgctaatgaaaaccgagataataaaatgttaatgttgggaccgcctatgcatcactcgggtgatttttgagataaaatcacccagattttttctttccttggatttgcatccaacgaattacaaaataaaataactaatacaaatttacttacacaacatttttttcaaaattacagtgcacttatatgtcatatcaacgaaatttacatatgtaattttagttatataggactgtaattttatatttgaaataaaataactaatgcaaatttatttacacaatattattatcaaaattacagtgcaactaaatttacaaatgtaattttagttatataagactgtaattttatattttaaagaaaataataagtacatatttacttacatattattattatcaaaattacaatgcacttacatgttaaatcaactaaatttacaaatgtaattttagttatataggactgtaattttatattttaaagaaaataataagtacatatttacttacacattattttttatcaaaattacagtacacttacctatcaaatcaactaaatttacaaatgtaattttagttatataggactgtaattttatatttcatgactatgacgagaggaacggtgtctctcgctgatcagtattggccgtgctaccggcggctggctcgccggtcagaggccactgtgttaccgtgcttctccaatctccattatcgtgtgcgcttgggctagctagacacagacacgaaggctgacgtgctggtgtccgacacgccagctgacgaggctgcaaaaaaaacgtgaaatgtcagcaaaaaaaaatcacgctagtgatcgatagcaaaatcggttaatgttaaaagagtaaaaacaaacaagcaaaaacgttcatctatggccatgggctaagctagcttcccctaggccgatgaagagcatataaaccggcccaattgtaggccgggcttttaagcccaaacatctcttacggcccccagttttccagccaactccaagacgggccgttccgggccggaccgagcctctcttagcttcttccgcgactcggactcggcccactggcgaagcaacctccgagccggtctccctcttcttgcagcacaagaagaagaagaagaagaagccgagccgaaataaaactagcctccccgcgacgccgcgccgccccgccccgcccgatcgccgccgcactcgccgcccgtccgcctcgccgcaacgcaccgcgccaccgcgccgcgccagcctgagggagagagagagacgccgaggtttgaggttggtgagggagctgaggcggcgggagaaggaggaggagcgagagcgagggagaga

SEQ ID NO: 11893 - DNA, 1501 bp, Oryza sativa
tgtgaatacatgtgtttgtccaatgttttttaagaaaatatatgcctttttgctaataagattttactgagataagagagttatcattggtcttcgtcattataactacatgttcttattagagcgcactcacatgtgtgcgaatatggtgttagggtgtgcggttgcaagcaattttaccacttataattattttttgtttcattttataggggacaattcgttgctttgacttcagcgggataaatatacaatgtattcaattatggtcgtgttttttgtgttctcgactttgaattttcgtttacacgcttctaagcttatgcctcatgtaaaagaaactatatggtattctaaaacaacatttcgactcctcagacaactagaaaaattagatcatttcaatttcagcagtctcaaatagagcctaatagattacataggatattcaagattatatttgacatgcaaaaattatactagtatataatagattgcataggatatcgtgctaattattcccttggtctaacaaaatcaacttagaaattgatgagacacttccctcaatctcagaaaaaaaaaccttagagatatactccctcggtttcatatcataaaactttctagcattactcacattcatatagatgtatatgtctaggttcattaacatctatatgaatgtgggcaatgctagaaagtcttataatatgaaacggatgaagtatgagatactttttattcagattcgttgtattacaaaatgattaaatgattaagtgattaagcaagattgtcgtctgttaagcaagattgccgtctgttttaaataaatattttataacattttcaaataaaccaatttctacctttttgcctatcatcgatctgtaaatcgagaattttatcttttcaatatctctcacctacccacctataatataactttgctattaattaggggtattttggtccttttatattcaccttggaaaataatctttaatacccctcacctacccaccccataatataactttgctattaattaggggtattttggttcttttatattcaccttggaaaattatcttcagtaaccctcacctacccactcataatataactttgctattaattaggggtattttggttcttttatattcacctcgaaaaattagggttggagatttttttttaagacagaggtagtaaaacataatccgattgtcctgtgagtgttccccttctccatctacctgtctgtcccccaattccccacttccccaacccaggcgatcctccgccgccgccgccggcggccggccgcctccctccgccgccacgcagccgcgccccctccgccggacactccagaccccggtgagcctcccctcctccgccggccgccttgcccgcgcccgaacgccacgccaagctcaggatcatttcgtcgatttcgtggattggatggccaaccttggcggtggcgcgatgc

SEQ ID NO: 11894 - DNA, 1501 bp, Oryza sativa
gccatggcggcgccgccgctgacggcccgcggcgagccggttgttgatgggcgatgccgcttctgccatggagatccgcccgccgctgcctcccgccggcgagtggcgacatctccggcgccaccgcgtggcgccgaactgctgctgcatccctccgcccacgtgcacggccctgaactcctcgagcccccgcgcgggctctgcgccggcgccgcggacgaagacgaggagtagcttctcggggcgggcggcgccccccacgcggagcccctccccccaacgctctcgccgccgacacccagccttctcccgtttcgtcgttgtcgcgtcgtcggccaccaccaccggacctcctcgtgacgccgtgaagagggagggaggagaggaagaagagaagggtgataatgacatgtgggatccacatggggcccatcattttattaatttgtgcgttaaagtgacatgtgggtcccacatggattaatatttttctagatcgaattgccatgtcagcgccatgtcaataccacgtcagatgaagactgagtcaaattagccacataggcgccacgtcggccaaaaccgcccttcatactgccgagggatctcgcttgtccggttttcgtaagttgggggttgggggacgggtcatacccggtttgcggttcagggacgtaaatcggactaagcaacaaaatagagggacgtaaagtgaacttattctaacctgataatgtcggtatcaggcctgatgggcccattttctggatgggcttcatttgatctgtcgagaggcggcgtcctgatcgagagcctgatattcaaggaaacgaccaatcggttcattccaaattactattccctccattcgaaaacgattttgctatatatttaacgacaaattttctcctaaaaatttgacaaatataattacactacaatcgtagtgtaattacactgtaaataaagtgtaacttgtatgtaactttcaaaaatctctctgtaatatgttatttcggtaaaatggaggttgtgagaacaaatccttatacatatgtgtgtgctgtgatttttttcttcctcacctaaacaaatcttgtaatagatttaacgattcaaaattacgtgaaacttatatacaagttatgctgtagttacatacaagttacaatgtaattacactacaattatactataattacatctgttatttttttaggagaaaatttgtcgacaaatgtataggtggtcccttccaaaatataagccacaaccactcttaacccaaagaccaagaaatagttattattatcttgtagtttggatcatcctaataaatataatgcatgcatccaataaagttaaagaatgtgacagtgaaggattttaaaaaaagtagtaatttaataaaaaatatgttatagtttaaaaccttatattatagaacatctaagaaaagtggctgtctcttatattatggaatggagggagtagctacgag

SEQ ID NO: 11895 - DNA, 1501 bp, Oryza sativa
taagtccacttgtcatccctcttctttacatcaagtttaattgaaatccctataaatactaggaatcttcaccaatcaccacccttcattttcgcaaaaccgtctaatttaggtagaatgagcactggcatcctaatcagcaaaagaagtaaaaaaaaacattggactcacatgtcagccacaacttctttcttcaccctctttttttttccccaaaccacgcatgcgcgtttatggggtggcggtgaggaaggcagcgagcgaacctatccaagcttgagctcaagcggcctgcgtgcgagaaaggcggaggcaggatagggagggggaggtggtcggcaagctcgtccgagcttgagctcacttagccttcatgcgagtgaggtggaggtggccaacgagctttttcgagaagaggagggagacaagggggccagcgagcttcctccactatggcacgccgctccttacggtgccgaagaagatggacataaactctaaggcggaggtggccccgtgagccctgctccgtcctggagggcgaccaccatggaggaggagaggcatctccgtgacgatgccatttatcatgcccatatccacaccactcctcaaatgaaagcaatggccattctcaccgtctagctacggtcttaactcatggtggctgccgacgcggctggctcctgccccgatgagcagggatgccaggccacgcgcgtattgctactgctataggactcaagttgtacagttatgtatagtttaggggaaaatatttctcgtattgaggataaaggatgtcaattaaacccgacgtaagttgaggatggcaagtggacttatttctttctgttaatcagccgggatgcgtgacctcgtgagtaaaaagcctgcttattttaatcgtgggctaatgggccaatatcgttctgactcatggagttatgggcccaatctaggtatgggtttatccataagcccacaaggccgacaacaaacaggctattttttttttggagtaatgaagaaaggaaaaaagaaggcaaaattaatgccatcatgttcagggtttataaaaccgtgcggttatcatgtgtgataacattttcaatttttaaaaccatggtatatttcgcggtaaccgtcaaaccgtagagcagcggtaaccccactctaaacgggtttggtaacgctgctcctgttactgatacttcaagttcaaggtgtatttgaatcatcttgcatacaatgtagcttgccataacaaaaacattgaggaaaagcacaacgtatcaaatcaaatactccaatgtgttccaaaatttccccagtactgcaaagcaatcgtaaataacagtaccgtcctacaaaactgtaccaaggcctatatgtcctactatgctgatatttttccaaatgaaaccctactgcattcctcacttatccaaaaaaaaagagaggagagaattggatatgcacaaatcagaccagctattta

SEQ ID NO: 11896 - DNA, 1501 bp, Oryza sativa
tcaacttctatccagatcaagtgaagggctttctgcagcattctgagaaacaaccacagattctactctctcttttttttttcctgatgagaaactccacagaaagataaagagttcttggttaccgaagttgggctgcatggtgaggcctgcaatgctcttgttcagcctggagatgatgctcttgttcagcctagagaagtggttggtgccaaggcataatgttgtggagttgttgatggaaaagatgttgacttgaactataatctcttctggtgagaacgatttcttagcaagatacattgaccatcgcaagggtagtactgttcatggactagcagatggtcatgctgcagtttgtgctgggaaagtgcctacaaaagccctagcttagcatatctggacctagatactggaggttcattccatctttctggctcataggctcatagctaagacctcgctgtaaacctggttgagttaatgtaattccttgtaatgtcttccaaatcttgatttagtattatagtaacaactaactatcttatccttcttagtgctatgcaagttcaattcgtggagtatgcagcaactttattatcttaattttgatgctctgctgctcctgtgaatatgtgaggtcttattgcttctgccattttgttcttgttctgataattttccaaatgtcattttcgcttcatttccctgttctctctagattatttactggattgtttgctctgtgctttgaaaaactatgttttatctaaaaaaattctactatattgcttagctcatttcttttaagctagtacttattaagtttgtttctcaaaatatttaatttatccttacgatcgttcactggaaagggattatgtgtgtgtaagatatttgtgactagtttattgaatatattttgataatatgtttgtttgatgaaaaaatattacatatttttctataaacttggtcaaacttaaagaagttcgactaggaaaaagtcaaatgagtccacgtatcctaattgagccaggccaacacaacatgaccaaacatctcactagaccgtgtatgggctctggtattagcacgtgggccaacacggcatagtccgttcggtgagtcgtgcctaatcgggcagcgcacaaacgtacctattatttatccctatactatatatagaaaaaaagataaaaattcaccgtctcaaaattccagccacatgagctctatttgaaaaatgggattaggacaaatattagaaacgcccagtagtgttccggttagctctatatgatggtgggctagctagcctagattcgaagcctcacaacttcaattcattttatattgggccattctatagtatattcgcgttttttaaagttattattttcatttttcagattttcaccaaacatgtttgggacctttgggtaggggtggggatggggcgaaattactaaagtaccctcgattttttgacgcctctgtc

SEQ ID NO: 11897 - DNA, 1501 bp, Oryza sativa
gaacttgaatttgagtaggttgatttcgccacaacaaacctgactacttgagccacgcttacttcgcttattaataaattacgtgcaaatcttaaaataaaaatatttcttaaattttctttagtaataaatcaaaccacaacaaaagggaagatggttactttttaaaatgagataaatggttaaacgtaatgtaaaaatttaacggtgtcatataaaaaatagtaaaatatagaggtagtaatttataagtaaaacgtttatatgtgtccgtactacttagtgatataaatgtaaacgttgtaaaataaactacaacaaaaaccagaaaatcaattttaaattttaacttatataagcatggatataaacgaagctgttaggtcactgaagacatgagttgccgtaaggcaggtttcggccggcgaagtcggctgggtcgcctaaaagaggagaaaacggcgttggaacttggaagtaggaaccgtggatctgatggcccgagaaaaaaagacgacccacgaggcctttccggcccattttgttgttgggataaaattgttgtacgggctgctttacttgggcgggatttttttttatttataattttttttattaaaagttttacaaaaataattttccattttgaaaattgacggaaggagtcgcctaccgccctctgggagggtgatttttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctcagctagggcgattttgtactgtggggggggccgcctgcaaatgggcggcgaggggggcatggaattttgcaggcggcccccttgccgccctccgctagggcgattttgtactgtggggggggggccgcctgcaaatgggcggcgagggggcatgggattttgcaggcggcccccttgccgccctgggggagggcgatttttgcctctccccccataaagcccagtccctcctctgtgaaatttcattatattcactaaaaatccaaaaaaaaccaaaagagagagaggggagggcagcagaaggggagcggcgaagccctgctggttcgctcaattcatcacaggtatgctcccatacatcttttgtgcatttgtactaatatgttatgtttgagtatatatgttgcgttttagttttagttccatatattttagcacatctgtagcacatagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggc

SEQ ID NO: 11898 - DNA, 1501 bp, Oryza sativa
cgtacggcgtggcggacgcgcagatcatgacgctgttcaacaagcaggggcggatgctggaccgccgcatcggcggcgtggagctgccgcccgccgcgctccagacgatcgggccggcgaccatcgtgctgttcgtgcccatctacgaccgcgcggtggtgccggcgctgcggcgcgcgacgggcaacccgagcgggctgacgacgctaagcggacgggggcggggctggcgacgtcgctggcggcggtggaggggcgccggctgggggcggcgcgggcggggcggcggccggcgatgagctgggcgtggctggtgccgcagtacgcgtcgatgggggtgtccgacgtgctggcgccggtggggatgcaggagttcttccacggcgagatgccggaggggcggcgcagcgtcgggctggcgctctactgcggcgccgtgggcatcggcggcttcgtcagcgccgcgctcatcgcggcgctggatggcgtcaccaggagggacggcggcgaggggtggttcgccgacgacctcgaccgcggccaccctcgactacttctactggctgctcgccggcgtcagcgccgtcgcactcgcgatgttcctctgcttcgcccgctcgtacgcctacaggaacaagacgctgcttgtaccatcaaacaccagtagtattaatactcatcatgcatgatactagtacgacggatcgatgcatgtacggacagacaatccagattgcagactgattaattgattatgcatcatgtaaataattcaccctctaattcatagtaattccattccatactggcatgctcaaaagcaaagcagtcatttgggtaaaaacttgctagtactccagttgtatcaagaagcaattgcttcttcaagatatatgctaaaacaatataaaattataattattttaaaacataaatagtactagtttctttctacgccacgtaggacgatagaccagatcaatgcaccacgtaagtagtttaaccaaaaccagcgaccaaggggaacttaatttgcactagttttataccttagttgtactctatattcgattttgcagttgagtgaacttttcaaaaaaaaaacaaacaaaaaaacaaaacaaaacacaaaagaactgccgctattcctcaattccacccctccatgtactccttccattatattggcgttcatccaaaacaaagcagggttaggtagcaaccatgcgatccacgcacatgaccacctctctaacaggaaactatttaaattttttttaatttttttaacaagataaattaatacgaacattcttaatttaacttttacatattgccaaaaaaactatttttactgttaatatacattaacaatttataatttaatttgttttttttaatttgtagaagttaaattttaacagtgatatatcacatatacttcttaattttttataattatttagatagcatgcaaacaatagagatatgccttctcgag

SEQ ID NO: 11899 - DNA, 1501 bp, Oryza sativa
ttatattgagatgaatgtggataagtataagtaattttccagatctatatcctatatccaggaagttgctatatttggacgtgtgtagtagtagttggtagtgcttgtaaaattcatctgtttcagagagggtgttattgatttatttatcaataccgcacctttatgataaaatagtgctttgttggcaaatatttgaaaatttggacaaattgatttggtttgccttttaaaattccgatcatctattttaaaacaaccttatataatctagtaaaaaattattacagtattcgtcgacgagttataccacgatcacggtattcatatatatatacaggatgtttgagaacgtagggaccaactgatatgggaatgcaaacaaaactctaaaagtatacgggttccaacctcctattgacaagtaatattcctattcctactgaccgaaaccggtgttaccattatatatcaatatctctcataaatataatagggagtagaacctaatctagtttgctagtacaccagtgtgaagctcaggcatgtgcttgatggctaattgatatcggcttccttgagaacaaacttggcaagattgagaggtggctctagaaccctccttgttggattcgtgtctcctctccttctgtgaggttttgtatttatactgttattataaataccctcttgatcaagtaaaactaggaaaatcaattatgtatacaattcgggtagtcttggactcttggttagatctaaataggactctgtttcctttttcttatacatgactacttccttatctacttattacacttgccatagcagtattgattccgtatatgatttggtatatagtgggctccactaatactagtacatatgtggagcgagaagtatatgatatctcatatttagaatactaacaatatgatagtgcttttaagacaaatatatgtataccatttcttctatttccaaattaaacattctaaaaattaccaatcgtcggaattttgaaagtttaaccgaatcttaccctagtcattaatatttatagcgtgagaatgtacttctaaagtactaggagtagtgtttaaacaaaattgaatctaacgacaaatgacaccttgcaaatataataaaacccagaggtacaaagtacaaaccccacaacctcgtggctactataacacacgcaacaaactcacgggagtcaggattcatgtctcatgcatgtttgtcaccaaccaaatgatatcacacccctctaaatacggaccaaatttgccctttccatcttcaaaaaattcaaaaaacattaacaaataaccccctgataaccctcataatcacacataaccccacttccactccttataaaccctcacactcccacacttcaaggaggaggagaagaagaggccaagcaaagcaaatcagccaaccacttgagcttctccctccactgagctccagatccactcgccctcggcaa

SEQ ID NO: 11900 - DNA, 1501 bp, Oryza sativa
caagtggttggctgatttgctttgcttggcctcttcttctcctcctccttgaagtgtgggagtgtgagggtttataaggagtggaagtggggttatgtgtgattatgagggttatcagggggttatttgttaatgttttttgaattttttgaagatggaaagggcaaatttggtccgtatttagaggggtgtgatatcatttggttggtgacaaacatgcatgagacatgaatcctgactcccgtgagtttgttgcgtgtgttatagtagccacgaggttgtggggtttgtactttgtacctctgggttttattatatttgcaaggtgtcatttgtcgttagattcaattttgtttaaacactactcctagtactttagaagtacattctcacgctataaatattaatgactagggtaagattcggttaaactttcaaaattccgacgattggtaatttttagaatgtttaatttggaaatagaagaaatggtatacatatatttgtcttaaaagcactatcatattgttagtattctaaatatgagatatcatatacttctcgctccacatatgtactagtattagtggagcccactatataccaaatcatatacggaatcaatactgctatggcaagtgtaataagtagataaggaagtagtcatgtataagaaaaaggaaacagagtcctatttagatctaaccaagagtccaagactacccgaattgtatacataattgattttcctagttttacttgatcaagagggtatttataataacagtataaatacaaaacctcacagaaggagaggagacacgaatccaacaaggagggttctagagccacctctcaatcttgccaagtttgttctcaaggaagccgatatcaattagccatcaagcacatgcctgagcttcacactggtgtactagcaaactagattaggttctactccctattatatttatgagagatattgatatataatggtaacaccggtttcggtcagtaggaataggaatattacttgtcaataggaggttggaacccgtatacttttagagttttgtttgcattcccatatcagttggtccctacgttctcaaacatcctgtatatatatatgaataccgtgatcgtggtataactcgtcgacgaatactgtaataattttttactagattatataaggttgttttaaaatagatgatcggaattttaaaaggcaaaccaaatcaatttgtccaaattttcaaatatttgccaacaaagcactattttatcataaaggtgcggtattgataaataaatcaataacaccctctctgaaacagatgaattttacaagcactaccaactactactacacacgtccaaatatagcaacttcctggatataggatatagatctggaaaattacttatacttatccacattcatctcaatataaactaacttttacgcatgaatttggatataacgtatatttagatt

SEQ ID NO: 11901 - DNA, 1501 bp, Oryza sativa
attggctacaagagcattgagaaatgtaaatattaatgaattgcttgtttacgtgattataaaagtagatagagggagtatttcgttttctatacggagaaatgatttacgaacacatccaattgtattacggttaccgcggcgtgctgactgaccgcttaccaaccacggttcacacccatcttcctggatcaaaccggctagtaagctagttctgtgatttatgagtaattaattaagaagcatgcgattatctttctcatcatgtgccaaagattcagggcggcgaggcaatctcatatattctcaacggacaaataataacaacgctttatctgcagcagccatccgaatccatcggcgatgcacagcgaatgcattgactccgatgagtactactgtacttgatggtgttctagaactgaaggaaggaatgaattcggtttgagtccgtgagtggttgattgatacaggtagtaccactgtaccaccatttgtggggttcagtttggcatccaagtgattgtgctgattaattgtctcattgttcagccaatcaacggtacaagatgagatgagatgagaggatgggctgttatctctgatgtgttttctgcctctcatgtcatcatcaactcgcccataacttaaaccatattatttttagggatttagggatattcagtttatttaccattttcaagcctaactaattttagtaatattaaaattttgtaaagtttgataatgccacaagatttggtaataaggtaaaattatgtatgcagtattgtttagtttgttaccttgtaaagaataatttggatgattaccaaattaattttggtatggtaggatgtgataggttattcgagacatgtttggattgttgtcattttaaattttggcaataccaaaatttaatatgtttgaaaatagtaaaaaaaaagtgaacacgcccttagtttatttatccgattattgaaatggcttatttattttatgctttgaaaaccaatttccttttagaaaaatagtactgtaattgatcaggctatttattttaacttatttataaagttcatcttttaaaatacttaatctattttaaaattgagtagataacttacgacgataatccaaatcaaacaaacctaactttaacactgcaagagaaaccgacaattatagcgagtaaaggaatcaagagatacgttatcatggaaacggtaagtactgaaagattagcgagcatacattaaaacggcaggtaaaaaacccaaaaaccgaaccggtgaacgtggacgcgaaaaagggcaacgtgcaaaaaaccttcctcaaatccaacctccgaccgcgtcaatggccgcccaatcacacgtccccacgtgtcccccctcacctccgccttcttaacctcgccacctcctcctctcctcccacctcgcctctctctcctctctctctctctagtttacttttcttggagccaccaagaaac

SEQ ID NO: 11902 - DNA, 1501 bp, Oryza sativa
cactggccggcgaggctgaagctggtgaagggggtggcgcgagcgctccaatacctgtacgacgagctgccgatgctgacggtgccgcacggccacctcaagtcgtccaacatcctcctcaacgaccgcttcgaaccgctgctcaccgactactcgctggtcccggtgatgaaccagtcgcactcggcgcagctcatggtggccttcaagtcgccggagcggaggcagttcggccgctcctccaagaagagcgacgtctggtgcctcggcatcctcatcctcgagatcctcaccggccggccgccgtcctacgacccgccgccgcagccggaggcggcgacggcgaacggcgacctcgtcggagcggtggcgtcgacgccggagggggagtggctggagaaggtggtggacgcggacatgatcaggaagtgggaggacgaggagagcaagggggagatggtgaagctgatcaagatcgggatggcgtgctgcgaggccgccgtggacagccggtgggagctcaagacggcggtggagagcatcgaggagctcaagggggggaaggaggaggacgccaacgacgagcactccttctactcctcgatcgacggcgacgaattcgccagcgtcgccatcaactaactcggaaatcaacccacattagcgcgcgcatcggttgtaattaagcagcatcaaatgatatgttaaaaagctcattatgtaaagtatacagaaatgatgcctaacacactaaatctgaactagcattctgtacttcatgtacgtctttttcgatttttttttcgttagcatttgactcatttcatttctcttttttttttttgctagtggcacaaaggccagggcacagtatgttcatgtcgtgtacaatatgagcgattttacggtccagaaggtcgtatattttagtttaaatttgttatgcctcactactaattagggcatcatcggtgtatgaaataaatcgaaccatcgcacttaaaattgtaccaacaagcacacaacactacaggtagcaaaccaaatcggtacaaggcaaaatggaaccatgttcttcgttcaaacctgtcaaagatagcttgtcgtccctcctatttttggcatcgtatcttccatatttggtgaacggggaatgcatagtaagccccactattaccttccgttctctgtaatattttccgattattcactagctaggtctatttcactgaaattagcccgtaccaattgtgcatgagttaagccattcctcttctctctcgatacacttgcatggtgacggagcatggggctcctcaccgggagaccgcgcaggcccccctttgccggttcggccgggggcgctaagtgaggttcttcaccctcgatctgtggaatgtacgcgagagagaaaatgcacgagacacgggcgatgtagacaggttcgggccgctgagaagcgtaataccctactcctgtgttctggtggatctgtgtgtga

SEQ ID NO: 11903 - DNA, 1501 bp, Oryza sativa
gatggagctggagctgtgtcaaacagatccatatagtagtacaatctagatccaaatgaagcgcataaagcctctagtattagtaactttttctttttttagaaacacaagtactagtatattttagtttttttttaagataatggaataactagtatattttagttagccttgacattgtgaaggcatgtacaattattaataatgatatcttaatattgctaatttggaatatttaattgttaacatggaagagagaaagtggataaacaaaacattgttgttatggttaacaacgactcaacaataactcttagtcatggttgcataagagtgaaaaaataaacataaaaataattaaaaaaaaaagaatattttaaagttaatggttatagcctatcatcttaacaattgcaaagatatagtatctaaataagtttgtattgtctaatagcctattcgtattgggggaatttcaatacataggaatagaaaaagcggaggaattgaataggagtgcatgcacacttcaatccataggaaattttccatgaggtttgtttggatggaaaatttcctttgttttctctctataacttgtaggaaagaaaaaaattcctttggttttttctatatatacattgctatgaatcgaatgatattcgtaggaattaatccttaggaatccaaatcttttgaaattactctaaaacgaatagtccataagagataatattgtctctaccatttgaatatgtcctcgattcccagcttaaggtcaatctacacagttgcacgcaccggatatctttaattcttctcttctttgaattactgccctgtgtatgactggtaccttagcatggttgccaatcgactttttctgctgcttgtcagtgatttcgaggaaggagaaatgttagaatacggatgaactccctcactgttgtaaactgcacggatcctgatcatctgggttttactggagtagtagaaagtagaattggtgccagcaaacacagtgaaagttgtctgaattttatctgcccctttttatcttgtttcaatatgggagtacttgcgcaagcacctaccgggagggagcttaacatggtagtggcacgcatatatttgaatcgcatgctgatttacaaacttgagcgtacgaaatgatgcaaagatatttcatcgatccagtgcgaacatttacatgcggctctgtatctatcgtggcatgttggggaacgatattagaaacgaattttttttatttataattttttttattaaaagttttacaaaaataattttctattttgaaaattgacggaagtagtcgcctaccgccctctgggaaggcgaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 11904 - DNA, 1501 bp, Oryza sativa
gtggtccagcgcgcaccactgcaggaacacccggaagctgcgcagctcgtcgtggatcaccgacttgctccgcgcgtacgccgggttcagcagcagcggctgcgacgacgccgccgccgacaacaacgacgacgaccacggcgacatggaagacgtctcctcctcctccgaatccattgccattggaacagttggataattcggtttgattcgtatgcatcgaaatatatagtcgtcgtgatcgagtgagcagtgtggggggtgtgcaagtgttcgacatgaggggaaaggagaggagggaggaggagatctcgtgatcgttcacaagggcggcgacgactgatgaatgcagaaaaaggcaaggggaagaaggcgactagctacgcgtgcatatgcacgaactgttcgatgatcttgatcgccatgcatgcattgtccatgatgttcttccttttctttttcgttgtcaaaggttgtcacctgttcagctcgatgcacactcttggctgagctatactgaactgaataacttgttttgttttttcttaaaaaaaaagctcgttccggtcataaatatttaactcctggaatgagattgtgatcaaaatttcaaaattcagaccatcgaaatttctttaaatgactaatttaaaagcacaaaaaagtggcaacaatagatttaccttgaaaagtactgtcataatatcataaacttatacacatatacagattggcagaattttaaacgattgataaatcttcttctaagcttcaaatatttataatcagagggggtaacttttctttttttgtgagtaaaaaaataaaatgaataagtattattaatgaactttggaaatcctagatcaaattccaaaagaataagtccacttctgagggactcaaagtagacttatacgaattccaaacaggcttagtaagcccatggtgagtttacagatgggccataacccggaagagattgccagctctgctaggtgaggtggagggcccacctagtgggcccaattgttttcgcgggggcatatacagcggaggacgcgtcgtcgtggagaagtggaaatcagtttccactttcttccaaagccgaaaaatcgagagagaaagagcaaaaccctaaccgcggcgctccgcccccttccgccgccggattcctcctcctccttcgtccgccttcgccggcgccgccctgctccgaaggagcccaggccttgtcgccgcgtcgcttgccccgccgccggtttcagcagcagccacccccaccaccatgtcttctcaggtacacgggtctctttcctcgccttgctctatttgtcgccgcggattggtcggggggctccgattgctgccgcgggaatccacccccgtcgccgcgggatggtgcgtgcgggagtgggtgggcgtagaattaggttaggttggatttggacctgttgcttgtcgatcagccatgggatctcgccgcaaaagctcacgcttg

SEQ ID NO: 11905 - DNA, 1501 bp, Oryza sativa
ctttctgatatgcgatggaattcattgttccaaacttcaattcgttagttatcctgcaaaatatcttctttggtcatgcctgtgatcttgtcccgctaaatgtgatccttgttatggttgaaatttgaagctttctcatttgtcaacgttggaaaatgtgatcctgaaaaaattgcaatcctgaattgggtaaaaagttatttgacaattgatattatcaaccaatcaaggattgtgggattggacatctgaaatttcatctgatctaccaaataaaaattgtagggcctattggaagacaacacttgacatgagggaagtagacaagtagtcacacactcgcactccattgtgcatctttcctaccagctgagttcgaatgttccaaatcctacgaagctaccatgaaagtacaaaaccgtattagcacttttttagagaaggacaaaaccgtattactacctcctattgaatacaaacttgtatgccgtacatatttttgcacacggttacaattcccgaacaagggaaaaaaaacatgactttcccatcaaaagcacaaccttctccatcaaaaaaacattttttttccattaaaaacgacatttttcacgaagtgagcatgatttatcagttagttagtgttaatgaccaaatttggtaatatcagcatcggaaaaggagattagatcaaggtgtagtcgaaggcggagattgatccaagaacagagcaaagaatcggctgaagtccagattggctacgattaggatcggctgggtctgagtcgaactaggtgagccgatgcagccgattctaacagtataatttggtgtatgacattgggttgaattgaggtgcttcaagatgattgccgcacatggatagagtcctgagaaggcgattgtatctattaattatgatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtaatttttaacacacatgttcaatacaatttcggcgcatcaccaactttttactttagttttgtttcgacgagttcttgctttcggattgagctgcatcggtttcgatcttcaacaagaggtaaaacttgttatgatgacttgtgttctcgagattagtgctttcatctttatgacactctaatcttgtctatataattcgtcaagttatcatatatcttacataatctttggcaatatcgtcatctaacctacaatcggctaacatatgttaatagaaggcagccgattaggttaaataacgacgttgtcctagattatataagatatctaccactttatgaaacacctagcggcttgattgtctagatattgttcttcttttcatacttaatgctgcatcagttgagtttgatctattaagtcgtgcttag

SEQ ID NO: 11906 - DNA, 1501 bp, Oryza sativa
gctccggcgatggtgttgagttctgcgacatgagcttcttcccgctggcggagacggcggcgagggtcgtcgacgcgtgcgaggggttgctgctgtacaggtcgctcgccgcggcgtcggcgatgtacgtcgcctgcccggcgacgaggaggtgggcggcgctgccggtgccgcggagggaggcgcagctcccgctgctggcgttcgacccggccgacggcggcggcggctcgccgcgctaccacgtcgtctgcttcgtggcgtggcaggagcgcggcgccaccgtggacgtcttctcgtcggagaccggcgcgtgggcggagcgcgacgcggcgttcggcggcgtcgaggcctcgtcgctgtcccccaccacgcactaccgcggcggcgtcctccacgtgctcgcgtacccggaccgcgtcgtgctcatggacctcgccgccacgaccacgacgacgacgtcggtggcgccgggcaggctcgcgccacggctgcccgacgacgtcgacgccggcgcgcgcctcggccactcccgcggccggctccactacgccaagtgcgacggcgagcggctgagggtctgggccctcgacgtcgacgccgcctcgccgggctcatgccaatggatcttgacgaacaccgtctgtgtcaacgagatgaccatcaatggcgggctctgggcggcaagcgaggtcaagttcttggcgttccacccggacatggccgacgtggtgtacctctcgtcgccggaggggaaggtggcgagctgtgacatgaggaggaaggagatggtgagctcgtggaagctgggagctgagcaccatgtcgtcaggttttggttgcttggtttctcctcgggtttgatgagctgcctgggtggcgagcaagcatgccagattgccggtgctagctagctatagtatactagtatattttttttctgctatttcttttccatttgaccttcgatttgattgcttcagaactcatatatcaaaacgcagttttgaagaaaaagttaaatggatggtggcggcgtgtggcaacgataacataagcccttttgaattgtgctttggtttgggtcggataggtgttgtgtgacttagtgtttcttggtggagttggagttgccgatcacatgggtgatggtgtgatgataataacgtcgcgtttttgccagtgtgggagttttgtttacttcttgcttgttgcttggctttatcgttcttgtgttgagcagcattgttaagtgttgcgcttgcctaaccttgcttcattgcgttggcaggttaagtttcttggagtatttgctgctgtagttttcgctcaatttttcttaattaattatctgtttttttaaatgggacatcttcttcttcttatatgtaaaacatcggcaatggtctgtccgttcgtaaacaaatagtcaattatttatcaaagttcatacatttcagcagtgttatactcccccttataaaatatactatctccattc

SEQ ID NO: 11907 - DNA, 1501 bp, Oryza sativa
atacagtggatatgtagagtgcagatttcttgattgattacgtagctatgtaacagggaaggaaaaaaatgccttttccctgaaataatactctgatattttatcagctctcatctgaaaccatttaagaaataagagctgacctcattccttgaatgtcatttctcgcttcatttggtgtatcaccacattcaatgttgatttctcttggaatctagaaaatgaaagcaagtactcagaacaaaaggtgaaaattaacaaaagcactattttacatgacaatgtgcaatactatgtaagtatgtaactgatatagagggaagctctcttttaaaatgcttgaagtgaaaaacttctgataggtttcccgattgataattattccaccaattacagaacaatgcatatttcaatgaactcatgttgaacagttatttttttataaataacataccagtggtagctgatcaatgtctggatcattttcatgttccagaagccagtttattgcagattcaagactggaattacctgataaagaccgattgttttaaccaaaccgattcggatatgtgttgaagaaattcacaaacaggattacagccatgcaaccatagacgaaattaaatatcctttactgttctaattgaatactatgccattcagcctaccataaaatagtttattacaatatgtctaccttgtattccttttgaaatagacataccagaaaaatggagtgccctaattgaacgagcagtagggaatcccataagttcaagttcgctaagaattctcttgtccaattgtggggtagccatcctagaagatacatatatgaataagaataagagcattctactgaccataaatgcaaaattagaacaaaataggaatgaaatgttatcctcatgagaaaagttggtacacttgaagctagatctcccataaaaattaaagatctaaattgcgaactagcctttttaaggacaaagaattagcaaatgttaccagtaaagtgaagttgagatatctttggagtgatctatatgcaaatacttctaactcatgtttagtaaagttacaacattctgaagtttaatgtctacaatctgtccacgcactgatctcattccatagcctatttgtgtaattatcattcttggttgaataggagaacggaaaactgcctggtaagcatagtctagaattacaggctattatggcacagttagggaactgaagaaggctgagacatttgcataatttggcatcacacctgtgcatacttacaggatggtaatatggtagaaacagcaaaacataggattcaagtagttgggcgaaataatcaaagcattttccaggttatcttgacagaacatcaaaggaaaatgttgaaagttttcgactgcatgaacaagatgaatggtgaacagaatttcttaccttttcaaaatttcttttcactttcaaactttggacccaggtggctgtacga

SEQ ID NO: 11908 - DNA, 1501 bp, Oryza sativa
aaataaatggggcattagttttctcggatccaaatctacatataaacatatatataaacacacacacacatatatatatataggatacccatatgggactccatggtgcctaggctccaaggtataaaacacacaaattctctcaaatttttaaaaatgttcaaattgtgagtatatacctaggtatatgaatttgattcatacaaatacctaacaacaaaacaactcaaactcaactttatttcacaattcattattacatacctaactaattatatgtttggatattatatacttagaaccaaaatctaacaaaaagaaagttcaaacttgaacttgttagtaaagaagttaatgtttatatctaaatattttaaaaaatttcatacccattaaaattgggtatatactcaatttgaatcttggagcatgcatattcatgtagcaccagttaatttacctctttctctctctctctctctctatatatatatatatatataggatctaggattcgaaatcacatcgagagaaaagagagggagagagaggaaagaaagagagaatcggcatcagctagggtttagaaagaattggagaccatcataacagaggccgatctaaaggggcgagaaagatggatatatacataccaggatttggagacgggggcggagcttggatgatgaccggccgccgctcaaatctccgacgcggcaagatgctgagctgctcgcggcggggggtttagggtttaagagtttgagtttgccggcttagcgaaagaatgctaattaacgacgggtttaattagggttttgatcagtggcggcgagtgtgagatatatatacgtatcgcttttcagcggggcagccgcgcactggccccccaaaatggtggggccctccacctacccctctgtgattagggatgcgatcatgcaattagactagagattagcgctacgctgtacgcaaaagccaaaggcaacagcacgtgtagataactatattattcctgattccagctgatcccgatttcttatctcttctctgcaagggcttctagctagctgattggcaattttagtgttgttgattgctttcttctagtaatatattaacattaacgtgcaatcctcttggtgcttgagaaaagaaaatatttgtttggattaatcggtgctaataatttaagttgtataatctatatgagttcgaacactaatacattatttttacaattcttagtccattcttcacattatgtcgcctcgaaaataaatgattaaatgagaaggaatcgttagatgtttttatgaaaagcgaattgctagatgagattactatcaccaatgaattcgcgtctaaaaatatctcaagaaatttgcaatgaaatatttgtgaggttcttcatataaatattgcttttggatgaactttaaatatttacaagcaatatattcatatatgtatatctatattatttattttttgtatg

SEQ ID NO: 11909 - DNA, 1501 bp, Oryza sativa
aatggacatattgcatttgctagtgattattcaaataattattcgagatctttgaattacgaaaataatatgtcactgcctatgcaaagtaattcacatactttaaaattcagtaatgctagtaatatacaatatatacacacaccttttaattcatcggcgattatttcacaacctactgttacacaacaaattttgccgatgaaagatatgtatggccatgacaatattaattatccagttgattcttttaattcattgcatggcatgccaagtatcggtcagtcacatctcagtcttatgggtcaccttatatagtatctagtggaaataattcggcttcatatgctagtagcgattatagccgaattaatagtagttccactagtgattttgtacccccacatagtttgccatcttcaaaatgtcaatcaaatagtactatgtatatggtcaaacacgcagagttcaaattgtgtaaattcggttgggggcaaactgaaatacctatgtcaaaaattgccaacattgatcaagagcacaatttcgatctcgacaataacactgtcacactagacgatttatctgagggccaacggtgtgagttagagcaggaagtcgaggtagaaattgcagagctaagggaacataaactcatacgcttgcagaaaacaaagaatagtgttattgcgaaacagcaaaagccgataaatttagaattatcggctaatgaaaaggaggtagctatgcttgatttatctggaaacataggaccttttgttttgccagctgaatttcgtgccaaggaagtggatgaacatctagacgatggatcacgaaatcgcgacgacaaggcggaaatattggagagccatcaatgaacgaacttagacatcattcaagtgaaaaaatcagaatgcttctccaacacattagataaggtaacgtttacaggtaatttgcttatttctcaatttgatcatgcttctgaaaataatccatacattaataatgtcaccatgaataattctaacagatcgattggggagattaatattcttgttggcaataataaagtgtttaaattttctatttcatcattgacaaagtttatgtctacatggtttgcttatgatcaatctagagctagaagcacaaaattaaaattggtgctgatatagcagatagttctaaatcattggacaagggaaatataagcgacaatgtagccgaatgggtagatagtaaatctgaaccatttgtttgcttagctttaaaaccgtctccacaaaagtgtcggttaaaggaaaagaagtatacttttgattggagtatgtgtgatcatatttttgatgatttgctaaagaatgattatattaaattgccggatcatcatgtcatgccatcgcttcaagatttagaagaacaaatttattgtaagtggcataattcatttgatcattgcactagtgattgtaatatttttcgtcagaaaatacaa

SEQ ID NO: 11910 - DNA, 1501 bp, Oryza sativa
tttcaatatttgtcactcaattcacactactttcagaatacaccactagagtgtgaattttcttcgttccgtgacactctgtcatcccaaaaccgcgcgtcgtcagttcattcctctcgccccgtttgccctcaccgccggcgagctcgtcctcccccacgccggcgagcttgtcctccccacaccagcgcctgcgctgctgggcgggaccatccacacggtcgccggtgacatcgcctgcttgccgccgtgccggatattgagatcgagccgccactgttggcttggaggagggggtcggcgacgatgggggtagcgcggggggaggagccgtggccagcgcctccaccgggccgccgacagccgcgcgcgtcggctgtagcttgcggcgccgcttcgcggtgggctcgtcgccgcgggcagccgccgcgacggcggagggcgactcgatggggatgcggaggacgccgtcgacggtggcttggaggaggtcagccgccggagctcgaccaccggagcgacggcggctcggttcgctcgtgtcatccccgagctcagccgccgtcgccagtccaacctccgccaccgcggcctcgagctggtatagagctcagtcgccggagctcgacgccgacgggcggcggtggggctgacgcgggcgacggaggggctgacgcgggcggcggcgcggctaacacgggcgcgagcggtggctgactgatgacggcgacgtcgggaggatggagaacgacggcgcgactgacggtaggggatggaatagcacggaacaaagaaaatttgcactctagtgttgtattttgaaagtagtgcgaattaggtgacaaatcctgaaagcagtgcgtattgggtgttatattctgaaaattctcgcttgcgggggttggaccctggagcctggagtcgaagagcttgccgccggtagaatccatggtgcggattcgcgccagcgtggaccggccaggtccgtggccgcgcagatcgagcttgcatgggctggctagctccctggtaggtccctgtcctcctctcctcgctctgctctctcttcctccatcccggcatggattgggcgcaggtgacgcggatcaacgcagccgctcccggccagcatcaacctcacttgaaagaagcagagcgattttccaccttggctggatcagatactatttgtcttcgattctgtgagtttatatttgattttctgtcttttcttcaactcgattttgttaaagtatatctctgtgtaatccgtgtgctttggattaggatggccggtggattaagctatagattagcttaggttgttgtgatcacatgtaataaggatccggccgttctatccatagcgcatgcctatttgtatcttctccatcgccgttttgtgcgataggttaacacgcatcgtcgacccgagtgcaaaggacgacgttcccatccatcctgttttcccacatggtatcagagcgctgaagttagatcc

SEQ ID NO: 11911 - DNA, 1501 bp, Oryza sativa
catgttcatctgaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtcttatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgactgttatgtcacttgtctgtggatcaactctcaagcccctcattaaccatccttttatagaaggtacactcctctcagccggtctctcaattcccctttctgatacaataaaatttgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgagggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcaggggctatttctgcaatttttttggtcgatagattatttctg

SEQ ID NO: 11912 - DNA, 1501 bp, Oryza sativa
tcatgaactgatgcacaatatgcccaagagggtatatttcccaaacctgaggtcagggtgaaacatttcgtcggagaaattagcacatgttggcatacaaactgccaaaaaacagagaaaggggagaaagaaacaggacacaaataaagaaaatgcttactcgaaccatctccaatattaagaaaacggcaaatgtgtggcatgatgtgtggcatggcgcatgccctttgaaaatttgcttcccaagaatttttgagatttgcaatcaacaaaacatcttagttgctgaggtctctgcaaatgctaatgctctcactttcagaaggtcttttggggagagagagtctgaggaatggctagctattggggatatcattaactctattgagttgtctgatgacccagatgtgttcctttgggggcttgataagaataaaacttacacctctaaatccatgtatagagcaattctctttaggggagtgactgacactagaatgcagggtgtgtggaattgtccctgtcctgaaaaaattaaacactttctatggcttgctttgaaaaacaggatacaatctgctgaacagctgaagaaaaaaggatggaagggctctgagttttgtgtactttgtgggatgcttgaaaccactgatcacattcttttccagtgtccaatggcctctttagtctggtgcttatgcagagatgcttttggcttggagtattatacctaggtcttttgaggatttcttcctgatcaatggctctttgggtggggctgatctgagagttttcttgaccctacttgctgcagtttgctgggtgttgtggtccactagaaacaacatgatttttagagaaaaattagtctactcacccctatcattaatgttccaaatcaattcatttttgcagctctggagaatccttagcagcaaggacactgagaaaattgacaagatttttttttttttttgccgggtcggccgaaggaactggcgaccaaatttcattaagattgggaggaataaaatcaaagtacaagtagttttcgcttgcaacgacaggaggctgtcgaattagactgtggcaggaaccacagcccggcaaactaaaaaactggaacgccaacacaacagaaagaaaactaagaactgcaattctcgaaatagcctgcttctttccacactaagatctcttctttgatagcctctgctaactggttagggcttctcgatctttggtcgaaaattgacaagattactgggaagctcatggatgctacttcaactttgagacaaccaagatctggagttggctgatcgtctgaagtttttagttcttagtcgtttgcttagcttgagagtttgttaagcctgtcttagagttgttttgtttccttttagtgctggtcagcttttatcccccctaatggtgttaattctggacctttcctgtgtgtgatgtaaaatgggtatcccccataacgatgccgtgtttg

SEQ ID NO: 11913 - DNA, 1501 bp, Oryza sativa
gccgggagacgcggcggaggacatcggtcgccgtcgccggcgaacaccaggattcgatagagatcgaaaagtagtaggtgattttcgcaggagcggaatattggtaagggtcagacttgctgtgttgcaacccctcgttcccaacacatttccctcgtttttcacgcgcacgttttttaaactgctaaatggtgtactacttaaaaaagtttctatatgaaagttgcttaaaaaatcaaattaatctatttttgaaaaaaaaactaatacttaattaattatgcgctaatgaaacgctcggtttttcgtgtggagggaatagttcacaattcacatcgagctcatgcgaacacagaggacttctaccgccagtttgacacagcttcaataaaaaaaatgaagtccggagctgaagtccacattttctggagctaaagtccaatcaaaacaatttcaacttcaatataaaaataaaaaatgaagtgagctgactaaagtgctctaataaaataaattagagaggtagaattgggttttagtaactccataactacaattcaaacccaacttttgaaattaaattttgaaattaaatttaggagtttagaccctatcaaatgggaaagtcacacgcgatcaaaccatacaactatgtcactaccagagcaatctaggccatcggatctcttccatttccccttccaaacttcgccagagaggagatgacctccccaccttcgccgccatttcttgtgcagacccgctgctaggaggagagtgatttgcaagaagatcgtttggcggcgggatggccacacggcgtcggtgacggcgtcaatggcaaagagcccccaaatcccctactccctagtctaaaaaaacctaatcctaaattcaaacacaggattggttttttttttgggacggagggagtatgttgacctctttggcggcaactacatatagacgtttgtgcaggctacgccgtacgtcgcagaccatggccagcctggacaaggggggcttcgtgccgtgctaccaagggatcggtaagcattattacaagtttgtggtactcaccaatcaccagactgttttctcgtaccagggtactccttccgtcgtctcatgttgtttggaagtacaagttcccaacacttttttcttgtttttcgcgcgcacgcttttcaaactgttaaacggtgtgtttttttaaaaagtttctatacgaaagttgcttaaaaaatcatattaattcttttttttaaaaaaatagcaaatatctaattaatcatgtgctaatggaccgtgccgttttccgtgcggccagcttgtgttgggaacacaaggttccgaacacagccaagtcgttttaggtttacactaagctaattttttttagtttattcaagtttataaaaatatatagtactaacatctgtaacatcaaattcataattgaatattttgatagtatatttgtgttgaaaatgttgcttta

SEQ ID NO: 11914 - DNA, 1501 bp, Oryza sativa
gaggcgaaatagacttttgcggagggatttgatttgggaaggatttggattcgggattgaacttggcgatcgatcggagatttgagatccggaattggcacggacactagacaataagcaaggaaacagatttcgaaattagggtttttaggaattacattttcccgctaggcgccacgacggaacgggcgctacagaaactcaaatccctttatactgtgggactgagggagtactatcggagatatgggcccgggggtatgtggagtagaggggaattattttcctctctggccacgtgactccacaggttggccccactcgcgcgccacgcgagtcgtagaagcgccgaggaggggcctcggggcatgacgtcaccccctcgggctctcccgcggcttcgccccgaggccctcgcccagctgccacgcggcagagagagaaagagcaagaagggagcgcaggctgaacagccataaatgtgcgacgccccaactgtccctcaccgcagttaatacggtaagggcagagacgtgcggcgtgcctagcgaacccctgttcatcggatgtgaccggtctgtgaccggcccgtctccgtcacatccgttggatagggcgaccatgtcctcacgtcgcccttgtccccgacggagtgggggtgggtatgacccgtcacatccgagcgcaactcgatgaggggctgttgcatgtcatcgttcatttataagggaatgacagggctgacccccgtgtcaggcggaggacggcgccgggttccgcgcaagaatcagttattgcttagcttccgagagaaggcacagtttgaaaacccaaaaagatggagtggggttccccccatggagggtaagtagaggcggcgcatgtggcatccccttaagctataaaaggaggaccctacccacggagatgggggacgactcccagaaaacctgaacttgagaaggaaagacgcaggtgcgctctctgagggggaggaacccttgtaaaaatcattcataatcccaaacacaggagtagggtgttacgctcgatagcggcccgaacctatataatccgactgcgtgcattcactcctgatagtcgtagggacgagcaaacgactaacgagaggagagcctccgcccccggccgaactcacgaaaggggggtctcacgactccccgctattgagggttttcctcgacaagtaccctgcaggctgcagcatgccacttcaggttgactttaccacgtctatgactgtgcgagcaatgcaattaccatatatggctgcgtgcttcttcaaattaatcagagtcaactacagtacatttacggatttaccgacttacgtaggtgcaatccatcgaaaacttgcacacggtaattgaccaaactcgctctatatatatagtgatcgaactcactctcgaaatcaaggtgtaattaatcagagtaaaaaccaagcaaaagtacagtgtcatgtcgacgttacgctgct

SEQ ID NO: 11915 - DNA, 1501 bp, Oryza sativa
gtgctcgccgccgtcgccgcccgtgctccgtagcacccgctcgtcgccggcctcgctcgacgtagctccgcccaatcctacgctagcaacggactcccggagtcgcgtagatgctctagctcgcccgaatcggtctcccgtcgcgccatcgctgtttcccccttctcccgccgccggttgccgccaccgcaatccgccgccgtcgagcatcccccagcgaatccgagccgttggctcgtctcccctcgtcccgagcaacttcccggtgtgctcgctttcgcctgtatcgccgggttcgctccgccgcccgccaccgtcgtccgccgtccgttccggccgacgtcgtcgtctacctcccgccggcccgcgtggcagccacgtaagcgccacgtcggcgccacctcggccgcgaccgggtcaagctgaccccggtccgccgctttccctccgccccactcgcgcgtgcggtccaccgcgagccgtgaggctgcgcgtggccccgccgcaccgcgtcctccgcgaaccgcgcgcatgcgctgcgcctcacctccccaaaccctagcacgccccgcgtgcacctcgctcacggtgaaccgagtcgccgacaagcgggtcccacccgggaccacgcgggatggacccggcccaccggctctctctctcctccctgcccgcgcgcatgttttgggccgccttctcgggccggccggcccgttaagtttggacgagccgcccttttctctcgggccgcgccccagccgcccgaggaaagtctaatttgcctccctccttcttttcttttcttttctttttcaaaaagcatttaaataaattctttttttttaccaaaaatccaataatcttagaaattcaatatcttcccaaccgtaagtccgtttgactccgttcaacttccaaaattcctcaaatctcgagatctatctaatggcatgcttagaggtcaataatagggctttattttcgccgtttgctgagttgtcccgtttcgcgtgtagttccggagcccgaagacccgcagtgcgaggatttcgaggatcaagctcaagatctcgagcaaggcaagccacccttgaacatcttgagcctatatttgaacttaattatgttgcttgaaaaatattatgcattgataggattgcacttaatctgtttgcccagtctgcaaggcagaccgatgggcctacctagctcattgcgtctgatccttcctttgttaattgttataccatgttcccttgtaaccacctagttgcgcctcggtaatcgtgcactctgcacgagtatcgacggtcgccttcaaccttaaaatctgagaaacatcttgggtaaaacttgggttttacaaaagacttggaaaacccgacacctgggtcggtgcttgcgaactaaatgaatttccaaaatcgcggaccggggaacgtaccgggtgtatggtttcccgctcttgcacttaaggaccgtttccttggaatttcatccg

SEQ ID NO: 11916 - DNA, 1501 bp, Oryza sativa
gaagcatggacgaataaattaaatattaaaaaaatgagaaacttgttttaaaaggttgtttaaaacaacgatgaggaaaactttcccattgtaagtttggacaccatgtctacgataatctatagtagtacacactaccttagttccataaaaagacaacctagtaacacattctagttgacatacgattgtcataattcgtagtattatgatgtgtcatatccgatcttaaatttatttttttatatgatagagggagtaagttacggagaatgtgccctcaaataatgtttcaacaatttgaatggggtctaaagggcagaacatatttgtagagcctcctaggtattgtgtaggtattgtttgggaagcttaaaatttcgagaagcatctatttcgtagctagcttacgagaatttggaaaaatatgaaactcattttaccggattctataaccccatattcttagaatttcaaaaaaaaactatactttttagaatgagcttttgtttgggagaagatgcagctgtcgtaaagctcccaaaaacggaccctaggacttcaatggaactgttgctaccgcacacatactgccatttggctaacaattttatccaccgatccactcgtgccacgtttctatttgacaattttcggaatctaagcccctttgtaattgagaaatatcaaatggattttgaattttgaaggattcaatttcctataaaactatttgatttatagaaaatggtaggatcttctcataggattacatttatatggttcaatttcatatgaaaaataagcaagaggtctaacttcttgaaaatttcctgtgatgctattagaggctcctcttcatctttcctatattttctattcctacaagattagaaaaacatgcaacattaatttctgtatgtgtattattcctatgtgtttcctataatgtatttcaaaggggtctttaaaaaaatatcgagtgtcacttatacatttcagtaacatacttaacaaactattataattattgattatgaataattataataattaataatttgcaaaatgggccatcgtcatgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgctgttgctctctgatccctagggtttactttcccctcctcctcgaactctagggtttttccgctcgc

SEQ ID NO: 11917 - DNA, 1501 bp, Oryza sativa
cccccgccaccgtcgttgccttccccggcgccagccgccaccaattgctgccaccaccccgccacctttaatccccgccgccaccaccaccaactgccaccgccacctcacaccgacccgccgccggcggcctccccgccagatccggccgtggcggcccggatctgggcggtcttcgcgcgtcccgcgcgcggcctcccaccgcgacgggagagggagacgaagacgagggtgaagccccgtcgccgccatccttgcggccgcgcggctttgccggtggctgctcggacggcggcgaggcggtgaaaggaggaggggggaggagcgggcgacgccggcggtttccgtctcccgtgtcgcccgtgggggaggcgacgcgggggcaaaatacacatacccatacttaaattacagtgagaaaactaaactatgtgcaaacagtattttgtgggtgccgtacattaattgttgactgtactgtgcgttatctagcagcactacctcggtcgtattcaaatgtagcagattctagtattaaaaaaattattttagaatatagtaattcacctcttattctcacataaatcgttttttttttcaatcaatcataaccttcacatatctaattcaacatattttcttcatactagcaaaaacccgtacgttgcaacggattattctaaatagccaaaaatattcttggttgaaacaagattcttcatcttaaaggacaaagaaaaaaatgccatacttggtttttagttcagattgatgacttcatctgtgttatcaaaatgcatttttcatatgattgtaaaatatgtaatcattaataaattgtgttgtatatctcatttaaactacaataaaaacctaaaaagtttgtaagtttttataatcaagattgcaataagcaaattaatagaaaattaaaaagactactcctacgcaactactccaccctagtacgtgatgaaaaagctacactcataaatcataactcatattgaaattatgacctatgtgtcgaattttagaattcgttatattatattttaagatggggatacacctttaggagagacaactgactatatttagttattcttcatatgataatatactcccttcatcccaaaatataaacatttttagctatgttacattttggaactgaggtattaataaaggtaaaaaatgaaaaaaaagggaaaaaactgtagcaaaaaatcgctgttcagtacgtgtggagcccactctatggcatggccgaacaagaaagaaattcggctgcaaagaccgaagacgaagagagagatgctctgaaccttatcggatggcgatccgcttcctctctccaatctgacccgaaaccgccatcctaatcagctaaatccagataagcattaggggcaaattggtcatttgacccacaagaccggctcggctatatatatatcttcgctaatcctcatttcgtgttccctcttctcgctcctta

SEQ ID NO: 11918 - DNA, 1501 bp, Oryza sativa
cacgtggcggtgggccattggaccatttgacgattcggttgatacttgcgcgaccctgcgcggggtactggtaggaatgactttgagcggaatgaatcacgccgtatatttccgggcatgtgccgtgtgtggcaccagacctgcacctgccacgtcacttgccgacacgacaacgaatgctgcgggacccacctgtcataggcatgacagaccaactgaatatttgcacccaggggcccaaattctcgcctaatgtcaaataagggttgatccctcgggtcacaaatataagtagaccaaatgtttattctatgcaccaactttttttgttagaaacacaaaataaatgtagacaccccacgcacactcattccttttaaacgcacacacgcacacacaccatgcctctataagcacctccattccttcagaaggctggaccgatatatcttgagattgacgaagtgacgtctcgccgtcaacgagtacgtcgcttcttactgaaagaataataagttgtaaacgtgtgcacccgtgacaaatctaggatttaaactcggataaattggtttcaccataaagaacctaactagttgagatacgctcacttcgcatacaccttatgattagataagtatgtgtcaccaggaataataggctttgttcgagagagtttccgacagatgcaaccaattcgataatcttgagttcttacaaacaactatagattcgcactttggattttgagattaagtaggtgcaaaatctataaatgaattcctaaacatgagacctagaaatgaactataactatagtaggcataacaacctagaaacctgcttatttgacagattctcactgactgtttaccaattacttccttcatccaataagttaatatattactagtatgcatcatatccagtacttttttacttcctctccgtttaaaaaaaaaatccaatcttagtaaggatttggtgaccaaaattgttaccaaaggtgattctcagtaaggttggtttttctaggacggagggagtaacttaccgtgggatgaagggagtatcagactctgtaacacaaaaggtgtagtataaaattagattttgtaggggcgtaatgtgaaaaaacgggtagacatacgccgggttggcccgcaccaatgaaaaggccgcccccatcaatcctccagtccctggaaaatctcgcctccttctgctccgcgtccccgagagtcgcctcctcctcaaaacggcttcgagagagagtggtggtggtggtgggccttcccgtcgtcgtcttcgacttcactccaactccacctccacctccaccacccctctctcgaagccatcgccgcctgtctctcctctccagctcgcccggtcagagtccgcgggggattcgattgattggtagctagctaggcttccgcgcgcggcgacccaacgtcggtggaggcggtgctgaaggccgggcggcgtctcgttcgtggtg

SEQ ID NO: 11919 - DNA, 1501 bp, Oryza sativa
gtggcgaccaatcgatgaaatcgaagattttattgccgtatataggagtagtaaaagattattaacaatccgagttcgtgtaagtgtttgagctagtgaagaaaagtgaggagcaaaataagttaagagaggcgagaaataaattaattaaagattaaattaaggagcgagaagagggaacacgaaatgaggattagcgaagatatatatatagccgagccggtcttgtgggtcaaatgaccaatttgcccctaatgcttatctggatttagctgattaggatggcggtttcgggtcagattggagagaggaagcggatcgccatccgataaggttcagagcatctctctcttcgtcttcggtctttgcagccgaatttctttcttgttcggccatgccatagagtgggctccacacgtactgaacagcgattttttgctacagttttttcccttttttttcattttttacctttattaatacctcagttccaaaatgtaacatagctaaaaatgtttatattttgggatgaagggagtatattatcatatgaagaataactaaatatagtcagttgtctctcctaaaggtgtatccccatcttaaaatataatataacgaattctaaaattcgacacataggtcataatttcaatatgagttatgatttatgagtgtagctttttcatcacgtactagggtggagtagttgcgtaggagtagtctttttaattttctattaatttgcttattgcaatcttgattataaaaacttacaaactttttaggtttttattgtagtttaaatgagatatacaacacaatttattaatgattacatattttacaatcatatgaaaaatgcattttgataacacagatgaagtcatcaatctgaactaaaaaccaagtatggcatttttttctttgtcctttaagatgaagaatcttgtttcaaccaagaatatttttggctatttagaataatccgttgcaacgtacgggtttttgctagtatgaagaaaatatgttgaattagatatgtgaaggttatgattgattgaaaaaaaaaacgatttatgtgagaataagaggtgaattactatattctaaaataatttttttaatactagaatctgctacatttgaatacgaccgaggtagtgctgctagataacgcacagtacagtcaacaattaatgtacggcacccacaaaatactgtttgcacatagtttagttttctcactgtaatttaagtatgggtatgtgtattttgcccccgcgtcgcctcccccacgggcgacacgggagacggaaaccgccggcgtcgcccgctcctcccccctcctcctttcaccgcctcgccgccgtccgagcagccaccggcaaagccgcgcggccgcaaggatggcggcgacggggcttcaccctcgtcttcgtctccctctcccgtcgcggtgggaggccgcgcgcgggacgcgcgaagaccgcccagatcc

SEQ ID NO: 11920 - DNA, 1501 bp, Oryza sativa
atcatgccatgagatgaagctgttggaaatgatatagtatactcacctaactggagtaaatcgggagctgtctgaattttgcccctgaatatctggaatgcaagttgctaaggagagaacagtagttgaaaagttgaaagagagaccagtgggtgagatcgagagttgcatactggcatgatgcaagccattgaatgttagttacatgcaccgatgcacaactactgttctcactgcaagcctataaatcgtccacttggaactacaacatcaaatcaaaccatatgacagcaatttgcaaggatatgttgccttcgctcctgaaaattctgttcttggattgagttctttgtgaagctgtagctagcattttctctcggtgaaatggatccacctgggcctggaggaccgggaggaggccctggcggttggggccctcctggaggtggccctgggggatggggccctcctggaggtggccctggaggatgggccccactacctcctgctggacctggctttctgggtggcccaggccctggccctggttactgggggcctggatttggaggtttcatggggtcctggtaagctgtgtacattacactgccctaaactttctggaagtttaacctcgcgttgcaattgcaaacaaagtttttaattcatctgcttaggaattcacattatcacatatgagttaaaaggtctacgttatgtgcaagttcaaccaatcgaagcacacaccaccgaaatttcacatatcaactcatcaaaagtttgaatctctgaaactctcttgtgcagtttttatgtcctctgctgctgctgcttgctccaggattgttgtgggccattgctggggcgtccaggcccgggtggcccatcgtcacccttctgataccaccctgaccttacccacctagtgaaataatgcgatgtgtttaccattacacatgggaccaaaatcgttacacatcctctgatgaagaacaagtacctgatagcagcttgcagagtcttatatatgctctttactttgtcacttatctctaggggtgttatgcataatcctacttgtttgcatttgttagcaactcgacgatataatgatggttctgctttggtacctcgttgatgccttacaaatgtcaaatcaaatacaacctgacagttttcaaactgacaccagcccaggtgaaaaggaaaacaacgaagaaaactgcaccgattctaagaaagaaccgaatccaacacactataaaaaccccagtgaggggagagaaaagaaatcccgggttagtctactgagccagcagcatctcttggacggttctgtacagatgtaaaagctgttctatgcacgcaggcaattggtacctttgttatatgcaaaaccataatggctagtgaaatacgatgctaaggaatgctcccctttcaagattgatgcgtagctgccctccaattcttgtgacaaactgaagtgtccagctgatgg

SEQ ID NO: 11921 - DNA, 1501 bp, Oryza sativa
caagcagtgaaggaaaatctcatggaaaatacttggaatgttgcatatagttgtgaacttagtttctgaaagttcctaaaatgtagggcaattttagtttcaaaaagttgtttgttaattcgtctatccaacttagctaggctgagctcacttctgcatgggtgttcaacctccatcttacgcatcatcatcgttatcatcccttgcaaatcccaaggtccttaaacaattcaataacgtacctagtaagagctcttgatcatccatgaggcataaactatgtttgttaatttaggtagtcaactatatttaaattcaagagcaccaaaatatatatgagcctcttgtagagcagcttaaaagttaaaattacaatagctctgttgcagtaaaactaccgtagttcgtattgaattcagccagattaaggagagaagcctgtcactctctgtcagaaattcaagctgagagttagcactccataagaagagtggttttggggattggaaaaccacattaatttcaaattggcggtgttaattgcgatcagattataaaacgagacctaggcaagaaaacaaggcaacaagaagccgatcaacttgaccatgcattcacaggttgctgtcatgacaagccagtattatactctctgccaggaaaacttgagcattgtctcttgccggccgatcccgaggggagcaaacaacaaaggtagatccaaactatgcacattatataaaactaaaacttttttttaaaaaaattctttgctacaagaacaagctctcttctcaggtccacgcggcttagctatctataggccccatcgtaccctagtaaactaaagccaaaaccaaaatttaaattttcgtacttaattttgaagttgattttaggatattttttatttagtttttttaacattggcttttaagtcgctaagaacacatatataaaaattttacctataaattatatgtgtagctgtactagctagagtgtatctatggtgcatagttactagcttctagattaatctttcctaacagttagctactgtatatatatagcatcctgtacactcaagtcatccctgacacacacacagacaaagacaggttcaattctctctgaaagctaagggaaaaatagctacactaacatggtgaaaattttggtaggataaatagaagaccagctccctcttcttcctctagctagctgtcactcataccaagttcagccagagaaagagcaagaaacacaagagaagttcagtctctgaatgtgtgttgccaattgctgaaactctgcatgtgcatatgcaaacttgaatcagttagctaactgcatgacatccatgtcgaccggtgttgaaagggattggattgcaccgtgatcttatcttctctgagcaacaagaagaggtggaagaagcaattgatggaggagtttgagctgcagcagcagccgtattacagcaagctgctcctgggta

SEQ ID NO: 11922 - DNA, 1501 bp, Oryza sativa
tttccctatcaattattgcagtcacaagatcgatcgtcaggtagggcaacacaagaccaaaattcattcaatttatgatccacgcaagaattcagacgaactgaagaagtaatactagatgtttgcatctgcatgcagatggtcttaacatacatgaacaattaactaagtggagaacatatatatgcacctggtgtccctggaaggcttctcttcttcttcttcttcacggccgtcggcggcgcaggcggcggatccgagggaactccggcgacaagctgcagatcactgtcgtcgacattggcgatctccagcgggctacccaggagcagcttgctgtaatacggctgctgctgcagctcaaactcctccatcaattgcttcttccacctcttcttgttgctcagagaagataagatcacggtgcaatccaatccctttcaacaccggtcgacatggatgtcatgcagttagctaactgattcaagtttgcatatgcacatgcagagtttcagcaattggcaacacacattcagagactgaacttctcttgtgtttcttgctctttctctggctgaacttggtatgagtgacagctagctagaggaagaagagggagctggtcttctatttatcctaccaaaattttcaccatgttagtgtagctatttttcccttagctttcagagagaattgaacctgtctttgtctgtgtgtgtgtcagggatgacttgagtgtacaggatgctatatatatacagtagctaactgttaggaaagattaatctagaagctagtaactatgcaccatagatacactctagctagtacagctacacatataatttataggtaaaatttttatatatgtgttcttagcgacttaaaagccaatgttaaaaaaactaaataaaaaatatcctaaaatcaacttcaaaattaagtacgaaaatttaaattttggttttggctttagtttactagggtacgatggggcctatagatagctaagccgcgtggacctgagaagagagcttgttcttgtagcaaagaatttttttaaaaaaaagttttagttttatataatgtgcatagtttggatctacctttgttgtttgctcccctcgggatcggccggcaagagacaatgctcaagttttcctggcagagagtataatactggcttgtcatgacagcaacctgtgaatgcatggtcaagttgatcggcttcttgttgccttgttttcttgcctaggtctcgttttataatctgatcgcaattaacaccgccaatttgaaattaatgtggttttccaatccccaaaaccactcttcttatggagtgctaactctcagcttgaatttctgacagagagtgacaggcttctctccttaatctggctgaattcaatacgaactacggtagttttactgcaacagagctattgtaattttaacttttaagctgctctacaagaggctcatatatattttggtgctc

SEQ ID NO: 11923 - DNA, 1501 bp, Oryza sativa
acattataatatgtttaaatataattttgtttttttaaaaattgtactgtttataaactcgggaaatgcacatgctaatgttattgcaaaattcacagcgctccattccattctcctaaaacaaaacacgaatattaggaaatgatttaatatcaaataattataaggataaggcttcgaacccagaccaactagcccatcttcttgtggaactagccggaagacttctaaacgtttctgaattttaaaatgaggataataaggcaaattgatctatatatagagtagcaaatataaaaaaaaaatgcacaactagctaagagcagatgcgcgaaccaaattaaacactaatatttgctggacaatctataaattattttacaacacatttgagcttaattaatcgactctatcggataattagttgcctgcaatttgagctgaactttatcataccgtacagtaatgtatactaaattaacctagagatgccgataaggtttggatccgccctaattgcttgtttttaccattttaacaggacgaataatgccctctgggggtagacatatcatgaagcacatttttcatttttggatgacattggaccaaaatccttttgtttaatatcccactttatattttctacgtgtccgcataacagaaccaggaatttccacgtcaatgccggaataaatcggcagggttagtgttaagcaatgaatttcaaacgccaagcatccactcaaagaataaacgaatcctctggtaccctttacatgtcgggagaatatataagcctactaaaggagtagtaattaattaattaagcaggttgtaaccgccctatctgcctttctaattatcttccactaattaatcaggtactgtgtgatgatcgtgttgaattgacccttgttaaatttatgcaggtaaacaaatgattgatattattcgatctctacttctaaatgaagaaattaaagagaagaattttggttattccatatttcagaagggactactattgatctttcaacaggtttgaagtttcaaatcttacagaattttcaacaatgtatacaaccctttttgaatgaaataaaaaaaagaataaacatgtaaaaaatcgtaaacttaataaaaatctaattttggtgcactgtaacagtgtaactaagtataaatataaatcaaatctaaagaacacaaatcttgatgcaaagattccacggacgaaaaatcaaaaaatagaagtccaaaaatctgttgcaagtgaaatagcaaaaccgtttaggatagctcatctttttcttgggcctgattatcatgggcctttggtccagttccatgtatgggctagtattcgtgctacctatatgggccaggcttatggctaccaatgcggcccatgtacgatgacgtgtaccctattgtcttctactagctctctccccctctactaccttccttactctgcccgtgaagagagagagagaga

SEQ ID NO: 11924 - DNA, 1501 bp, Oryza sativa
gataaggatgtcgacataccacacaaatttatctcctcgctaatctttattctgtttttaattatgtaattatctaaaatcagaataatttaggtctcgttcttttctccaacaagtgttgatgaagattaaaattttcgtggcacgctttttaaattgctaaacggtgcgtttcaagcaaaaactttttatataaaagtttctctaaaatatcatattaatgtatttttcaagtttgttataattaaaactcaatcaatcatacattaataccacctcgttttgcataaaaaaacttaatcttcatcttcatcttacggagaaaacggagaaaagaagatgataaaaaagtatgaaaaaccggaaaataaaaaaaacgaaggaaggaaaaaacaattgtttgatataaaaaatatcgattgtgaaaaaaattgcgcaaaatcatcatatgttacgtgaccggtctccacgcgagtccacatatgatcttggaaactaagacgcatgcttgcaacacgagagttgacaaagcgagaaaacacgcgtgaccactacgaggctataaataaatacccaaaagtatttttatccatcctgattattcatcggtattacgataaaaatgataaaaatacctattttaaataattttttttgttaatcacaacaccaggtacatcgtcaagttcaacttcatcaactgcgatattacccggtgtaacgcacgggtattttcctagtaaaataaaaatcatgatgtaccaccaagcaatgtccggccctgttcttgcgcttggtttttaaacctattgcgtgcacgaatctcaaaccggatacgacgactcgaaactttccccttcaattttcctgcgacggtagaatatcaattccgttggtccaaacgagtactgtgacacctcaaaaacagaatgaaacaaaacaacaacccaccgtaagacgctccgtgcccaaacgaactcaacgagaatcccagaatccagcggaaagcaaccccgtccgcgcgctacgccaccgcctctgccagccgacggccgttcggccctccgcgcacgcgtccaccgaccctggcgccgcccgtgcgcgcacaaaggatatgccccgatggcccatggccccgccgactcgcacccgaccgcacgcccaaaacgtgtgcgtccacgcggccagagcatcacaaaaaacccccacgggattcccaacccaccgttccattctctcgagctcaccccgtcatccacctcacccgcgccgtccccacccccaagcgaaatctttataaattccgtttcccacgcgtagccgcagcgaaccaagcccaacaacacacggcgccgcccacccatccacacacccaccggcacacgcaacgccatcatcgtcgctcgtagcagcagtagcgtaccacacttcgcaccgcgatcgtccgtgtttgtgtcgtccacgggaagggaccgagaggcttggaggaaaggaggggaga

SEQ ID NO: 11925 - DNA, 1501 bp, Oryza sativa
gtagagatcgaataatatcaatcatttgtttacctgcataaatttaacaagggtcaattcaacacgatcatcacacagtacctgattaattagtggaagataattagaaaggcagatagggcggttacaacctgcttaattaattaattactactcctttagtaggcttatatattctcccgacatgtaaagggtaccagaggattcgtttattctttgagtggatgcttggcgtttgaaattcattgcttaacactaaccctgccgatttattccggcattgacgtggaaattcctggttctgttatgcggacacgtagaaaatataaagtgggatattaaacaaaaggattttggtccaatgtcatccaaaaatgaaaaatgtgcttcatgatatgtctacccccagagggcattattcgtcctgttaaaatggtaaaaacaagcaattagggcggatccaaaccttatcggcatctctaggttaatttagtatacattactgtacggtatgataaagttcagctcaaattgcaggcaactaattatccgatagagtcgattaattaagctcaaatgtgttgtaaaataatttatagattgtccagcaaatattagtgtttaatttggttcgcgcatctgctcttagctagttgtgcattttttttttatatttgctactctatatatagatcaatttgccttattatcctcattttaaaattcagaaacgtttagaagtcttccggctagttccacaagaagatgggctagttggtctgggttcgaagccttatccttataattatttgatattaaatcatttcctaatattcgtgttttgttttaggagaatggaatggagcgctgtgaattttgcaataacattagcatgtgcatttcccgagtttataaacagtacaatttttaaaaaaacaaaattatatttaaacatattataatgttgttttaaatccacttttaactttttataatagctaatttatttatctgtaccatcgaataattatcacaaagtcatccatctattcagcatttcattctattcatcacaaaaacataaatatatattttgatcatagtaaaacctcaatttgcatggcatacccccatttcaatcaaataaataattcaacttttataatgctgtcccctccggccaaaagcaaagctagagaaaaaaatccaagtactaaacctctaataagcgcacaacattcccaatcagtgccagaggctgtttattagagtttcaacttctaaatttagcttcagtagttagatctatagtagagttgtggagcggcctaaacccaactccaactctctagttcagtttgtgagagagccccatccaactccactcttattttagatggagataaaactgtttagctggagaggtggagctgaagttaaagctgtgccaacgagcccttaattagttattatctcttcttcttccttggttcagtttccc

SEQ ID NO: 11926 - DNA, 1501 bp, Oryza sativa
tagtctttacaagacatcaatttgggaaggatctaacaggcctacagtacgtgtgaagatgcaggatcaccacacacgatccagaattattattccagatggacaacggcttgttggaatgtggtggaggaagagccagcagcaaaggccgcggaatcacttccaacttttgggttgcaactgcaaggaggggattcgttccaatctcaaacagtgaaccagatagagaaagagagagagagcttaccaacaccaggagaggcgccgccgctgcacttccgcctgtaccgagccgacccgagccgcgggacacaggggcgcatggtgctcgactcgatccatcgatccggccgccgccgctcgaacggacgccgcctccagcccccttcaccacctcgccgccggtggcttcgctccgccccccgtggctggactcacgggatcgtctgcgccgccgctgccctgaagccaccacagcccatcaagctttcgagctgggccttcggctcacacgcagcctagtccaagcaaacatatgctgctctaaggcccaaagagttgtagcccaagcagcccaaaattatgtcgctcgagctatcaacagtactacacactaatataagggtgcaagtggggaagccgcttatagacaaaattagtgcataaaccgcaggtttgactcacatgttatatatattaacttgatctataaatatgtttataaatcgacccacttgcatatctagatgcggcaagttaggccacgacacaaaaacccatgaattatcatttatttgacctaggagtgaattcgcgagtcggcccgcttgcatccctacactaatatgctcccatggtgattacagacaagatgtcctgactcttagcatgccactcaaatggttaaaaaaaattaaaaaaaaaaagatgtattaacatatgatgtatcatttcacaaatattcaagttgaaatacaatttatataagttgcacaaaaaataaattaaactacagctagttaacgtatatttatagtcaaatttatttttttttattttatggttaaatttcgccttgcatgtttgtggattgatctatcacatattaagttatcttattgttttttaaaaaaatttataaccatttgagtgacatgcaaaacctaatttttagagtttaaaatagttttcctttacagtacaggcgaggcgagacggactgacgatcgaagccgtggttttgctacgccgatggtgctaattaactggtcacgactcacgaggataaccgtgtacctgtggtcaactgaaccagccagcccgaagtttacacacgaatcaaagcggagatcctaggttcctagtgttgatcatctactgtttgcagctgggttttggtttgatccatggttttgttatgttcagtccaccttgagatacatctcatcaaattagcacgacatttactacgtgtataggtcaacgcttaaccctgctaaat

SEQ ID NO: 11927 - DNA, 1501 bp, Oryza sativa
aattgcaataattattcttctctttagcagctaccccttcatagattcaattttaaatttcaaaagacccacaaactcatctatgatcctgatcggagagttttaagattctgataagctagctggtaaaaatccgaagaaactgagagtatctgattgaaaatctatactgtttggggagcttctactagctaatctctagctgccagtagctcccaaagcataccctacatctgcattccctcgtgatctcagatttgctcgagatatgcaaaaacaccctaaaaagatggcctaattacgaattgggaggggtaaaatggcataatggtaattaataatgatagtgatagtagtacgacgccatctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccggtacgcgccccccgcctccggccgctctgctccctccccccctcattgccctgtctctctgctctccttcacgcgcgctctctctctctgtgctggtgcggattgcgctttgggggggggggggggggggcggaggctggatcctaggtttggtaggttaagtggattacgagggatgattttgggggtgggattttgtggatttgagttatgtttcggatgggatcaagggtttcattgcgaggaatttcacccgcgattttttttaaaaaaaatcggcgttcgatggcgagggtttcgcttggaggaatcggtcgtcattgggtttgtttgtttgtttcgcttggtgaaatccttaggtcttcattttgttctggtcgtgtagagtggtttgatcgtgtaggtggtccagggattcgattatgatttcaaaaattgattcagaggggacgtacgatcacacctgctaagcagatagatttatcattcgtaatggaagatccccattggccactttgcggtagtccacatactactatagtcacatgatacaaaagcctgcaattcattgtaaatggaaaggactgtaacttgtcgggatgaagttatcgaattaaattgtagttttctttggttagatttattcgcagatataagttactatattaccatctgttatcggtaaattcagaaacatcagtatacacttaatgcctgtccctttccttaatgctatatactaaacggtaactctgcttgagtttgtgaacgtacaagtgttgataattttgattagtcatatgatgcttgcaagttttattaatatcagcctgttatatgtaaaccttagtacttgcatattcatggtattggtacgttctctttgatcatttttttggttatttgatgattgatcattatggtacttaagagtaactagcatgaaaattcatacttccaaggaaacatttcctgatggtag

SEQ ID NO: 11928 - DNA, 1501 bp, Oryza sativa
acggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctcacctgaaactgatgaagatgacacaaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaaacctgcaagatcctactcatttctgagcccctccatcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaaga

SEQ ID NO: 11929 - DNA, 569 bp, Oryza sativa
caattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcagg

SEQ ID NO: 11930 - DNA, 1501 bp, Oryza sativa
cattgctgcaacatatttatgtaccattcagtaccacagaaaagggtcaatactatatgacaggacaagagcattacttccattaaatgatttaaatgttgatgacatgataaacttaaagtctttgcactgttgcacgtagctctcagctgaacactagaacaggaaatactactgaaacgcgaaattattacctagaccaattccgtttgacagggtgcaccgcacgcaagaaacaggtctatgaaataattcctttcgggatccacgtaaactctgatcgatcatgaatgatggtaattaaattaaagctacgacggcgacggtgacgacgaagaagaactaaacgcaagaactgagcccccggctgttgcaccagctagctagcctcgccgatcggatcaccggcgttggcgcgggcggcgctggtcgtcgtcgttgaagtcgagcagcacggcgctgtggcaccgggggcaccggggatcctcccgggacagcatcacgtacatcatgcaccgggggcacccagccagcaccatgggcggccccgcgccgccgcccgccgcgtccgggctgccctccgacgacacgcacgagctcggcggcgacgcggtggacgacgacgaggacgacagcctgcgcggcgacgtgttcgcgccgttgacgccgccgctgtcgccgcccgggcgcacagtcgccgacggcccgccgccgccgccgccacgcgccctcgacaggctcatcagcctcaggcactccagcttggaactcttgccgttgttcctgctcatcctcgccgcctccaccaacaccacctccgatcactgcactcagctacgccaacaacattagcgagacagcacaagttcacaacacacacgacctagctaagctagccactatccaacaatatgacctagctagctagtgacacattgcactaaacttgttctgaagaaaaattcagtcacattgcactagaccaaatgcattacctcggattctaatatagggagcagttcgacgtgttggtggattggagctctccacttggttgcatatagcttttgctaggtaggagtatttgtcatgcaccactcctgttgttatataatggggaggggttgaggaggaggtgggttttcttaaaggcaagaacagccacatttaaacgctggtcaattccctccaagcctctggagtctggacgctgtcccgccatacttgtattttccattaatattgtagcttttctggagggtggaaaaatattggagtatatttattaattaattggtggatagacgtgacaaggagcaggtgtttctgtagatcgaaagggaagcacttgtacgggggtatgttaatgagctagctggaggttccttaatgcatggcctctgtaacaacatgaagtactaccattcatgtaacaagatgatcgtaaaatctatcatgtaatatacatgagcggggtattagtgtagaagtactccctccg

SEQ ID NO: 11931 - DNA, 1501 bp, Oryza sativa
cagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccaatcatctccaaaaccacttcgccaataatctccaaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacctaaaagctttgaactttagaaaaggaccagacaaacccaagtacgaataacattttcctgaaagcactaaagcactcccactaatatgattatctgaatcggatttaagataacttaataaaattagtagtactatcacattaattttaaggtttggaggttgcttcagggtgagatcaaccgcatttctaacttgtaacatgacgagctacgtaatggaagtggttgtgtgatcgactaacgacagaggccaaactaaggcacataattttataattatctagaaaacctacaggatgatattagaggtttcttcctagcacgacttcttgtagctagaacttagggtaattttctcattcttaaaaaggtatcaggaggtgtcatattttctatgataaaatttggtacctttagatactacatcctccgtttcaggttataaaactttttagcattgcccatattcatatagatgttaataagtctaggcaacatctatatgaatgtggacaatactaaaaggtcttataacctgaaacggaggtagtaagtatcttaaggtatcaaaaattttttagtgtaaaatttagataactcaaaatgctttgtcaaaaaccataaaatttctct

SEQ ID NO: 11932 - DNA, 1501 bp, Oryza sativa
ctcctcaattatccactcctcgatggttcggctcacggctcagtttttaaaaggtgttaaaaacgacacctttaatttattataggtgttgttttttttttgaaaaagcgacaccaatagtataggtgttggttttttacagaactggcacctataatcacttaagggtgtcgttgtttgtgttttcattacatggaggtaggaaaaggtctataggtgtcgattttagcacttccgatacctatagtgccgacttgtattggttgttttgtggtagtgatggtttctgcaatgtgtagaaaacaattcagcacctattctttgattgccacatggctcgttttgcatgatggtgtctagatgatatcccgcgtttatgggagttttgtataatattagtacaaataacatgtaaaatatctacattttgtataattttcatctatgcccgactattgaaaaaaaaggtatatataaaacatatgataatgtggtttataacaatttaaatcatatatgaattaatcatgtaaaaggaaaactaagataatgtgactcaatgagagaagaaaaagaaattaacaaggtaatataaactaatcataaaaaaataaaactatggtggtatgattttatattagaagaaaagggagggagataatttagaccatagatcaaccatccaatagttagaaacagttgaggtgatttgacttaatgagagaatagagaaatatcattaactatacttagtggagatgatcactttatagatatataggatatccctcctcctcgaaccaccagaaatatttttggtaactggcaccgaggagtccctagctagacgagttactccgaggagtgtctagctagacgcttgaaaatggttttattcagggttagtgtacttcgttggtcaattttgatgttaatgaaatgataaagtttttaataacaaaaagttgtttaattccacgcaggttatcttcatgtcattaagctagcttcaatattagtgttgatgttatggtggaaggagcattatattacgcgcaatagtgttactttcttagagttgatagtcaagtatctttgtatttgtattctactatgagtgacgtaatatgttagaatgtatatggttttttaagtttattatcaattaattttgtttgttatggtagttagggtttggcctttcaactactgtctaattttgtttgttatggtagtaagggtttggcctttcaactactatctttttagctaaaaagcttattgattgtacgtagtataacaaaggccgaggatgcaatatatttccattaccttaaattgagctaatatattagcatcattccaaattatagggcgtcatcttttgaaggataatcaaactcgataacgttaaaatgattgtaataattatttttatgttaagtattatatatgtatatcattagatttatatttttaagtatttttatatgatactgat

SEQ ID NO: 11933 - DNA, 1501 bp, Oryza sativa
cgagtatctctattggatgtgattttcttaaatttggaacataaataaatattcttgtttgtaatgaagaatattttaatgaaaacaattaattcaacatgatcacggtagatttgtactccctctgttttatgatataagtcattctagcatttctcacattcatattaatgtcaatgaatttagacatatatatctatctagattcattaacatcaatatgaatgtggaaaatattaaaatgacttacatggtgaaacggaggaagtagatgttttcgtaaactttattttcctgtgataaacttaatctgcatatattatatatgcatggggtattattatatgataataagcgaaacataactcaattttgtttttgaaattatgattttaatatctctagcatacatgataaggtagataataatttgattagttactaccgtcaaacctggtgggacaaattcgttgtgctgtaagtgtcacgttgagtttttttttcaagggaatacgcctctacgtgctgttttttttttctgacagcccttcctttttcttttattcgtgacagtcccccacagcaatacgcatccagatgcctccgttcccctcgtgtttgttcaggtttaggatgctttgtttttttttttttagggatcaggatgctttgtttggaagccaggccacgttcagaacttttttacttctgtgaccaggaccgattctatatccaacggttgcttttgttaccgttgctctatctgacggctatgattcgtcctaagatttatctcatgattctctcacttggagagagattggggtaacttttagtcctttaaagtggatataatagtgtttttctcgagctattcttgtaaataataaatagaatagcacaaatttgtgacagctagcagaggtccttcgacgtgcatcgccaaaggtgctaggtggtgtacactcatgatacacgatggtgtaactttatttgccattagtttacgggcaagtttaatagtacttagtataaaaaactattagccataaaattcaacacatcatttataggtaatttaatagtctatttatataataaatatatcatcaattaatacttgacacacctctgtaacacatacttcttccggtttttaaaatatggcgccgttctttttttatgcatattttaccattcgtcttatttaaaaattttatataaatatatgaaaatgtaattcatgtttaaaatatcttagtggataaacaagtcccaacaaaaataaataataacaatatttttctactaagacaaatagttaaatatggggttacaaatctattaaaaacttgttgaaacccgtacaactactctgcaacgtacatactacaaatttgtaatctattttttttctttttcttattatttaagcacaaatttgatagggacaactctggtatactctgggaaaaagataaaacaacttatgtagtataaa

SEQ ID NO: 11934 - DNA, 1501 bp, Oryza sativa
ccaccctctccacccgatgcggcggtcggcgccgcgctgctgctgctgatgcgggcggtggtgaagaggcgacgagggggagagcgcgggcgctgctgcggctattggagatccggggcttcgtggtaagcaagctctgctccccacccccgcccgctccctactgattcccgcctgatcccgccgggattccgctagattgctctgccccccgcgcgcgccagcggcgagctcggctttgctgtgctgtgctgcggccgccgccgccgctattggctgcgcgacgcgtgggggagaaatgggcttaggcttttaagcgtgctgtttaggcttttgactgctctgtggctgtgcttatggtagaagccgccgttaaaaggtggctcgattttttgttttttctccctttctttttgtgtcagggatcgtgcggggctaggctgggctcgagcaaggtcacgagtgagttagtacggggatggtgatcttgtcatgatacaatgcggtgtggctgtttcttttttttttttggtgagagtttggtagagagatgacaaatcgtggcttagttttcaaattctttgtgattttgtttcccaatgcggcccccaagtagctcactatgtttgcaaagcacatggaataccattttattgaaccattttgtttttttgttcgtggggcattaggttggaagtttaatgctggatatttatgcacattttgttgctctgatcaaaggttttagttggctctgttgtaagcttaagagggaattagtgatttagtgtggctcatgtaccttgagtagaaatggtcgaatgccatggatcattgtagtatatatatacatctacgccactgtgctatacgcttgtatttttgtacaaattaacttctaattctttaggaatgtgaatttgtccaattcgagggtttcttcttgtttattataaccgtgcatttgtaagtgaccaacgtgtcttcgtgatgtaccagtccaactttcaaatacttccaaaaagtttaattggtgaatacatgtgggttcctcatagtttttacctatgtcaagtatcatgctcagcacttgttcatggtttatttctaccccagttttacgttatagtttatatagaaatgtcacactgtcactttctggaacattcaatcagtattcatgatatatacaacatactttacaatactttctggaagtagaatttgcttgaacacgttagatccttctagtttcctcctacgtccaatgaagtgaggtactttacttgtgtttatgatatacttttctatcgacttgcaaaaactttctaaaagttgagtttcttaataaccttaatgtcttttgatgcgctgtacgcgtgccatatgctatgcttttacaccaacttccaagttttccctaaaagctgttcttctatttaagcgattagtggggtcgtgtgaccccacgggacccaaagtggatccatttcgacgggga

SEQ ID NO: 11935 - DNA, 594 bp, Oryza sativa
accctcactcccgaacagagccttatgtatttaccaaatttaaaaacaaactaagcattgacattttttttgacaactttacccaaaaagtatggttgaaatagcatcaaagtaaacaggccctaaggacttcgactcagctcggctgtttcccaaatcgttttgaatggggttaccgtcaccccatgatttggacggttatcatgataaccgtataattactgtaagatataccgtggttttaaaaattgagaaggttaccgcaggcgatattcgtatgattttataaaaccatgatccaaccactgaccactgtgtagtagtagcacactgcttgtgtagctgtagcttgggtggcacggggatttgaggggagagacttagtctattgttgtattagtagtgtttttgtttgcatggaggagtaactaattggttgatcggttattagttagtagttaattaaggaagtgtcaaagtcttaaaactcttgttagtgcactccacaggtcaggtctccaaaattgcttgccgctttcctagaattttcttctgggtggtggctgtggttagtggtgtgtggatatggagcca

SEQ ID NO: 11936 - DNA, 1501 bp, Oryza sativa; identical to SEQ ID NO: 11928

SEQ ID NO: 11937 - DNA, 1501 bp, Oryza sativa
cagtaacatgtatacaaagtacaacagtatctataaataaaaaaaataaagaagttgtatattaaatccattagaacttctaatatctatggcatatatatacatatgaaaataggagctaataagttgttgtttaacaaatcccatttaactagcccgtgcaatattacatcagtactcccgtagttccttagaatgcgacggtggatctgtagtacactctctacagatataagcacttttaaagttatactacaatcaaacatttttagttttggggaaaaaatagttgatgatgtaagaacgattcgtgttactgtatttattgtgaaactaaatatcgcagtttataaatgtcttttaaaatagtttaaatttatatatttactggccaaagtaagatattacaaattgtgttgatgttcagtatttatataaatatcgcagtttatatgagctctctctctcggatggtgctcgtgcacagcacgtgcgggaagggagagaggaagcgggctgagagggaaatgggccaaggggagaagaaatcggcccacgaacccgagggaggcaaaatagacttttgcgggaggatctgatttggaagatgatttgaattggaaaccgaattcgacgatagattgggaaatgaagatcgggaaaggcacggatacttgacaacaatcaaagaaacatatttcgcaattaggttttttaagatttaattttcccactaggcgccacgatggaacgggcgctacaatattggaatctaatttgatgcacaaatttgcacatattataggaattctagtgaaggatgtttgcttgagttttggtatatttcatatgaggtttgagtcttgaattaaatttagatgttctttggattaatttggttcattttcaaaggggagggattaatgagattttgtggtttttgaaatgtatttgagtagatttaagaaaaggtgacagatgagagggaaatagaagaatttcaaggaacttttggaatggttcgctatttagaattatttgaataaatttggaaaaagacatgaaatggagagatattagaatttaatttattattggaaaatcttgacaacctacatggttgcaaaggagatttcctgatttcagtgaattttgatatatcggaaatttgaaagaatttgtggagaagggtttaagataggatttgaatttgacatcgagattttattttagggaggactttagagtgagattttcgggctacaacgattgttttgatttgagctcttgaaactagtgttgatgtttgatgtcgcgattctggtatttgcatagtatggagatcgttggtattaggatatatgcgagattgtagtaaaagagataggatgaggatttttatacaggttcgggcccctgaattgtcaggtaataaccctactcctgttggccgaagtcggtcgttgctcttattcactataatcacaccagtacaatattt

SEQ ID NO: 11938 - DNA, 1501 bp, Oryza sativa
atctgacggctattatttactcagaagtctcagtgacgtgattcgtcctaagattatctcatgattctctttgcacttgagagatattggggtaacttttagcgaaaacactaattagcgaccaatcgcgcgcgcccttccgcacgtgactggacacgtgtcgcgcacggaaaggagcggcggatcgcgcgtgtacgtacagttttcctttttttttttctgttttcttctgcggacggagcgcgtgtacggtttccttttttttcgttttttctgttgtcttccgtattttcggtttcttttttccttttttttcttttttatcttttccaggttttaatacatgcgtatgcaaactttatatacgtgtatttttttttagatttttttacgtatgtatacaaagtttatatacgcgtatacaaactttgtatatgttttttgttttttcttggctttcggttttttaaatatctatgtatttatatatacaaagtttgtatacacgtacacaaagtttgtatacaacagtgtaacagtagtagcaacagtgtagtagtactactagtagtagtatagtagtagcagtagaggtagcagatagtttactgtagcaccatattgtcaaatcataaactaattaggtttaaaaagtttgtctcgcaatttacacgcaaactgtacaattagttttttttgtctatgtttaatactatacacgggaactaaactaggcctaaaagttttttacctaaaaagacagtagttgaaaggcctaactaccgtagcaaacaaaattgacagataaacttaaaaaaacccgtatagaatctaacaaattacgccactcatatagtagaataaaaagatccttgactaccaactctaagaaaggtaacactattgtgcgtaatatcatgctccttctaccataacatcatacatcaatattgaagctagatgaaagatatgaagataacctatgtgagattaaacaacttttttttattgaaaaccttatcatttcagtaatgtcaaaattgacaaacaaagtacactaaccctgaataaaacctttttcaagcgtctaggcactcctcagagcccgttatcaaaaaaatttctggtgcttcgagaaggagtgatatcctatatatcgatccctactaagcatagttaatgctatttcttttttctctaaattaagtctaatcaccttaattgtttttatcccttggatggttgatttaggtctaaattatctccccctttttcttttgttataaaatcatatcaccttagttttgtttttatgattaatttgtattaccttgtttcttttccttttaaacgatcaattcatatgtgatttaaattgttataaaatacatcatcaaatggtttatatatagtttttttttcaatagtcgatcagagataaaaattatacaaagtgtatagatattttttcaatagtcgatcaaagtcctaaccacatata

SEQ ID NO: 11939 - DNA, 1501 bp, Oryza sativa
tccctccctcaccaactaacctcgaggacggtggcgggcagaactcgaggtgacgaagggggcggcagagctcagaacgatggcagtcggagtgggcggcggcgaagagggcgtgtgcagccaccggcgctcgggacagcggtgaggttggagtgggcggcagcgtagcggatgcgatagcacatgcagagctccaacccatttgtcatcgcgctgtccagccccacccatgacaccctcttccctggcggcgaaggtacggcagtggaggcgagctcttcattaacggccagatccagccaatgtggctcccgccacttgacgacgtcggtggtagcggcgagccgatgcgggagcacgaggcggggatgggaaacgagcgcggtggacgcttccctactccgcacatggctgtctccgccgccacaccttcatcttcgaccgcgccgtcaccaccctcgccgccggtcgcgccgccagtcacgccgctctcacttccgtctccatgccaagcgcgctcgccgccctcaccgctctcgcctccgcctccatgctgggcgtactcaccgccctcgccgaggtcgcaccgctcttgcttccgccttcatgccaggcgcgcttgccaacctcttcgccggtcatgccgccagtcacgccgctctcgcctccacctccatgcttcgcgctctcgcgccctacctacatggtgagcgtgagcgtgtgcgggagagcgtgccggccgcttctgccacgtggttcagaaggggagggagaagagagaggggggggtgaggatctgacaagtaggccctagctttgttaaaaaatgtttgttgactgcactaccacatatgctattcgaaccctaaaccgctctcaatagtactggggggtttgtctggtttttgagtttaaggggtaattcagtcgactgttgtagtttaggggataattcgtacttttccctttagaatttactcagattttgagaatctaaagttgtggaatccagaaaataaactaaaagtcagaaactggaaaagccaacttttccagattttcacctgctagattctctccgtctgcttctcagaatcttaaactcgcccaaacatgacctaaatatcatgccacaatgacaaaagtgacgcaatattagatatcacctctctccggtaatatttgtgtaattggctaattggagaatcgaagagtggcagcttaattataagagtgttaacttacatgagtggcaaatagtcaaatgtcccaaaacttttgcggtatttttcggtggaactcctacaaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatga

SEQ ID NO: 11940 - DNA, 1501 bp, Oryza sativa
tggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgaccacaccacctgagccaacctaggtagttgtcaaccaaaagaaaaccgattcatatcaattcttccatcagttcacccccagattcaaaccaaatcaattctagtatctgtaacaacaataatcccaaagtgcaaccactactacacatgccatgaatcataaccctaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactgaagtggacctagaaggctacgttgaagctcccgaaggccacatttcacgaggcaagccatagttccaatctttgatcatattgaaaccttgtagagaaccacttagttattttctgcattgagtatttataaaattattttgcatatgaattatttttgaataaacttgttagtttagttattacccattattacattgttattattggccaaatccatgaattgctatatcacgtcctttgataacctaggtgtagatttatatacttcacaataatattctagtggataagactaccaaatatctatactcatatacatggtttacccgtcgtcacgtggtggcgtgtcgggtgatataaaatgtgttatttgatatgagtcactcgcctggagtgatatggaagattaattccgggtgaagatggatgttgtggtgtgtgaggccgtgcatattgttataattattttgtggaaagtgtatatttacacttgaagtatgcacgggcctgtgctagttttggtggctttcccggatataaggactacccccttatgccatggaaaatgatgtaatttgcgcctatccataggactgagtaatcagacttagcctagtacattgtcccactatatgaaagactgtagggtggctctatgagcaggtttggggtggacatgtggaaggggctttggccaggttgacatgatccacaacggtggaacccgtgaaagcagcgaccgtctagccttgcttaggcctagcaagtgcccgactgctaggacggatcaatatcccactgggcagtaactagtagtaagtgggattctcaaacggctatgttgtcctcagcctagctagctgttgacatcaggtgggtaaagctgggcagtctctacagagatgagtcttaaatcattcgaatgtgccgtgcttccggttaagaagctatgtcattgggtgattcctatttatcatggtatgagtaga

SEQ ID NO: 11941 - DNA, 1501 bp, Oryza sativa
accactgcaccgacaccccctgccagccagccttcgtgtgccgaagaccgcgccacacccactggcagctcctcctcgcaccgtggtcgccacctttaccgtcggccgcgcctcatcacgccacgccggcctcctccaccaccggacgcgcctctcgcgccagtccggcctccctccatcggttgcgcctctcgcgccaagccggcctcctcgccactgaccacgcctctcgcgccttgccggccactactgccatcggctgtgcctctctgcgccaagccggcctccgacccctccaatcgctgccgtgcagccaggtgcggccgtctgccacgccctcggctagccgtctgagaccgccatgcctcctccaatcacaatcacggtcaccatcaccgcagccgctgctgaccgcagtcacggccagccacctcgccgccatccagccgctgtcgcaacagtcgccacaagctccacgccgatgtcttacgccgcctggccgccagctagccacagccaccgcgcctgccggccaattgccggccaggcacagccgcacgccacagtcacaaccgtcgtgcctccgcgcctactgaggtcgcccgcgcctccgcggctaccacggccgcccgctcctccgccgccgtcgcgcctaccgcgcctccaccactatcaccgtcgcccgcgcctttgctgccgacgccgcgcctcgccaccttcgccggcgtcggcatcgcaccaacgccgcgcccgtgtggccatggccctgatccggcggtggcgacgccggatccagccgcgggagtgccagatccatcggtggcggcgccggatccgccgccacaacgtctcgccgctgcgcagccttcccgacggtccgcgccgccccttcgcgtagagacagccgtgccgccggggataggagcctcgccgccgccatcccggcaggccgcgcggtttccggcaacacgcttcggtggcggcaaggtggggaaggggagtgaagtgtgacggcggccgggggctagggttcgccccggttgcccgcgcgaggacgacagggcgctcgtctaccaaaaatactttttacaaacttataactgaccagcagaaatattgagctatatataccagcaaagcaatcatacattcgcacagcacgagagccacagcaaagaaatcgtaacaccacaagttcgcttgctaaaacaccacaccacagtaggaagctgcagcacatcacagctttgaaatcagctcagcctgaatatccttctgcgactaaacatcaggcccaggaggcacatcgatggcaggcgagcagttgaagagtccatcaggctggacaaccaaaccaatatatatagcttccattttcagatgagttgtaaagtcgtaatgttatctgaagcaattaggacaagaatactatcttttcgcagcaaaaaaccatctaagtaatataaagaacaatggagaaagaaacgaaggccaaagtgat

SEQ ID NO: 11942 - DNA, 1501 bp, Oryza sativa
tttgattgctgaggctgccaataagaaggcgacgcgagcaaaaaaaaaaaaacgaaaacaaaaaggcgcaaaaaagaaggaaaatattttagcccacacccccttgcgtggcccccacacccggccacaccccctgcaaggctgcaactgcaaagctccccacgccacggttccaccacctccacctccaccactccatccatcaccacgtctcgcccctcgtccattcctttttccctccctccctcgcctgcctccacctccacctccacgggcgtcgcatcacaacgcaggcgcacccccagcaacctcctcctccaccaccgcagatcgcgctgcgaatccgcccgcgggcggcggcggcggcgaggacgcgagccccagaggagtacggaggagccttcgatctaataggtgcgcgccgcgtaagccttcgcctggcctggccaagctcttccgcgcgattcgcgtttcgctggggaacgcgacgccgcggcccgcccgcgtgggtaggttcggtttcaccgggcggggcgctcggatctgcatttggcatggggagggatggttggattggattggattggatcgtgcgtgggaatgggatcgcagcgatctgcgcgcgcgggggtgtgtggcacgggagcgtatttagttggttgttttgtttggtggttattttagatgcttggttgaaatctggctgaaaggcaccacgaattccctttacttctggtgtttatcgaggatgcacagcggtttcgacgagatgatcttatatgaggctgatcgtactggagatgtgttcatagcatccgctctgcttaggattaaccagtttagaatacacggtcttatggattctgtgatttctgcggagttagtgcctcacagcaacgccattgcttatatcagatatcttagtggagaactgtgccagcaatcgggtttacctgtgggtgactagtcacacccattttggttcacttggatacttggattacccttaaataattaattagttacagagaatatgggttctcctctttttaacaaagaatttacgttttgtttgctggtcctagcttaatactatgttatccaattcagacaggccgaaagtaaaatttcagctcattgcatgacatggcttattacttcttattttcttacctttgtcaaatgtggttatccttaactgctgggtgtgccatgtgcagttgctatgttaaatcttcagattagtaaaaatcctaaacggtaattgtattagggcctaggtgatggagcttgataaccttgtttgagcagctagtatttcttttaatcttgtagtacacagatatagtgctatacttttacaattacagttttacttactgcatattggagcttcactctttctttttatctacacagaaatatttgtaagagcgcactgacaaaaattaaacagtggattttcatttatattcgtaggggcacgcggaaaaaaaaataa

SEQ ID NO: 11943 - DNA, 1501 bp, Oryza sativa
ggtaccaaggagtacagtggtacaccacaagggtactgatgcgctgtagcactcgtactccttatgacccaaataaaaacaaacatcaccaaacgacgaaattgaacaggcggagaagatgaccatcggacgtggtagggatgcctcaataagagcaagttgaatagtatagcccactactggctctaaatcatctatagccaatataatagccaatttatataatagtttcttactatactattaatacctagtcccacatgtcatacacatattacatcttggagtccgtgctacagctagctatagatctataatctgctgctcttctctcttttcctttcttttttttaaaatatgtttatatctggcctgctatcgtaccggctctgagcagagcggaccaattaaggccacagcacatgagggcacagtggatctgcacgctgcaagcgacaatggagtcctccccagtacacgtggagggaggagagtgaaaggagccaggcttgcctgggccactgtgctgctggttgatggactctttgcctagtgaagcctcttcaattcctccattgatctttctttctgctagatcagcatggtcatggccatgctccaattagagtgctatacactggagtacttgcggaaatgcttcagcaactgggaagttaattaagtgagcatggactcaatggactccactgtggagataaaaaagagtggcgcttacttgcttatactcaatattatcttggagtggagctcatgatcaaccagagtgatctaaatctaatcttgtcgatgcctagcttaaaatgtgggctagaggttggacatggcaaatttgattgacatgctaccggcaagattggggttataaatgggatgggacttggccaccaaatataggtgctgcacaaatgatttatgcaaggcgcagatcaccacttttaatttgtgtgactaaattttaaattcctaaaaattccatgttaatttataattaatatagcttatgtaattacattgtttgggactaatttgatgttagcctagtcgacaactcatcatctaatttgatgtcctaaagcaaattttgtgttgcgttgtcgatcggttcgtctaatgatgattgtaagccgtacaatttactaaaagataatttatgggtcaattttttatgtataagtcattagaaatttaaaagataatgctaaaaaataaagtacaataaaaaaagacataacaacttagagcaagtataataataggttgtaggccggctaaatgctgaggtggagaagagaagagaggagaagcgggctgcaaacttacaaccggcttggacaccagaaccaagaaactctgtgagagagacaagtgggctctgtattaattataaagagctaactattacaaatcggctgtattattagccttgctcttgtaagttgcagggcaaacgatgggggaggcttaaaatttaatggtgtgg

SEQ ID NO: 11944 - DNA, 1501 bp, Oryza sativa
gcactttggacggatggaccaatcactgatcaatcgatcatgtgacttctccggctcaagaggtgacagcaaaacaacatgggcttaacagatttaaatatcaacctaacatgcccttacacccgcagtgagcagtgaagatcttcaactagatttaaccatttataaataagaaagcataagtatagcttaagaaatgctcaaaataaaaaatagttttcaaacaattgtaatagctattttattcaatgttagattaagggttgggaaaagaatatttatagtttaaggttacctaagagatgatttttaaggaggtaaaaaatatcaagctaacaatttttaaagaaaaagtattaactacagcaaaataaaccaattcggagagaaagtactctctccgttttactcagtgtcatattatttcttagtcaaaattctttacattcattcaatcaaatttatagaaaaactagcttacattcattcaatcaaatttatagaaaaaatagctaacatctactctattcttacacacaagattggctttatgggcatcgagaaatgcaaatatgtagattggctttatgggcatcgagaaatgcaaatatgtagaattaattattcttgatctgtagatgaaatatgactataagaaatagatgaagagagtacgtcattctagcattttctctaatattaatgaatataaacatataaatctctttaaattcattaacatcaatactctttaaattcattaacatcaatacaaatgtaatacgaatataaaaaatgctaaaataactcacattaaatcgaagtactacaatttaattttattttatattaaacatattttaatacaatatttgtttttattataaatattactataatttattacaaatcaaatttgaatttttttaaaaagagttctatttaattaactatagctaaatttagatttggtattttgtgggtagggaggcccacacaggcaagtcctgcaaaagtaagcagtgtcaatacccgcgcgagcctcttcccctcgcaaaaattgccgtgcagggtttgagtcccgcaccgcgagcggctctcaccgcaacgctttgttttccttactcattagtttaaggcaagttttttcgttgcacctcacccaccttatatagcaccagccgcaccccgcatctcctccggccagcgaggtgggattattcaccacattccccctctcgttcgttgcgctgtgtcgaccatatatgggccgtggtggcccattgacctgagagggttggagcccagccgtaaaatgtgggccgcactgcgtcggcccataactagatgcgaacatgggctaggcccacttaattcaggtctctgaccttaaaccctccgctcgcctcctccgcgaagcatatacacccccattctcttcctcgcgccgccgccgccgaagcagctgcgaccgccgccgccgcgattcgagccccagcca

SEQ ID NO: 11945 - DNA, 1501 bp, Oryza sativa
aaccagcacatgtttatatatagtcattaatttggtgcatgctgtggttattgcatctcacgagagttattgtcccttgtcgagactttctctatgggctctatatataggctgtgtttagatccaaactttggatccaaacttcagtccttttccatcacatcagcctgtcatacacacaacttttcagtcacatcatccccaatttcaaccaaaatccaaactttgccatcaactaaacacagccatattctagacacacaacgactaggatgtaattctctgccatagaaaaaaggtgatgggcgcatggaacaagcgataagaaggacggagcaacacatcctgtagggattagtggattattgcctggatgagtgaaatatacttgtctgttgtctcctaatttactgacatcactcaactcgaaatggagaacatgttcaaactacaaggcatgtctagtatggatgtactgacaagcaaacaaacaatggctttgatcgtttgtacttgcagccagcaagctgcgtcctgttgctgctacatcaaatcagcttgcatagagctggctggctgcagctgcggtgttgtagccagcacaaacgatcagccccaatgtgtgttgttcttggtgcaggcgcgcgattcgtgcactattcggccggccctctccttgctctatccacgacacatctaggctcgatccatactacaaccttcatcccaagctattgccatggcatctctggtcccagcactaggatcttgctaagtgctcgacattatattgtcatgtgtaccatatctaggagattctaccaaaacacggaggcatttctaatggctatgtttccaacgccttccattcctatacggaacgatgaagctagctagcattatgtttggcttctatctgaactctagcttgcacaacaggcatagcatggcagcaagatagagctcctctttatcacttgtatctctcactattcttttgaatctttttcatcatattagtgaagggtgtgtgtaactagaggagacgaggtaggctttggttcttgatatagttcgtgtgtgtggggttgggggggattgcaccaagccaccaactacagattaattcactagagctagcctactgatgtaaagatgggaaaaatattcagagcacatgagtaagcaggtggtactaatagtaatagagcctgaaatctgaattaggagccagtgttggtcgatatgcatttaattaagtgaagactttgatcttgagatcttttaggtaccattactgattacagattaatagctgtgtcatgccaaaaggattaaacaaaagctctacgaaaaaaaaaagataataaggattgagaagctagtgctgtactactgtccagtacttaattctcagactttcagaaccaacgtgactagtaagccccccgttctggtcaaggcagcttcgtgtatagatagccatatggcccgagtccca

SEQ ID NO: 11946 - DNA, 1501 bp, Oryza sativa
gccggcgaggttgcggcaagggcgcggcgcccagcgaggggacaggcgcggcggcagccagcgattcacgatgccgacgattcattctatttttgatggtgtgtccactatgtgcaatttttgtttttgctaatttgatgaatgtcttgtattttttttctgattggatggagatgctatccaatgcgggggcccggtcgggttgcggggccccggaggggtcggggacgggggttgatttggccctgcatcaacggtcgaggccggggacgggggaggagggtgaagtcgggggtcgggggcaggggcattccagcccaacccaccccgccctgttgccatccctaatctgaaacatatctccaaatatttgagttctacattcatgtattcatattttccttaagattatgattaagatattgtttctaccttgatttctattaacatgttttctaaacatgtaaaacgtaaaacagtgagtttcgtacgaaaactttttatataaaagtcactataaaatattaaataaatttatttttgaaattttatatattttaacttaattaattatacacaaatggttttcttgttttgcaaacttgactcgatcgttagaatcgaacaccaccaaagatcttacgcatggatttgatatattcaatggtcaaaatgcacaatggccgagataagacagaacaactagggcttaagtccagagccctaaatttgtcttcttgatttgtgttagatatctatgaaaaattatagaaaaaaataagatacaaagtgtataagcaattactgcctgtcttgaacatttccttgttctccgtccttgagcacatgttgtttatacaatatagatgtgccctagaacatatcaatgtgattttttttttaaaaaaaagacctagctcgtagcacatcagatatgtatataactagaaataagctactataaatatgatttaagataaaatactgttttcggtggttactttttgcatatagaccagctgttgcgagttataagtgggaggaggggatagaagaaggcctagtttagctcttaaatttttttccccgtaaaaaacgtcacatcgaatatttggacacatgcatggagcattaaatatagatacaataaaaaactgattgcaccgtttgcatgaaaattataagacgaatcttttgagcctaattagtccatgattagccataaatgctacagtaacctatatgtgctaataatgaattaattaggcttaataaatttatctcgaggttttcatatgagttatggaattagttttttcatttgtatccgaaaaccccttcagacatccgatcaaacgtttgatgtgacacccaaaatatttattttcgcgaactcaacaaggccaaattacagttgggcaaatggcatgtgccgttgtgtgcaccagatccttccttcgcgggaaggacactgtacatgcattgcagtattgcaccttgc

SEQ ID NO: 11947 - DNA, 1501 bp, Oryza sativa
tgcattcaagtacattgcatttgcatacagctagttaacgtaagaagcaaattaaacgatatttccgtacaaacttccaacagtgcatagaatgggcggaggatatgatctacaaaaggaaaaaatcaccaccatcgagatatatcgattttactttgaataatagtggaatttcttttttggctaaccgtgaatgtttttcacaatcacaatacattgatgacagctctcaactctgtgagtaatttcattcgtcttgacttgagtgtaatgctaatttccgagcctagccatttacaagattattcggtttgaccacacctctttttcaagcccaataaagatcgactcgttagtttcattgactatagttatcttctattccgtctcgtaccttgatatgcactagtcacatgttattttactatggctatgttaggataacacccttcatgcatggttcttgctcctcctatgcattttcgatcaaagtcaaatactcactcagccccttggtcatctcattgttgttcttgtcaccacatctctctcatactatagttgacactccaagctgcaactaatgttaatttgaatccattgcttcttgccattctcaacatgatcctccctcctttcctccagcttctcgtctggaagtgatgaatgaggagtgcatgacattgtgataatttgatgaaagtaatctcgttgggctcatcaacgaataaccaaccaattataaaaaaaaagcaacaaatgactcaaaatggatatgacaagagcaccagtaagacgagttgtattatgttgctatgacatgccttttaagcttgagcagccaaatgaaggcaatatattatggcttaagttggggcaacaagcgcaacaagcatgccacattctaaacttgtttacgggttgaaccaattctggataaaagtcatttcgcttgcttagtttggtaagaggaaactatctattgaaactagtttccctgtatcaaaaagaatcaacttaagataagatgtaacatatcctagaacgatgaatctgaacaagtgttaaaagtggaatggtaataaatttcttcaatgctaatgaagaattttgtaacaaagtgaatatgttgtaacttttttatgacaaactaaaagcatacccccttatcccaaaatgtagctatgaatatatacaattatctagattcatagttaaagtaactactatatggtactatctaaattcatagctatattttggaatggagcgattagttttgcaaaagaaaaaatctaactgttgttcaatgttttatttctaaaaaactgttgctcaataatgagaaattgagaatgccctaaggtgaatacctatgtttttttatacactgttttactctgatgttctcttcaaaaattgaattgtttcaactgaaaacaattgtcactgaacaaatgaacccctatatcacgtttgtaaatcttaccggcatactctc

SEQ ID NO: 11948 - DNA, 1501 bp, Oryza sativa
ctttactttttttttcttcttttctttttctttcgttttcttctcattcttcacaaagaaaggagaagaaagggaaaaaagagaagaaaaaaaagaaaaatgaaaaattttcaatgggtcccatttatcagttaaaatttaaatgagacttggatattcatttcgagagtttagggacctagatgacatatccctacaagtttaaggaccacccgtacactttactctaaattagatgtggacatctcctcgtgtgtgtgtgcatatatatatatatatatatatatatatatatatatatatatatatattattttcagacattgtctatactaaaaagaatgtagagtatgcatgttggccatcccccatctcaccaaaattgaagtctaaaatcaacatataaagtgagaaaattattacaaaattgaatagctaaattactatttatgttttagatttgtctatttttttctcgatatatgacttggatttagactctaattttctgagaatattatactgctgttatattttctaaaaaagaatactattatcttctatttatattattttataagataactaggggtattacaaatactttgtccttttaggtataccatctcgaaaaagagcatatatgtatatacacaccagctgaggtaatacaagataacaccgacggtccaaatgaggaaacccatagtcttagggggtgtttgggagagagtggctaccttaaacaaatgcaaaaggtagagaagaaacaactttttatcctccaacaacttcatttctatatctagacagccaaacctcccccaaaacagaaacctaaaagaagaaaggaaactaaaacgaaactttttttcaaaaaaataaactatatatgaatctcttagaaactattctaaattcatttttgactttacaatatttatcattcgttctactcttcaattatttatcattcgttctactcttaaataattatcgtaaatcattctgtcattcagctattcttagatgctttatccgttctatattatattttgactttttaagttaaagacttggataagtctgtaagaatagcaatatttttaataaaagcatattattaaaatatattcaatgttatatttaatgtaactggtttgacatagtagatattactactttttataaatttaattaaatttaaatagatttataactatgaaagattaaaacgacttataatacggcgatggaagagtaggagcagatggacggagcacccactgctgcgggcgtgaggtgtcgctgtcatccacagccgtagctccacgccatggctgagtcactcgctcgctcgcctaggataaacccgttcatagtctctctctcgctgacgccccggccccacctccagcttccccgggctataaatccacctcgcccttcttcttcctcctcctcagctcaggcagcagcagaaagcaacgccaatacgcca

SEQ ID NO: 11949 - DNA, 751 bp, Oryza sativa
cctcctcctcctccaccacccccaccccctcccccgccgcagccgccgccgcggggcagaatgcgaccaccgccgcgaaggcaacgacgaggacgaggaggagacggaggaggcggaggggccccgcgcggcgacgcggcagcatcgccggagaggaggggagggggagagaggggtttagattgtggaggcgggtgtggcggtgcggtgtgcgtgtgagtgcgcgtgtcgggggggaggaaggagaaggagagggagagggaagaagaaagcgagagagaaaaagcgaaacacacgcgcacgccaacggggagaggcgagacagaagcgtgtgagatgcttacgtgcagttgcagcgggattggatttgcggcaatatgtagggggggtgtgtgtgtctgtattgagatctgttgctaatgggattggcgacctaacaatttcgtttcatttcttcaccaatttttcttttcttttttgtggggagggttttgagggcccattttgttgggtgtcatggtagtacactcccttcgtctgacaaaatatcaacatagcactggatatgacacattctaatataacgaatttggatactaaaatgcgttacattctgtattaggctggtatttttagatggagagagtatgccggtaagatttacaaacgtgatataggggttcatttgttcagtgacaattgttttcagttgaaacaattcaatttttgaagagaacatcagagtaaaaca

SEQ ID NO: 11950 - DNA, 1501 bp, Oryza sativa
tgataataaagcaaatcacaaacaaaataaataataatttcatattttttttaataagacgaaaaatcaaatattataaacaaaaactcaaaacgacaaatattttagaatggaggtagtagccatcatcgtaaagctatagcaacctcgtcctacatagtgtgatgtgacacaactatgaatattacactaggaatgcccctattggtgagtgtgtgctggtagggtggatcaagaaaaaaagacaatgttctatggtcaggggtggagcaaaaactctaataacacggtccatgcctccgcccatttctggatccggcccactacggttacatctactaccaataaagcatcatgcgaaatgatttacgagaagggaacagtttagggtcaattgaaagactgttctttcggcccattttcaacttgcaaaagatcatccacattccaaaaggaatgagttcacttcaggtccctcaaatttgtcgtcgaatctaatattcatttctaaaccgcaataccagatataacgcattcctcaactctcaaaaacaatgcaaataaaatcaaagacggtttggatggtggttttaactaacacgatgtttaaaatgagaaaaaaatggtgaaacccatatgttagtgacggtccaattaaaagtaaaaaaaaatacagtgggactcgcgtctccttctccccaatctccccatctccgcggcgagcaattgggggtcgctcgactccaaggcggcgtcctccaacctcaaggtatcacctcccagccgatggcacctccgatagatctgctagcctcgcctgcttcactctcaaatgattcttgtcttttgtgtttttcttagccataggaatgtccagttctagatgattggtaagtactttgggactctgcgctgtagtgatgtgtaattgatcgtgaagttgtgattactcgtttgctattacttgattcatatataaaaggaaattgacattttggttttcggtgttggtggccaccagattctcgatcattgatggcaccgcccccttcgggttgacgatgttatcacgaagtctcttgttggaggagtcgaaaccaccatccgaaaccatccaaaccatattgagatcttatttgcactggttttaggagttaaaagacgtgtcatatttgttattgtggttcaaggatgattttcagactctgcaataaattaagggacctaaagtgaacttattccatccaaaaagagctgtcaccttgccaatggaaaaagtacaccgaaggttcctcaacttgtcatcgagttacaaaatcgtcccccaaccacaaaaccagatatccagcgtcccttaacttattctacgtggtggctgagtcagcatgggacccacgtgtcagcgtgaccacttcaacctcctctctctctcttttccctcttctctcctttcctcgtatttctctcccttctctgactcagcaggcgggaggagaagggc

SEQ ID NO: 11951 - DNA, 880 bp, Oryza sativa
ctggtcctggacagggatttaatgcacattcagcttagaaattctggtttgagaatttcggggcgtgacaagttggtatcagagccgaccttgaccgtaggacaagccaactggaaaccctaagagccctctgaacccctttttcatctgcatatgccctttttgcacctggaattgtttcgggaaaatttggagttttgcctctttggtttgcgggaaaaatcttgtcgttctttcgggtcggatttttttttttttaaaaaaaaaaaaattattagctcagcctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccacccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 11952 - DNA, 1501 bp, Oryza sativa
agaagggagggagagagaggagagaagagagcgagacagagaagggagagaagagagcgagaagaagaggcgaagaagagagcgagaccttatctccacatgtcgctcgtcatggtggggcccgccggcttggttccggctcggctcgatttttggggtgctattataggtgtcggtttttttaaaaaaaccgacacaaaatataagaggtgtcggtttttatttagcactaacacctataattacttaaaggtgccttttttgcgatttctacccgtggaggtggtaaaaggccctataggtgctggttttagcactaccggtacctatagtggtgacacctatttgatgttttgtagtagtgaatctatctccgcttaattactggtaataattattaaaaattaatatatctcattgtcaagggaggtattcttatatatatgattgatgcggaagcacacaagaaatattagaaacagtgaccttgcaggctcgaaaatgtacagaaaatgtactatttttttagtgctatatatatattttctttttgacaaacacggtacagacggaggtgctgataacgtgtgcacaccatgaacaccctaccccactaaaagaataaaatagacttaaatgcgagcacccgtacgttttaaatctaagaattatatccgggtgagcgagctggttccacaacaatatattctgatattgaaaataccttcttaatgtaagcttatcaagggataatagaattccttgataacaacaacaataatttcatttcttcttctatcctttcagccagggatgttggcggcatctcagcattctttgagattctaatctcaatttattttaaatagtggtgttagcgcatttgcgtttcagacaaaaaggtttcttggaagttttattattgctgtctagcatattttgaagcaaagaaatggaaagatttttcggaatgagcgaccttcctttgaaggctggagaattttgttcaagaaagttcttctgcagcatatgtgcaaaatgaaagatcctctaaagaaaatagttttttattgattataacctttgtaatcttttcagtgctctccttgtaattattttttgtaaaatacttttttcttttaatgaaaatcacgctgttaggcaaagtcctagtagtaattcaaataaaaaagcaaacaaaaatattttcagaccagctaaaattagtaaacgtttcttgagtagtaatccacaccaagccaatatatattctatcataattttatactatcacaccaagccactgcccactgtctcattagtttcttgagtagtaatccagaggcaccaggtgacatactcgctgacgccacggagcacccataaaactcgctataaataacggcgcgaaaatggaagagcaaagctgtctcacttcaccagccgctcaatcctctcccaagaatcgatcggccggccatggcggcagcagcagcgacag

SEQ ID NO: 11953 - DNA, 1501 bp, Oryza sativa
tgacaagggagcttcctagacgatgagcaccgccaacgccatttgtcgaggtctcaaggagaaccaagacaggtttttcacctgataaccccacgagagggagagagacggctccacagcgccccaagaggtaaaatggcactaaagctccatcgttgtgggcttggcaatgacaagctaagttttgaaccgaccgcatcccccgagtcgatccttagcttagctattgctccattgcccaccaccgaacaaccccgctagcgtgaggacatcacttacctgacaccccctgccggttagccacaacatgcctctgtggaacacccgccatgtcgagctccctaccgttgcccgcactgacctccagagtcagcctcccgctgctgccggccgcacgtctcgcatcgtgccggcctaccaccgctggcggtcgcgccggcctacagccgccaccgacatgcaccaggctagctctactagccgtagcctccctaccgattcacgacacgtcgttccacatatatgtttgaccattcatttcattaagaaattaattaattattatttatatatttatagtggcttgattcatcatcaaatattatttataaaaaaaattaaataagagaatgattaaatgtttgttaaaattaatgtcaatggcatcctatattaaaaaaaaagagaggtagtttatatatatgatagacacatagtatatattctgtttgtaacttgccttacttaccacgctgtcgctacctacccagcatgaaaatgtcctacgtctctctattggaaatttggaatctttctactacttggaggcaaacaagtcttaatatgctgacttttaactggtcaagaacaaatgaatcagaatctaacaaggttgccacacagtaatgaaagaagagggtacacatccatgtacgaaactgtctgctttttcatcacagtcacgactcattctaacatacaaaaaccaagaattcaaaccacgtgaattgaaaaccaaagcaacgtgtacttgactaacctgcactctagctaatcctacttgtcatttctgtgctgaccttcagctcgatcgatcgcccaatccatttccaacgtagaatctttcaaaccttaataaacaaaaaaatattcagtcatatattctacgtctcaatcatgaaatccagtctatatatcgatcaataccgcagaagaaatgtacatatatatttctgccaaatttgaacattatatatatatataccaccttacctagtctatatatatagactgggtgtgtgtatatgtacgtacatcctcttctcatttctaagctagccaaagctatagatggatcacagccttgctagtgctttcggcataaatgccggcaaaatgatcatttcgcagaagccacctactaccacatgttgttttcctatacatatggtttggcacaaaccagctgttgctgctggaaatacgtgcgacatcctaagat

SEQ ID NO: 11954 - DNA, 1501 bp, Oryza sativa
atgaaaagttatttgttctattctttgagaaaagtacattttcgcaaaaagctttcaataacattgcttagatcacttgtttttattaatttgttaagtttatttttagtaagacatgtaacttattatgcatataattaatcaaataaataatccacaccaacaatccgcttaggcccggtttagatggcaaatttcttttttgttttcgggtgtcacatcggatatacggaaacacatttaaagtattaaacatcgtctaataacaaaacaaattaccgattccgttagaaaactgcgagacaaattttttaagcctaattaattcgtcattagcaaatgtttactgtagcaccacattatcaaatcatggcataattaggcttaaaagttttgtcccgcaatttacacacaaactgtatatttggtttttttatccacatttaatactttatgcatgtgtccaaacattcgatgtgatgggtaaaaagtttttgttttagaaactaaacatgaccttacaccgttctaatttcaaccaaatttccaatttaagcgtaaactaaacacaaccttagtaaagtatatgtttaaatcctaccctctacaatacaatacataggatctaggatctcgtgatcagctgctctcaccgtgatctcaacgggcaccgtggagtcgattcgatgctggtagtagaggtcgatgcagccgacgccgagccgccggaggctgccctcgcacgccgcccgcacgtacgccgggtcgccgcgcacctcccacgccggcgtgatgccgaacttggtggccacctgcacctgcacctcctcctccgtcgccgccgccgccgccaccgccttgccgacgagcacctcgttggtgtgcggcccgtagacgtcggaggtgtcgaggaaggtgacgcccgcggcgacggcgtggcggacgagcgccaccatgtcggcctccggcttccgctccccgtacaccgccgacatgcccatgcagcccagcccctgcgccgacacctccatcccctgcgaccccagcttcattcgccgcaccaccgctgccgccggagctgtcgctgctgctgccgccatggccggccgatcgattcttgggagaggattgagcggctggtgaagtgagacagctttgctcttccattttcgcgccgttatttatagcgagttttatgggtgctccgtggcgtcagcgagtatgtcacctggtgcctctggattactactcaagaaactaatgagacagtgggcagtggcttggtgtgatagtataaaattatgatagaatatatattggcttggtgtggattactactcaagaaacgtttactaattttagctggtctgaaaatatttttgtttgcttttttatttgaattactactaggactttgcctaacagcgtgattttcattaaaagaaaaaagtattttacaaaaaataattacaaggagagcactgaaaagattacaaaggtt

SEQ ID NO: 11955 - DNA, 1501 bp, Oryza sativa
cggctaggtggccctggtcggaggcgggagtgacaggcagggaccgccactgtcactgatgccgccaccaccgctgtcaccgcttttcctgcctgccctacccccccccccccaagtggttcctccgccgctgccaccgccggacctagaggaagaaggggaagggaaggggaggagcggctgcggcgaggaggtggcgtcgctgacagcggctcgccacccactcggggggtaattcgatcgaccgagatagttcggggggggtaattcatacctttttctttattatttggtataagggatgtatttatcacttactagacccgccttccaggataagttcgttttacacattccacctaccaatacataaccaacacaactagaataccgttactttctcaaaatccaatgccattattcattactaagagtaacaatgctttttttattccttcctatgaggttgtagtgctattacctgatattagttgcttagtatcttcacaatgtttactacttggtataagagatgtatttatcgcttactacacccttatgctaaaataagttttgtttactagctggttgtaatgcaattgtcacatatttgctgcttactacctccaaaatatttactattcgatataagtgatgtatttagtgcttactactacaccctcgtcccaaaataagttcatttttcacacatctcacatgcaccaatacaaaacaaaaagacaataatacacttgctttctcaaatgacaatgcaattatttcttgctaaaagaattaatgttttttattccttactagcaggttatagtcttgcttgatatttgttgcttagtgcctccatcatgtttactggttggtataagggatgtatttattgcttattacaccctgctcgcaaaataagtttatttttcacacatcccacacatagcaaccactatctatttattttactacctattttttcttctcaatcaatcacaaacttcatccaatcatttttacctagctacttccttaatatccatgcccacctaatattagaatggagaaagtatctattttgtgatagagagtatccttttaagagttcactgtggaagccctattatttttacttatttctttaatatccatgcccacctaatatttgaacggagaaagtatctattttgtgacaaagagagtatcctttttaagagtacattctagaagccctatgccttatcctatataaagcagctagctagctagctagctaaagcaacgatcagactaccacactacaatagtatcagtgaactgctattgccctcccaagggaaatatactagtatgtcaacttccatccctctccctttcttcttctctcatggtgttgtgcatgctaggataggccatcgtccaatccagccatcggttgggcttctttctgctggtgccccggcaaaagtctccttccgacgacaaagcagtgcgc

SEQ ID NO: 11956 - DNA, 1501 bp, Oryza sativa
agacgaccatcacagtcgaaaagataatcttctgctgaggtaaatcaccaaaaagccaagtatttcaatcatcttcgccatagtctcgcgagcgcttttatcaaatcatgaggctatggagggccgaaaaaatttaaggataatatcgaatatatatttaagtgaattgattagatgcacctaattaagtgtagttcctgactatgtgtttagttgaacaatctaagcatatagtcaagagataaataatttaaccatccaagtggtttaagccacctaagtagcataataatagtagtatgaaccctcgagtatacgatactcaagtgataaaactgactgcttaaaaaatataatgcgtacaacctaaagttgactacatctttcaaaattcacatagaaaaatagctataaagaagcttgtatgctgtgaataaagaaatctctaaagtatcgggcacatgccatgcgcacgctgctttaacaaatatgcttaactcactaaaagacacatggtttcactacaccaagaaatatacggcatatgtggtgtaaaatccgtgtaaataaactcataaaggatttaccagccgcctaaaaaggaccaaaatgtataatcagcctaagccataatattggtctataaataaaaatgcatacttacgtagcaaaaatgccacgatattgtatccaatcgattgctttataaacccgaacaataccctgacttatatatatatacatatatatatatagagaattatatatagagaattactatatggcaccttaaggggctatgtactaaacggcacgtgatacaaccccagcccccagccccacccactgtggaaccccacacccacacacactccccaccctgcctaccactaggtccacagaatgcagttaaaattttactcaccgaccaatctcgatcccacccctatgcccctccccacactcccatagtccaagtaattttttattaaatgttaaccaacttcttagtagttctatatatagttaaaatttaactcatcgacgaccaatctcggtcccacccctgtgccccgtcccccactcccattgtccgagtaatttttttaattaatgttgcccaacttttcaacatatatatacatgtgttgttcccccatcccgtaaccaactgcatatcccaatctgattttttggatatgagggagaggcggtgggtcagtggtgacgggcgtctgcgggcacggcatcggcaagtgggaggtggatctagcacggcacggctgcgagcgcagtggtgacaggcgactatgaacgcgcatcggcaggcgggaggcgtggcggcaccacctctcccgtcgagcggcagagggcgtggcgtcggcggatctggcacagcacatttgcgggcgcagcagtgacgggcgactgtgggcgggaggcgcggcgactccacctccaccaccgagcggcggcgggcgcggtggcggcagatccggca

SEQ ID NO: 11957 - DNA, 1501 bp, Oryza sativa
ccgccgcatcccgccgtccctgcgtgcattaaagtggggggaaatgtttcccccgattccctctccctttccccccaattttccctccctctctcccttggataagtttgaaaacccctcccctaatcctgccggcgccattgatggagcccgagaacgccgcgctggtttccttcccctccggccgccctctctcgccccggccctatttaaaccctccccgcgcttctaccgtccgtttccgcctctcgccacccttcctcctcgctggattcgagctcgcgacgtcgctctctctctccgccgtcgtcgccccggaccgcctcccacctcggcgccgcctccttcggcttcgccgcatccttgccgacctcgtccacctctccgtttcggtcgccgaccgccggagcgccgccgtccccgtcgacccgagccgcgccaccgcctccctccgctccggccgcctcctccgtagccgccgttgcctcggggtgagccgcggaccgccgcctcgtttcccccttcccttcccctctctcggccgcctctccgccgtgccatggccaccatcggcgaccataggggcgcgggtgcgccacctctcaccgaccgcgccctcaggtgcggctgacgcgtggggcccacggcgccggccggtgtgagcccgggtgcgcccggtccaccgtggaccgtgaggctgccgcgtgggccccactcccgtggacccggtccgcgcgcccctccccctcggctgacgcaataaatcccttttaaattaaaatttaaatgaagaaattcgtaaatattcatttaaagagcatttaaacttcaaatggccataacttgaccatttgaactcggaattggaccattcaagtctctaatttttccttaagaaatcaagaacccatttttgtgctttattcctgcttgttatgtggagtttattagcgtaaaagcccttttcttttccgttggtcgtgtagacgctgcagcttcgaaagatccgctctacgtggaggttgaagccgacgtttgggaaagccagcaaggcaagtcacatcatccttgaatatattgaatcccagtttataaaattattttgatttaaattaatgcattatcgctttatttaaattcccgcgttatcactgttttatttagccatgcctatttacctttgttatgaccttattattgctattgttattattaccttgttcaccctagaataaataaaaccccaactagtgtatactctattcatggcaccactagtatgaatttaggtagatgcttcgttggttaattaggcaacattaggtggttttacaactctagactttgggaatattcatatcacctggacactatggaatggttggattatggtggaattggattcacacctccccctctattcaaaatcctcaaaatggttttaggctgggctcggggtgcatggttttgatagtagcacctcggccacataaggaccggt

SEQ ID NO: 11958 - DNA, 1501 bp, Oryza sativa
gagtcgccgcgcctcccgcccacagtcgcccgtcactgctgcgcccgcaaatgtgctgtgccagatccgccgacgccacgccctctgccgctcgacgggagaggtggtgccgccacgcctcccgcctgccgatgcgcgttcatagtcgcctgtcaccactgcgctcgcagccgtgccgtgctagatccacctcccacttgccgatgccgtgcccgcagacgcccgtcaccactgacccaccgcctctccctcatatccaaaaaatcagattgggatatgcagttggttacgggatgggggaacaacacatgtatatatatgttgaaaagttgggcaacattaattaaaaaaattactcggacaatgggagtgggggacggggcacaggggtgggaccgagattggtcgtcgatgagttaaattttaactatatatagaactactaagaagttggttaacatttaataaaaaattacttggactatgggagtgtggggaggggcataggggtgggatcgagattggtcggtgagtaaaattttaactgcattctgtggacctagtggtaggcagggtggggagtgtgtgtgggtgtggggttccacagtgggtggggctgggggctggggttgtatcacgtgccgtttagtacatagccccttaaggtgccatatagtaattctctatatataattctctatatatatatatgtatatatatataagtcagggtattgttcgggtttataaagcaatcgattggatacaatatcgtggcatttttgctacgtaagtatgcatttttatttatagaccaatattatggcttaggctgattatacattttggtcctttttaggcggctggtaaatcctttatgagtttatttacacggattttacaccacatatgccgtatatttcttggtgtagtgaaaccatgtgtcttttagtgagttaagcatatttgttaaagcagcgtgcgcatggcatgtgcccgatactttagagatttctttattcacagcatacaagcttctttatagctatttttctatgtgaattttgaaagatgtagtcaactttaggttgtacgcattatattttttaagcagtcagttttatcacttgagtatcgtatactcgagggttcatactactattattatgctacttaggtggcttaaaccacttggatggttaaattatttatctcttgactatatgcttagattgttcaactaaacacatagtcaggaactacacttaattaggtgcatctaatcaattcacttaaatatatattcgatattatccttaaattttttcggccctccatagcctcatgatttgataaaagcgctcgcgagactatggcgaagatgattgaaatacttggctttttggtgatttacctcagcagaagattatcttttcgactgtgatggtcgtcttagtggctactgtggagaatatggttaccgggtacccacatggcctcc

SEQ ID NO: 11959 - DNA, 1501 bp, Oryza sativa
atatagatacacagttgtccagattcatagccaaaaatgcttatattttgggatggagggagtactcacttgactagagaacattttcattttttgtattgtaggcaaatcagcaaaagactcattttttctcgttcaataattttaatatttgctttaatataaattagtatgctttaaacataaaaatggtgtgtacgtatatatatatacatttatcttgtgtacgtgatgtacatacacaatacacaccattcttattttttgttataaaagtttaaaaaatctttcaaatgtatacaccatttgtatgtttcaaatgcatttatatattacaaatgaatgcataaatgttctaaacttttctaataaatttgtcatacataaatgcaaattactctcgtaaaattgaatcattttttaaacttctctaataaatatattgtgatcaaagtagcatctcgtggttaacactacgaaaaatgtgtggcatgttccattttatcggtgtgcaagatattaccaatttcatcattttcgaaaacaatgaagcgctaattaacagataagatggcatggaacagaattttaggaacatgttatgacctaaatgaaacagagatgagtataacaatacgttgagtatcatacataagagctctgtatggcaaattaattaacttacacaactgaaatatatttttcaatgtaaacttatcctattgcatgcaatattaaccattagagtaatttgcatctagattacatgaacttgattggtggatatgatgcgatccagtgaaaactttaaaaattagcatattggtcagcaactgagctagcacgaacatttaggatcgatatgtcacacataagagtcttttagccatggaagcacgccatgtcgacgaaggtctgcagcttttgcttttgattggtagtgttcatcattgcaacgaggctagcatgtgcaaggaaagaaagcacagcgtgctacactcctgcataacaatatattaaattttatcgtatcgacaatgcagttttctcatgattcattgattcatatctccagtccagttgcctaagtcatgattcacaacttactattgttttaagactcagaacatgcaaactaacataatttccaagtaattcaactcctcaaagatatcttaagaatgaacactgcaaaatacaaacaatctagctgatatgtttagaatatagaaaaagaaaacagaatgaatcgtcggtaacattatttttgacaaacgcgcgtgattgccaagtccatgtactagcatgcttatttttcaagttgttgtactatatgacaactgcctgctaagttcttgtacgagaatacaatttactctaattgttatgtttcccttgttcatatattgcatctaaactattgttactgcttttgatgaatcttcaagtctatctttttttttgtcctgcaatccaaactaacaaatcaatacacattcat

SEQ ID NO: 11960 - DNA, 1501 bp, Oryza sativa
accacatgcctaattgtagttgactaaatctcggtaggacccaccacataccatgtcttatatagaaataaccttcgaatataggaggagttctgcagaaggaaggatgaatagagttctacatggaaacgacaaggactactcggattgtatccatattgttttccctagttctacttggacaaggagacacctatgggtataaatacaaggccctctaggaggagaggggacacgaaacaatagatcaagacacaagatcaacatacaagccaacatgcgccaagacaagacgccggatatcgatttcagacataagcatggctagtcccctacaatgtctacggatatagtctggagagacatagcgctgtctttgatctcgccagatgcggattcgaggaggaacgctaccctgttgtcgactacgagtcagcacttcagaccgccaagtcgacaacagttagataggctaccccaaatattgtactggtgtattatggtgaataagagcaacgaccggcttcggccaacaggagtagggttattatctgacaattcagtggcccgaacctgtataaaaatcctcgtccccatcttttttaccttaatctcgcatataccctggtaccaacgatccccatactatccaaataccctagtcgcggtaccacgcgtcgacagtggcgcgctaggtagggggtcttggtgcttcaaggttacgacgagatgggtttaagagatgaattctccaacaacaagctactcgacgacttcggttgtggggagatctaacccaaccggagtatgtcttccaacaagatcggagctatcgccgtcaataatttgacctatggagatcaacaaaattcaagatgccgacgccgcagagaagcaatgatgatgtgcttgtggtcatcggggagccgtgcgcggagccttaaccatgcatgttttcatctgggttaatgcaaacataccaggccagcaatctcttcgaccaatcggataaaagcatatcccaatgcccgatcacaaagtatgtgacgtggtatcagttcatgagtagagccatccgactacgcatgttagtttcatgggagttggattctgctacgtttgcctggtcctgtccgtccattgttaccaacagaccccggcaagactaccagcaagcccagatgcattgatgcattggtactccccaactagcaggcgttccgagacatggacagaggcaatacacgaggccacaatggagttctactgatacagctgtccaccaagccaccatataaatacataggtatttactaaattgattttttaaattaatttactaattccgtagatatatccggcatatatctaaaaaggtacgcaatattttatttacattttatcgtacctattttcgagatcatacaatattatcagatcaataatttattatgtttacctagaacatgttctttatacaatatctattatgtgggcattc

SEQ ID NO: 11961 - DNA, 1501 bp, Oryza sativa
tcaaataaaacggacggtcaaacgttggacatgtaaattcagggtttgcctttttttttatgagggagtacgtaagtatcgtgcttcctaattattggtgatattactcaaacacgcgattcaggcatggaaagtttaatcgatcgagcatattctccgtgttaatcattaaattaatttagtgtgttcaaccctgacaaagttggatccgatcaccgctgttgagcccatatcgttacctctgacaggtttgatcctcatcaggtaacagtggttagtcatgattgcacctcatctctaatcggtggaagccctttagtgatgattaacatctttaatgagccatgtagtctagtggttacagtgacctgagtaatactctaaggttttgagtttaaatcttttatagagcgaattttagattgggttgtttacggggttaagtaccttatttcaatggtcgtatatatccggttagatatagaggctgatacttttttttaaaaaaaaaatctctaatgggccattttgaaatatcccgttgcaggtgagattcacctgtatgacatatggctctttcttgcctgtcacagatgacagattgtcattcatcaactgtcataggtgtgaaaattaaaaaaaaaaagcctcgcccccctagctcacgatatggaggaaaaactgtaggataaatatcaagatgcacgacacatcaactttctattttaatggcagatccaataacatcagagaaaaattaatggtttttgccaaattaactaatttgggcaacatatcctaattactcccttagtacctttcaaacacagtcactatccaactttgaacatccgtcctaattaaatttttttaaattagtatttttattgttcttaaatggtaaaacacgaatagtattttatgcgtgatctgtgtttttttaatttattaaataaaatggacgatcaaagtttgagacgaaaactgcaaaactacacttaaaatgagatagagggagtattatccttgcatggctagctagctactcccttcgtcctaaaatattagagattttggacggatgagacacttcctagcacagcggatggctctctagattcgttgtgctaggaagtatcccatccgtttaaaatctcttatattttagaacggagaaagtagctagcagaagtagtatgtccattgctctatatataggatgggtggcagcagggtggttaacttaactggctataagcattaattagcagaagctagctagatgatatactcgatctatatgtactactacaccagatcgatgcatatggatcaccgcttagcatgtgctttcaccatttcgcagccaccgccgcctgcatgtgcctgcatgtgcctgcaggtttcgcacaacgccaccaccactgctgcagctaggaataatagaagcactatcatcgtgtgcagcccaaacgcaagcagcaagcatcacagcagcagc

SEQ ID NO: 11962 - DNA, 1501 bp, Oryza sativa
ccctccgccttcgtcttagccttcgactcagccgccgtgctagtgagatggtgagcggagggatttgagagagagggggggttgagatagaggagagagatagagaggggtggggaactgacagtgggtcccactaatttttttaataaaattactgactggactgccacgcatatgccacgtaggaccaaaaccaccgcggattgagccgggggggttatttgtcctgtttcaatagttggggggtgtagaatgtccggttttcgagttcgggggtgtaatttggtcgacctcgatagttcaggggggtaattcgtactttttctgaaactttatatgtgaattgtagatagtgtccatattcaattttgtagtgtaacgttttttcattccagattgtttatgtggctataaattcgttacaaactttcactattttgataaaatgaatttttgaatttttaaaatgagctcaaatggagacatgctctgtagagctcgacgctgcaagtttatagttgataactttttaatttgatggcccttggagtaaaaaatatatgttacaagttttatgaaggatgaagtcaaatgaatagcatctatgggatagtcaccaaagatcctgggttggaattctatgccatagtaacgaaagctatatgccatagtcccgtgttggaattctatgccatagtaaggaaagctatgccatatatacagtccatgggttggaatattctatgccatgcatagtcgtccccggtcatagtcctttcgttagtgactatggcatagcaaggaaactatggcactgagtgagaggccctgggttcgaattctatataccgcccgtgcgcatatttcacatctaaaattatgtacttgtgattaaaaaaaataaaaaactggaaatcccgtgtaatagaaaatttttcacacgcccaaggttgcgggtgggatcgtaaaatacctatgtaaatgggttatggaccatccgcaaaaatattaatttgctgtagtagcgtcggagatatatttaattcactacaaaatacaaaattgttaaaatttttagtgtgcaatgggagtgttgtaattggatgttaaaataactagctgaatatataccccaccgcgttgctgcgggaaattaaattatgtaatgtgtacaaataagatgcaatataattattaaaacccaaacaaattaatacttataaattttgagccaaaaataattcagattgcatggtgttatgagagaagaaagaatagacaatttgaaccatagatctattatctaaaagctataaataattaggatgatatggtttgatgagagaagagagaaataacattaaccgacacttggtggacgaaggatctcggagcccatgcatcgctatatatagtacacctgctgtagtacttggcaactggagactggagtagtagctattgctagtgcgtacagcacatcgtacggacatggaggaca

SEQ ID NO: 11963 - DNA, 1501 bp, Oryza sativa
tctctcgaacaccaatagaagttgcggtgtgagagattgctgcgtactggtgcgagaaccagtgagcgagcggaatcatctctcaaacaccaatggacgttgcggtgtgatagattgctgcgtactggtgcgagaaccagtgagcgagcggaatgatctctcgaacaccaatggacgttgcggtgtgggagattgctgcgtactggtgcgagaaccagtgagcgagcggaatcttctctcgaacaccaatggaagtgctagagttggtttattgcaagtgtatctcatgtggccagcatgactcacgtacccaacttatagcatatccggatgtccgttcgcaatcatgtcgggtgatcaagccgacgacgttagcgaggaattatccgttaacaaccttttctcgagtagtccagccatggctggtgctatgagataggtcgtcggtctttgttggtaggttgggtgcgataactccgcatttgtcgagaatattctcgataatggagtgtactcgaccacaacctactcgagtgctcaattgttcctgaaaaatattttttagaaagcaagatatatagcagatgatatcgagtatgtactcaaaaactgcgtggatcttctagtattatcaggatataacgagcagattaattaaatatcaggcattatgtaaaccgtaaacaagcatgatttatacggaaaaaaatagagcgagcccccagcattaaaccgtagtcgatttaacatcggggacactcgcgcaatagatattgtataaaaaacatgctctagataaatataatataaatctgacaatgctgtatgatctgaaaagtaggtacggtaaattgtatataaaatactgcgtacctttgtagatacatgccggatgtatctgcgtacctttaaattaatcttgctaaatacctttgttgatttgtttgaatattatgcagtcgtgctgtgtagacatgtgttgatgtgcatataccgaataggttttggaaaccgatcagcatatgtacgtacgtcaacatgtaggcctgtggatggatatctcctgagtcctgattggtcggcacggttgtcatgcatgcacgtattccgtttgccaaattccagtcctaaccggacacaagaacgaagcaaatacagattgatctgccaccaagtcgggcttggcattccttggatgggcgtcgcactcgtgtcagcagctgcacggccgggtggaggtcggcgtctccttctcggcggcgatggtcccgatctcgtcgggggatatattccggtcggattagacctccccacagccgaagtcgtcgagtagcttgttgttggagaatccatctcttaaacccatctcgtcgaaatccaagaagcaccaaaatccccctacctggcgcgccactgtcgacgtttgatatcgcaattctggtatttgtacagtatggggatcgttgatgctaggatatatgcgagactgaggtaaaagaga

SEQ ID NO: 11964 - DNA, 1501 bp, Oryza sativa
tataactgtcgttccaaactatagcaatatctggatggagggagctagaactatcttttctaataaaaatctattaaagccatgaaggcatgcgcatgggtatatttctgagtccgcctatatatatatagcatttttttttaagatgatggacctatatatataaataaataaaaacctgatggttatagatgtagcgacatatctccctccggtgttctgatgatatgacagtgtccagtgatccagtggcatacaaagaaaatatctgcatacagaaactaggtcactagaaattaatctcgaaataattgaacatgaatattaatattaattagccaaaaaaatcaaattaataccaagacaggcatgatgaatatagcaccactgaggtcgccaggccagtggccatcatctgcttgcagagaggagaactcatcgagagctcgcctcaaggaagccatcacagtttcttcagtcacctgctccttctcgccaagcttattgacggccggtggaatacgatcaccacggcgttggtgattgttttctcttgcaaactgcaacaagatcatatctcagatggtcaaactaacatcgaatcgatcaaatgaagctagctaacagtgatcctgtttcaaattacataaatttcagttcaaattaacactattaactatatactccctccgggctgataatacttatcgttttaaaacagagtgagatcaaactttaaaatatttgattataaatcatttttaaaatatttattttccaagtacggtgaaaagtactttaataaaatcataaaatcatatatttgttaacacttttatacatattataatgcgaattatttggtcaaaattgttttctgtagatgaccgtgtccttctccaaagcgacaattattatcaagccggaggagcacacaacacatacctgcatgcgcatgaggagatcggcggactccgggcggcggaggcggtggtcggtgaagtcgcggcgcaccctctcgacgttggctcggtcctccggcgtgccgtggtcggggtcgaactcccacaccgctcgcccggcgaagccgttcgtcgaccgcaacaaagcgccgccgccctgggccaccttcagcctccacatgatgttcgcgatcgagcaccagctaagctagagccaaccaacgtaccggacaaggagacaatgcaaagacgacgaccagctatatccagtatatatactggctgcctttttattagagctactgtggggggcttaactacagtatttattacaataccaaactgtgccactcttcaaataacacttttggatttgttgttacatatttagcagacgggagagataagactatttcttaaatttttttctgccactttaactaacgtggcacaacacgttgacatgtcagcgtggtgtacactaatatctctatctctagcagttggactatcggtattaattactagcaaatacttcg

SEQ ID NO: 11965 - DNA, 1501 bp, Oryza sativa
tgcataaatcagtgagttcagtaaagtattggtccttcaagctcttaatctgtggataaataaagagaaacacacataaatttgtacaaattttcagttccaactttacatgcaaaattaaacaaaaagcgtagagttaggtggcaaacagatcaaaaggaaaggaagggaaaagtaaatgaggggaaacaggaagttttttttttttgaaaaaagaatacttaacattctctagttcttctatcaacaatctagatccatgtgaattgaaagcttcagagtgcttaagggattataacataccttaccatgtcatatatctcatcttgcaaataacattgacctggatgatcagtttgagtagtaatgtgcatagttgctgcataaaaagaaaaagattgtcaaaacctgaaacaagatactttgatgaaaaaaaagaaggcatcaatagcaggctagtacaacatagaatggatgccggtagcatgtggacttttttgtgcctgctatcgaaaaactaaaaccacaacaatgaactaaaggtcagattgcaaaagttatgcagagtagcctttacaaaattactgcgactttacacggatcgaaattcgaaagcacgtttgatgaaacgtaggcacagatcaacttactactgaatggaacttcttgaaggccgcactgtgcctgagtatattgcatttgttcatcaatgttattttgttgcaagaacatcccggctgaagtttgaaagctttgttgcactgaaggcttctgttccatccccaattcttgctgcagttgattcgactgagactggaacgctgccataatatgccgctgtgattgatgttgctggttgtgctgagactgaggttgcatcaaacccatccattgctggtgatcatgcagtgggtgctgaacctcctccatctttacttgttttcgcatatgcatccgtggaatgtcagaaacaattggcacagtttcaagaagctgctgctgtagagttgtcataataagataaccctgggagtccaattgttgtgactgatgcagggacatggaaccatttgactgaaccatggaatcttatttaagagtttgttgtaatctctattgtattggatatataaatacaatcgccctcccacgttgggtcgtgaggcgtctcataattctctacatggtatcagataccggtttccttctaccctaattcgccgcttcctctggccttcgctttttccgcgttcgcttctcttccactgcccacgcgacttccgcgtccccaccaccgcgccgcgccccagcgatttcccctcacgatctcgccgcgccccagccccaccgcgccttccgcgtccccaccgcgccacgacgcaccgcgccgcgccctcgctcgttccgcgccgcgccctgcctccgcgctctgcccccatcgcgccacgccgcgccctgccctgctctgctcatgctgcgccgccttctatcttcgccgcgt

SEQ ID NO: 11966 - DNA, 1501 bp, Oryza sativa
gcaggggggggggggatcgggcgatttaaacaacgcccgatttaaacgattgaaacattttcgatctacttagtgaaacaatttcaatatacttggtggaacatcgtgcaacatttaaaaataattcaataataagctaaaaaaaattttcgtcgaaatatatccatgtgttgtcttgttttaaagatttaattacaacgaatttaatggtgcaatcgaatcatgatttggataaataatttaagagaaaacgtagtttaaagtggttttgccgacatacgtcatgctgacgtcaacgctcgatttttccccctccctatcgggcgcccgattctaagtcgttccctaaggatacataattcatcgattattttccttttctgtgttcatgtccatataagcttcgaataaatttgttgatgttatgttttatgcactggcaggtgaggaacttgaaggaccagcactttacagaactctatcatctgtacaataagatatctaggaagcaagaatatgtggatagccaaatgccatctcaaatgcctatagaacagtatggaaagatgaagaaatttaaagaaatgttggagcgcatactgcggttcctgcaaatttacaagggcgacattctgcctgctctcgcagaaaaaatccctaaatacaagaggcagattatcacactagtggagaaaccatctttcgtcggtcgggctattttcacaatagtcccggttgcaataaaaaccgggactaaagatctttagtcctggttaaaaagggtaacaggcatatttgatctttagtcccggttggtctttagtcccggttcaaatactgtcagggcttatcagcccccccccgggataccaaccgggactaaagatcccgtcgatctttagccccggttggtaacaccaaccgggactaaagtcccacccctttatatatgtcttcttcctcctccagcccgagcaagcttcaaaatttcttcaaaaaagagaggaggtcatgccaaaatttctagtgaatttactttggtgattatatacaaatcggaggtgcctaaaaggttagcaacttcatcctccaatgtttttttggtcatattacatctggagctatgttttgcacacttttttgtctccaaaattttgttgtaagttgatgagagagaaaatttgtgtgggaaaagaaagaatatatagaaattttgtttatttgataaagaaggttttataaaatagttgagtaggaaaatatagtgaaagttaatcttaaataaaagaaaacaaactaaattgaaaattaaaagaatttaaaacttcaaaaaaataaataagaattatttggtggactattttataatttttgtatgaataatgatatgtcattattgtatgactattgaaagagtttgtgattattttatcattattgtatgactgtcattattgtacgaatgattatttgtgtatgattttttttcatttcatgtaga

SEQ ID NO: 11967 - DNA, 1501 bp, Oryza sativa
cgctgccgagccacccgcctactgccacgtgagagaggagagacagttggaggtgaggataaggataaggaggtgagagaggttgagggaggatatgaggatgaaatttttgaagtgttgagagggtaaaagaagggagagtattttcgcgcgtagtgctcttaagatgcccgcacgcaaaaatgggaggacgatgtttgttctatcaactaggaaggtagcccgcgcgaatgcgcgggcatgcgtcctatgctaagtttgagataagtataagagcgaaatattaaacggaaaacatctgccatgatttgtacataaattattttcatcagcattaattgctaagttagtaacctattagttttatattatatcatatttaagtaatatctataagcaattatttataatcttctttatcatttgaaaataaggtaaacatattttttttttgaaaacatgtcaacaaaagtaaagtaaggtgttttttaattacatatctataacagttcaattaaagatgaattgggtgagacatgaagctccactaaatgtatgggtttatagaagctaatatgattgatatagtttgagaggtgatccatttatgaacatttcatgtagggtgggtgagaggctccatgcaacctaatatgaatatgataatgacgaaatataattgcgtagtaatattttggaaatatcatgtaccataaatacatgcttaacttttatataagatagatctaacagttataacaaattgttcaccggtttaaaaggcataaaagtattccagttatgtagcttaaaaattatggttgttttattatccaatgttattgtgaagtgagcacagatcaattggttaggtttcttgtggtgtaacttgtctacctggtttaagtcctagacttgatacgggtgctcgcatttacggctaaatattctttcaatggtaggtggcgtacccgtcaacagcgagacgcctgtggtgacatcgtcattctcaaaatgtgttggctcagtcttttagaggtactcaaaggagcaggctgtgcgcgtgtcgtgtttcttaaaaaaaaatccaatattattgattgtttctattttagtttaatatctaagaaatagcgagaaagacgtcaaaacttatttgcttttttcttaaaaatgtatgaattagtgaacaaaagctagtccgtaaaatatatatgatccaaagtaatgaatcttttaataatgaagttaacttgattctttaattttaaattttatagtaaataatctaatttatctcctacttaggctacattcgatctaattggttgagcttaggcagaatcttttaataatgtagttaacttgattctttaattttaaattttttagtaaataatctaatctatctcctacttaggctacattcgatctaattggttgaacttaggcaaggcatgaaaaacgatgtaggtcatcaacgcaagattaattaagtatt

SEQ ID NO: 11968 - DNA, 1501 bp, Oryza sativa
gtaggtttctttgtcaaacgcttgaccgtccaccttatttaaaatttttatatgattagtattttgtttgtttattagatgataaaatatgaatatttttaattttaaaagagcaacctaggtagcaatctatagctttagggcacgttgcttattgggaaaacggttcttctgtttctttagaaaggagcattacgcgtatgatcgtaatgtagatgaggggaatggatagatggatgcgctttcagtaataaaaaaatattagatgataaaatatgaaaaatattttatgcgtgacttattttttataatttttttttcgtaatttttgatataagaccgatacacagaaacctaaccgctgtgcacgtagcaaaaatccacttcttctagagactacccaggttatatatatcccagccatccatctccttcgtcctaatccccttcctcaccccatcacatctcacgcggtggcttaccttggcccctatctaatgtactgtactacccctctatttcaaaatgtttaacgcagttgactttttagcatatatttgaccgttcgtcttattaaaaaaaattgtgaaatatgtaaaactatatgtgtacttgaaagtatatttaacaatgaatcaaataatatgaaaagaataaataattacttaaattttttaataagacgaatggtcaaacatgtactaaaaagtcaacggtatcaaatattttgaaacggagggagtactttcgtttcagccggttcccaacatgatcagtatacacgaaaagtgaaacggtctattagcacgaattttctctatccagatttattttattagattatgtttcatccaagttctagggacaagttctagtatgcacgaatttcatccaagttctaggttgagttttattaggacgaagagagtaatcagtattagctattttttaaagcaactttcatatagaaatatttagtgaaaaaaaacatcgtttagctgtttaaaaaacatacacgtcaaaatgaaagaggagagttgggaaatcagagtgccgaacacatcctaatcacccattccgcaccaccgtcactgtcatcccatcctccttcctctcctcaccttcctattatcctttccggatcgagctttgccttccttctcctacgcgcctcgccatcgccgcacggcgcaaaaaggcaagcaaaggcgaacgcgccgcccgtgcgcctcccctcccatccacacgtttcgctctcctcctcttccgatccgtagcggcggcagcggcagcggcagcagcagcagccgccgacacgcggggggcggagcagagctcgcggaaccctacctcttgaggcttcttatctgcttcagccgagaggtctagtaatcccgggttctgatggctggttgtggtttgttgtgtttgtgtttgtgtgatctgagttgggtttggtttggttttggtttgcgtgtgtgcagggggggcgaggcggcga

SEQ ID NO: 11969 - DNA, 1501 bp, Oryza sativa
accagcggcatgaggtcttttggtctgcgcccatcgatccatgcagagtcctagaagcgtgtcgtgttctcatcaccgacagttatttttgttgatgcggcgaagagatccctgtcaatttcgttgcaaggcatctccaatcccacccacggttttgtcgggtctttccattcatgccacaatcatcgcagccttaatccccttgtgaatttggtttagaactcccaggctggtaaggtcaattggagcttggatttgggtttcacagctgcactcatactgagttccagaaaaggctattagcatatcacaccccattgtttggtgtgtaagattcttttaacctatcttcgcttagtacaactaataacagtaaacaaaaccataatttttcacataataatgaattggggctagtctgcaaggaaactacaagatcatgtttaatagctgtgcttaaataattccataccacgaaagataggaggcaatcaacagcatcatgcagcctttctatttcaattggatccccgaccacgttgctagagatcttttccagtaacagtacagcctggaaatgagattatgtaagatttcaagagtagacaaaataaaaatttatgcagaactggcaacagatcgtgatcaattttttgtataagcatgagcttcttgggtgtgctatcactgattaagactaggttaatacgatagtacaacctccgtcccaaaatataacaacttttaaccattaggatttgttctaaaatataacaacttctccaccaacattcttttcccaaccaatcacaacactccaccattcacttttcccacctatctccactattcatccaattacaaccctccaccattcacttctacctactttcttaataactgtgtccaactctaaaactttttatattctaggatggagggagtagtacttatttgaccgtttcaaggattaattaattatttgcctcccttgtttcaatggtgcattagtaaaaaaaaaaagaagaagaagaaagaacataatgaccttcagcgcttctgctgtagtgtcagacacagcccatccattgtctgctgacgaaagagtccatgaaccctttgatctatggcgatgccagtaactttggtcaccaggatgattcctcataatcttcaagaaagaacatgcaatttatgttggatcaccttatgcactagttaatttataaatttaaattattaaagtatagactctgaacctgtgaatttttcatgaactcgtgggctctcctaacagttgaaccatactcatttacaagatcagtagcacaaaacgcttgaattataaatgctgtttcccagctctggcaaccatcatatatctatcattcagataaaaatctgtcacagtttttttctgtttcctcattagataaaactaggaagctagcccacgcatctgtgcggacatgtatcaaatactgtgtctgtgtaggaaaca

SEQ ID NO: 11970 - DNA, 1501 bp, Oryza sativa
ttctggaaattttcggatatgtccgaaattaattttcagaattttcgaaaaatgcaattattgggcataacaggcaaatctggagttgtggctataaatagcccactccccttacttgtgagggctgctggtcacattggatattttcatgcccttggcttgttcatcttcagattcacttttgagtcttgctttcttgtttccctctcacttgtgtttgattcggattttggtctgtgtttgagagttgtggattcgagtttgtgtgtgtgcttgttgtaggcttcgtgaagatttgtgagcacttgcatcatctccgggagttcctttgattatttattactcttggaggttgaggactcctaggcggctaggtgtcagtctcgagtcaccgatctacgtgtggtaggccaggagaagtttgtgaagatcggatctcacctccgaaagggaagagataccactagtgaaaggaggagtgctttgtgcaacctcttgagcaaagggttagtggatacccgactctttgtgagctcgtcaacgtagagtagaatcccctcaaggatttgaactcagggaacaactcatcgtgcaacaactttggtgatattacttccccctctcctctagctttgcttgattgtgtcgctaaaggtctagttgcttttcgtgatagcatattcttgttgtaggcagctaaatctagaatttactttgttttgcgcatactctgctattttcggaaattccgaaaatccctacttccgtatttacttgagtttttgaattagcctattccccaggcctaattgaccctttcataaacctcagcgccattttagctagcgctaagtgcccagccagggaccccgcaacagggttgtttggcgagccgggcggcagcggctaagtgccgaatgtcagcgccaaggaaagtggcgctgagctgtagatgtcagcgccaagctccttggcgatgagacccctgccacgttggctgggccatgctggcagcgctcagcgccaaagcggttggcacggatatggccaagctccgcgccaggaggcttggcgctgagcccatggcctatttttggttaaagttctttgcgcgggctaatttcgtaataagtttttcaaaagggtcaatttgtaaaaaaaaagaatggcaaaaactgccatgtcggacgaaaccgcctcctaaaccacggaaggagatcatttacaccggttttcaaagatggaacagacgttatacccggttttgttttgtagttgagggatagattcgaagcaagagttgagggtggtaaaataaacttattcctgctaggctagggaaaggcgcattatgctggacttgggactgggccaccgcccaccgcagtccaataattacggcgttaaagacctagacgaaggagtggtggaaaggaagcagcctcccagattcccacccccccaccatctctccgtaaagctgacggctttgggaaggcga

SEQ ID NO: 11971 - DNA, 1501 bp, Oryza sativa
tcagaatcaagcacggctttccttcaagcaatcatagacagcaatcggtcttcaaaaggaatagaaccaatttggttcgctgcttgcacctacacgctatggaaatcccgcaacaacagagtgtttgaaggtcagtttgacaacctacagcacatcacacagcaagtctcagacacccttgatctttggagcatgagaaccaatgaatcaaacatgcagaaaattcaatcctggtgtaccaggctctcctagtataagaacccttgtttatatctttgtaaatcccaccccccgttctcttttctttttatttttgtttcttctcttcttccttttcgtttttttcctttctgttctaggttaactataacctctaacttgtaacctgaaaacctcatttctattaatgaaatgatctattaatgaaatgattataaggtggagcgcgctctaccttcttccgtaaaaaaaaatcgccgtccttctcatcgcatcgtatgccgaaccaactaacgcatcccacggcaacaagcaaacagtataaatccaactattcctatccgacgtttttgctgcctcaaactttactcaggctgtgttcggtacccttagttaccaacatctctctctcgtgttccgcgcgcatgcttttcaaactgttaaacggtgtgttttttttcaaaaagtttctatacgaaagttgtttgaaaaaaatcatattaatcttgtcagggttatggataccatatatctaataatagttgactaaatctcgacaggacccgtcacataccatgtcttatacggaatctgacctcggatatggatgaagttccggataagaaaagacaaccagagttctacatggaaacgacaaggactactcggattgtattcatattggtttccttagttctacttggacaaggtgacacctatgagtataaatacaagaccccctaggaggagaggggatatagagacaatcaacatacacggacaacatagacgccataaaaccacaagcctacatacgccaagacaagccgccggatatcgacttcagcgataagcacggctagtcccctacggtgtcttcggatactgtcaggagagacgaaagcgctatctctgatctcgccgggcacggattcgaggagaaaggctactctgttgtcgactacgagtcagatcttcagaccgccatgtcgacaacagttagataggctactccaaacattgtactggtgtggttatgatgaataagatcaataaccggctttggccaacaggatgtagggctattacttgtcagataaggggcccgaacttgtataaaaatccccgtctccatctcttttatctcagtctcgcgtatatcctagtaccaacgatccccgtaccatgcaaataccggaatcgcgacatcaaacgtcgacaatggcgcgctaggtagggggagtttggtacttcaaggtttcgacgagatgggttcaaaaga

SEQ ID NO: 11972 - DNA, 1501 bp, Oryza sativa
caaagcacgcatgaaagatcatcattgtccttagcacagtgccggcgatctagcatatcttgagtattaaacctgtcattgagcaaaagtcaagcaaaaaccttgatcttcatgacacatctggtttttcacaaccagataaaagatcttggaggatggagagattgaaaattgagtttataaactctcctagcagaatacaattctgctctatcttaccgttgcttatttaacctatttgaccatatatatatacctaattaaaaaatacgtaaggtttccgctcccccccttcgtccgtcaaccccccccccccaccgcgactccccatccgttttcgtctctctctctcccccctcccggtgtcccgatctccacacgcttcccctacccgcggccttcttctccctagcgcccctcctctcccgcctccctccctccctcacggcaccccacatctatcccttgcggcacgctctccccctctcccgtgacatctcttcttcttggcatccctcctctcccctgcgttcctaccctcttgtgcgttcaagaaaaacggaacctcctcattcgggaacacgttttgacgtactcatccggccatgttcaccactagaactccccgttgccgtttctctctctatcggtaccatgttgttgttagccacgttcccattattctggttttcttcgttgccaaccaccacaatctatgacgagccacatcgtgggacacgtccgaccaccttactcacccccgtttggtcgctggagcaccgttgcccatcttccctcctcttctatttgttgtgttggctagggaagacaatgaacaatattattcgttttttcttcatcttttgttcttcctgcgcatttaaggaaaacggaatcctctcatccggaaacatgttttgatgcactcatctggtcgtgttcatcaacaaagctcgttgttgttgtttctctctatcaggactacgtcgttgcccgacctgttcatgttgttctggttttctttattgccaacgcccaccatttaacgtcgttgtttttatctctgattgcttcgattttgactagaaaacggaaagaggagatcgagtggatcaaaagctatcaacaaattttggagatcgagaaagattagacctttggagatcgagaaagattagaccggatttgatgggggaggattggctctgtcatcgtatggtcacgtgaccgtgcgagctccaccggatttgatggggaggatcggaaaaggtcgaggacaattgggggcaatctggaaaaggtcgaggacaatggtggaattcaggcagaggtagaggacgatggtggaacaatgaaagaggaaaaggaagagaaaataaacctgaccaaaccaaattttgtcaaacacatggaccaggaggtcattccacagaagaatgttacagtaagttttgtcatatacatggtccgggaggccattccacagaagaatgcaggcaaa

SEQ ID NO: 11973 - DNA, 1501 bp, Oryza sativa
agtaaacaagttgttaaacacatgtacaaacaacgttttctgaataccgaaaattcgcatcgagttgtgcgaaggattatcaaagagcacgaaattctcacgaacatcacaaagcatatttaacacatagcctagaagcacaacacggaatgccattttgtgaaatgacatagatcaaacttattagcgcgcccactaattcagttcaattctcaacttaaatccacagagaaaaatgggtaaatcgaaaccgctcggcaggatggaccttattcccacggagacctggcaggatttagctagggcacatcacacggccacgggaggcggaggagaagagatggttacctggaacgcgcggagccagtcggggtcttcttcttcctcgcccatgcctgcgcctccctccctcaaaactcctccagagccgactatggaaggcagcccactacgcggaccagccgagcgagcgagcgcgccggcggcgaggcgaggcggcggcggcggagcccgggtcgtcgacctgcgcagctgcgctcgaggagaaagagaggtcacgtgcgtcagagctgttgctacgaggccccgttccagccgggccggcccacgagtgtggtgggccaaacacgcgatgctggattaggatacggcccacgagtaagtaatctatgagtatacctttcctaatcgttcacgcccttgtacgggtggaaacctagccaagatccccatcgtcgccgccgccgccgtcgccgtcgccatcgccgccggcggccgccattggcagcagggaagaggatgatccggcgattcttgtacattgctgaccactgctttacaggcccctccctctcccacaggctacggcgagtcaacccatcacatctcttctaccccgatggccatccactagcaacgaaaccggagcgagcgacggtggaggtggaggacgctcgcctgcctccacccgccatggccttctgctccccgggcaccacggcgacggccatgggcatggagttcatgcgcaggaacgacggcagcatcgtcggcatcgaccacaccggccgcgccgtcctctacgaccccgccgcgcgcgccgtccgcacgctgcccgccctcgcggcgcccaagctcatgcccgtctcggccgccgtcggcgacgacctgtacgtcatggagacgacgcccctccccgacggcgccggctgcttcgaggcgctcgtacgcctcgaggataatcccgccgagtccgactccgacaagtgggaggtaggggacaactacctctggcaacccctgccgccgccgccgccgccgccgtccccgtgcgtgaacgcctacgccgccggcttcgaaggctcctcccgcggcatgatctgcgggtacgcggtggccggcgacggcgacggcggcacgcgcatcctggtatccaccacgaccaacggcacctactccttcgacaccgcgagctccgcgtggagcaaggccggcgactggg

SEQ ID NO: 11974 - DNA, 1501 bp, Oryza sativa
tgcccttaacgtatatataggagataatttctgagcaaactataatcttacatttcaacgatccatatgcccgcgcatgcatgcaggccgccttcctagttctggttaaagcaacatctaaaacaacaagcaccatttttttttcgaacattacttgtctagtacataatcggagaacaacacaaaaggctgcaacatgcagtctgcccgtacaactaaaagtataattgtattaaatacaactctatctcaaataggcatataatttctcaggaagttcgactagttgtggtgaaagcaacatgtaaaacaacagcacagtttgaaattttgttctaagcttacttgtacagtataaagtcgaccaagaacacaaaagattgcagcatacaattgggaaataaggggggataattggatcacacacctgggtccttgatttgtttctcaaatctttctacccaatgatcaaactaacctagctagctcctcttcttgatctttctcttcttaacatctgttacgagcaaagcgatcacctgtttgttcacaaaaattgtttgatcaacatgaatagagattataaaagaaagaagagcacagatgcgctagttccagatatatagaatgttaggaaagttaatctctcggctaaggaaatcgggagaaaatcacgcgttatcgttttccacccgttaaccagcgtgattagctaaatcaaatcacgattaaatttccttaattgcacgcgcaataatcggtagcgcttccaacgtttccttttggagcagcccccgattccctcagcgcaaaataaaaggggaggccggcccgtgagaaagatgacgatctcactcacggttccaatctccccgacatcccaaaaccctaatttcccgattctcagttgcactggaagggattcgtagtgctattcccggacagtgtaggtggcgaccggaaggccgctgccactccgcaggtgatcgccggtgacctcttcgggatcaagccggtgtactcactgctacgaccacttctacaccgacaattcgcgaggtggttcgaggttctacatcctctacatccaccccgaaccaagcaagaacaattgcaatggcttcaaacaacggtcagttatcctaaattccgcattagggtgatcatgttaggcttagcacttatgtcttagtagattcgcaaagtctacatagagtaccaattttgtctcccgaattcaaacaaaaagaactaacagaaattgggaagagtacagcccccaattttagttacttcttttccgaggtagaatgaaggactaaactcgcttttgcggctatacgctgcttccacgcacaagcgctcagctaactttctgagaaattacttatatatatagaggaactgatgttcgttcagaacacggtaggaaattaaaagaggccgctgttttgccaatatataggacaaaggcctggtttagttcttaactttttttttt

SEQ ID NO: 11975 - DNA, 1501 bp, Oryza sativa
tttttcattttctcggactcccagagtccagctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatggaaggatcaaatcctcacataaacataggccattttaggcgtgcacaaatcaaattccaaccaccttgatcggtaagtgagcaagcttctcgtccttgccttaccaggaacccggtttgtccgaccccgccccggcgttcccaactattggcatgcgaggtttccctgaaccgtctagttacttaaccagggtgtcccattccaccttgtggttgcactttgattatgttcgatgagtttcccacaggaatcggtccttatatgcgaatacgggacagtaccacataggcacaacccccgcatcgcgagttttcacaattcattttattttcaaacacaccgacaccacatgtcgggttttgaaggcttcacaaacccatttcccaagttttcgacaagcaacggtgtatgtgggatatttgtatacgcgctcagagagcacgaataccgaggtaccacaagggtggagcgacaaggaatcagggtagtatgacctacggaaattagtgcgactactgggtaggtccgtcgatttggcatgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaattgaaaacctaaacaaaagaccaaaagaaagatcctatttagactaattattagtgccattaaatagatctcgattttacggaattactggaagttgaacggagtcaaacggaagagcggttgggaagatatgaattttggaagtttaatttggattttctggtcaaggaaatgatttatcggaattttctggaatacgagaaatggtttatggggtttgtagaaataatattcccaagaatattattaacagtcactgtcatgcgggaccaaaggaaatggtttatggaattttggaataaggaattgatttatgggacaagggaaaaaggatttattaaatccctggaaaaagaaaaggatggaggga

SEQ ID NO: 11976 - DNA, 1501 bp, Oryza sativa
tacaaatactacagatctactaagttacctacatggctacatctaacaatatatatttatatagtaccacaggtaaaactctatttcatacaatgcatttatcatatatttagtcacgtatataatctacgaatattacctgaaatcgaagtttgaaactggcagggcttcgcctcttcttttcttctcctccccttctccttttttttttttttttgatgtggagaggttaggagggaatgggctcctcaaaggagccggctgggctttataggcggccaggcctgccgccttctgtaagggcggcaagggggtcctgccgccctttgccagggcggcaagagggcaggagggggcaggaggacggccgtcccgcgccgtccagcgcgccgtgtgccacgtcggcttgccgcccttgcgaagggcggcagggtctagttttgcaaattttttcggcgctataatatttctgtaaatattaaaaaaaaaaatctaaaaatacaaaaaattccaaacaacgcgagggtttataccctctccgccgccgggggaaggggaagagctctccgccgcccgccggtgcccgacattgcggcatcggcgagcgcgagcgattcatccaagaatcgatcgagctcgagcgggggctttcctccaccgcgatccgccgcggccacacctactcctccacggtcacctcctcccccgcctcttcttggttcttcttcaaggaacaatccctcgtcgaggtatatatattcatctctatgtctcgccgttgctcctctaccttgctctttcagttcttggctgagaactcgggattaccgaggaagaaaccagtgcgttctgtgatacaaaaaaaaaaaaaagaaattttgatctttggctcagttgcatgatgtctctacctgggcgcttcgaaacatgttaatccagcagattcgtgttgcagtttgtcttgtgattttgttaaacttaggctgcttgtttcatcaattgcctcgtaaattccaggttttagtttgtataaatgctgatgttttttttattaattgatttgtggaatattcgtttgttcttttggacaagcaattctaagattgtaattcgtttagtagtagatcacttgtttatcaattgttcctgtaaaccaagatactacatagtttgttacattaattcccttctaggtttgcaaagctgctctgtgttaactgatttcgagataaattaatatgtttctgcatttattaataattttatagatgaataaataggttacatacttgatctatttgtgaagataagcaaacgaaccgtgaagcccaaacatgtacatgaaaaagcgaaaagttttttgtttcgtcagtataaatatgcgacatgaattttccatcatatattcatgcggttcattatgatttcattaattttaatctagggctctggacaactgctacaccttgaaagacctaactagctctgctgtatttctcaa

SEQ ID NO: 11977 - DNA, 1086 bp, Oryza sativa
tattccggtgtgccccctccctctcgaatcgtcgcgacaagctccggtgaactcggccgccgtccgccgtccatctcggcctccccttcttcctcctcccgccggcccgcgtggctaccacgtaggcgccacgtcggagtcacctcggccgcgaccgggtcagcacgaccagcctgccgcctccccctccctcaaccggtgcgcgcggtccacggagagccctatggctgcgcgtgggcccgccgcatctcggtccatccggcgcaccgcccgtgcgccatcttcaccaaaccctagcgccgcccccgcgtgaacccattcctccatgaacccagccgccgacaggtgggcccgtcccgggacccgcatggtggaccgcggtccacccggtcggtctcctccccctcccacgccccattgggccgccctcctcgcggccgtgccggcccattaggctcgcccgagctgcacaagtccctcgggccgcgccaatgccacccgagacaagtctgattgacatccctccatccttttctttttccagggatttaataaatcctttttcccttgtcccataaatcaattccttattccaaaattccataaaccatttcctttggtcccgcatgacagtgactgttaataatattcttgggaatattatttctacaaaccccataaaccatttctcgtattccagaaaattccgataaatcatttccttgaccagaaaatccaaattaaacttccaaaattcatatcttcccaaccgctcttccgtttgactccgttcaacttccagtaattccgtaaaatcgagatctatttaatggcactaataattagtctaaataggatctttcttttggtcttttgtttaggttttcaattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgca

SEQ ID NO: 11978 - DNA, 1501 bp, Oryza sativa
catgtcaaatcatgataaatcatgatggggggtgttacgaaatttgtgcctaattgacactcacgattcgttgcaaacaaattgtaattaacaccaggattccgagttatactaccaccccttttgtgttcaaattgacagaatgcgcagaacgtacagagagaagaagtagaagaagaagcaagaacagagtgcgatgcgagaacgcgtaccgcggaacagagaaaggagacgaggagatcgaaggaagccgtcgtcgtctcctcgtcctcctccttctccggcgagcggccggaggaggctggggacggatggacgggcaggcggggaagggagcgtgtgtggaggctgtagttaagggcctgttcactttaataccaaaaaaaaccttactaaattttagcattgtcaaaattttggtatagttgctaaaattttggcaggattttttatatagttaccaaaatttggcagcaaactaaatgtatctacttttttttgacaactttaccgaaatttggtaaggttgaaaatgatatcaaattgaactggccctaagctaaggctgcgtcgagagaaacgagtggcgccagcacgcgatgcgcgtctgcactgcatgtctgcatggtttggttgagggggggatccaagccgaggcggctacgtgcacgcgatgcggcggcagcgtgacgacgagcgttttcatttgccctttttttttctttctttctttttttcctttttctctcctcctttttctgactcgatctcgatcggagctgacgctactgggtctctgtaggttgtctcgtccattggaagggacgaaataaagcaaacaaggtgatggtttgatctgctgttggataccttgaagataggcaatgaactgtagtttctacggtcgtagcacgtggcaccttactccctccgtccaaaaaaaaataaactctgggttcaccgtccgtcttatttaaaaaaattatgaaaaaaattaaaaagacaaatcacgcataaagtattaatcatgttttatcatctaacaacaatgaaaatattaattataaaaataaaatttatataagacgggctatcaaacgttcgacacggaaacctagggtttatctttttttgggacggaggaagtaagttttattgactcataagcaaccaatgctctggtacggagtgtgagcgtgtgcactgtgcataggatacactgcccggtttgcactggcctctacttgcgcttactccatacttgcaaacagaaaaatcgaactaaaaattacaaaacaaaaaaatactacagaacaatatacaattccaacggaatagctgacgtcacgatgatgtcgtcatgttatttatataccaaatctaattcctacgggatatcatatctgatacttacgataccatgctgacatcatgttggcgtcagctattccattacaacagtataccgttctttagtctcccaaaaaaaatattattgaaa

SEQ ID NO: 11979 - DNA, 1501 bp, Oryza sativa
aggaactgtaccatgaccaaataggttttctctaaaccaacctaccttgtgactacctgcgatcgacctttccttgtcgagtaaatatattgcatatgtattccatttgatattatgattctcatctctaatccaatatgcatcgataaaataaatccaatcacattagtatataaatagctgcaatttttagtgtgtacgagattagaatgacttcaaaatatacgacacaatttttatatatatttccagttagaaaaatacaagttcaaatatctgtaaattgaatatttgtttcagcatatataatcattttaagttgaagattgttattaaattaagaaacaaatgttaccataaacacttatgaaatttcaaatggctaatttgtaggaccattatgtattattaatattaaatggttccatgtagtaatagtacattatgtattatgaattctcattgttacatgttaaaattagtttcattttatccaatacagattaaaaatttaatttgaatggatgaaacatagcaaactatacaaaataatattctattccatgcgaaaagacagtgttgtttgctaagtaccgtcgaagtgagcttgataatatttgcaggttgatcaggacacatttcaccaaccatgctaaggagaacatcaccacagtttgtttggttttctctaatatctaatggaatccatctgaagcttacacctttttttaaagcttgcttatgcaaggaaacatataggtatatatacacacatggggagtggatagaagatgttgtatcacgcgtccatgtatcctggtatcatgctatttaacacaagcatgcttctggtacatgaaacaacgtagtgtgtatgcttatgattacactcctttaaaatgacggcacaagttagatcatttgcttgctgaactaaaatggtttaacccttcatttttgtcaaaagtgtgaacatcatgtcttttcccaaacaaaagcagtcattagtcatctaatcaaaagtagagaaaatagtatcattgtcgaatcctgacatccataatacatgtaattaacttattaacatgattttagttcattatcgttatcgaatgcagtgcctgtactccataaaaattttatttctgcatctgaccaaaaatcaccaaaaacggatttctcgttgtccaaaatctgaacgcttgctcgcagatatagtccaattttattggtgactattgcgtcaccaaaaatggacacgacgatctcaattttctaacactactggagaaaacatttttgatgggttagccaaaaaccacattagtctcggtttaaatagaaaccgggactaaagatggtttttttcccggtttaaaactccatcagccctgtatgatttttagtaccggtaaccaggactaaagatgagttttagtcccggttcattcacagctaggggctgtcagggggccagtgatcgttagtccaatccatgtgc

SEQ ID NO: 11980 - DNA, 1501 bp, Oryza sativa
gaggtgacagaggctgatattgataattcaaatttcttccttgatagttctagaagttcggttgaatattacgtaccaaatgttcagggataatctgaggcacaactgattgatcggcctgtacatgatggaccaagtgttcaggaataacttggttcacagtatgctgcattggccgattgtcaggtgttctcaatctcgctgacgcatgttgtaagttttgctgctgagtcggatgaactgtctgctacctcggctgtgcttgctgagtcggcaacggctgtgttgggtcggctattgtcggatttggcaagaacattgcagcaacttgctcctgagtcagccgattgacattttgcccagcatgttgtggttgttctctggtcaacaatctggggttaaccatctgtcttggtgctgattgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttccaacttcgtcttcagctcagaagcactacacttctgaaaagggggaataatagcaaggctgagtacaaccaccgtactcagcaagccacaccaacgatgcggacgtgcaaggggatacaaggaggggtttgtggctatttgcataaaggcggttgtaaaacattttatttagcaaacagtaaaactgttgaataattaaagtgacattaaaatctccactgatcaacgctacaccacgttgaacaggcccaaccaacccacctgtactacagtgcattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcactgtaagtcttccagggtttctcgtgaaccggtccttaattgccatgggtgcgactcgcaaaaccatgcacccacagcccaccattcagtcgtattttagttggataattacgaccatgaaaca

SEQ ID NO: 11981 - DNA, 1501 bp, Oryza sativa
agcgtcgatgataaatatggttcatatggatttagccgtccttcagttaaacctgatgttgagggttttaaagaagccactgagcaacttgcaacagagaagatttttcgaggttctgatcgagggcagaattggtggactgcatttttcaagattgaatcaacgatacataataaatctttgtatgtctctcataaaattgaccaaagatagttttgctacaaatataaaactaatgtatttaaggttctcaatatcttttttatacaaatacttaaattaggttgttgagtcaaaaggaaaaaaaagtctaatataaggttgttgctatgaaggtttacttgaaatatttgttctaaatcattcaacgtataataacattttgggtgccgagaggggggtgggaagtgaccgcaataacaaatatagtgcttacccaaggtttagcccctcacaaaaagtgaaagttttgttttttcgaaacatacatagaggcacaagtaaccgataattaatgagttcacgtgcatcaacaatgctctacgcaaacatgtgttaagacttaacaggtggaagtaaccgacaataatgaattcaacatgtctcgacagtgcgttacgcggaacgtgtgttaagggtgtgtgtagtatatgcacgtgatgtacgtacgtcttctacatgatcgcaacaaaaaaaagaaggaaaaatagattctcctattccttctatacaaggaaatactttaggaaagcccccattttccgacaaacggttatgatgggtcaaactcagccttatcatatagcaaatttctcacaaaaaaaattgtacattcaataccctactactatttatctgctgttctagacacaaaacaaaagcttatttcaaatggcacaaatcaatatatttttttgttcaagatcacagcctaccagtaggtaaattcagtttcacaagaaaagggtaagagaaattggagaatgaccaaaatacccccttcccctccatctatttctgtgtttgtgctcctctactgtctccatctcccttctcttctgcttccgatctgcagcgccttccgcctcgccggcgagcaagccggcgccgtcgacggcctcctctccctcccggacccgccctctgccctcctcccctgcgcgacctcctcgctcgctcgcccgcccgcccgacctccgtctccggttcgcgtccaattttgaggtatccactcaattcttctccccttggattgagcccgcgtggcatggattggggatccattccggactagggtttggtttctttgcctagagctgacccatccagcgtcttcctgatctctttcgggcgtcgtgctgtgcttgtagcagttcatagcagctttgttaggtctgcccccttaccgtaggcgctttaggtactagtttatcgatgaaattgggttgataacagtgatgatgcaatcctgctgttgttgttgatgagagcaggagtgaaa

SEQ ID NO: 11982 - DNA, 1501 bp, Oryza sativa
gccgacccccgcccccctagacctagggctcccagatctctcgcggatctgctctctccgttcatctcctccatggtgctgcgcctctccgtcggacttctctacgtataagctgggcttcctaactcgttcgttcgtgggtcctgccgtgtttgcgcagcgagctcgcctgcgttttgggggtcccagtttcatcttctctgatgaatttgtgcatgaatcgtcgagatttgaagtggtcgtgtttgatcgattacaagctaccgattcctcagggatgatcgatcgatcgatcgcggagtctactctgtgatcctcttaaccaaatactatgattaattggagcaggggcggaggcaaatgactttttgctaatcccactattaatacacattacgaatagaaaattgctgttgtgaacatatactttgacaccattatagttgaagaatggccccatcgatactaccactggtttcgattggatgaaccatccactcccacccaagccaaccctttcattttaacccgttgcttcaaccaataatccccttgggtctagatgttgctatgtgagactgtgagagagtagggcatttgtcaggagaataaataaacaaggtgtctatatcttcagctgatttttattaaagtatatatgatggttgtggttttaattacatttattctaccacaataagtccagtgaatcacatattgcttgtttgaggacaactgtttgatcttgcacgaatctaatctgttgaactagctggagattcagttgtatattttggaatcgcatattccttatctacagttctacacatttgcgcttgaggcgtgatagttatattttctaactgtggatgactatgtatgtgctggaagactggaacttattccatcgtaccaaagaacaagaaagcagctgatttatagttttgacaacttcgacagttagcaataagcccccttgggtctagtttgctcctgcattttggctgtgagatagtggagtattatcagtagaataaatgatgtgtctactctattatctataactgattctgttaaggtatatgtaggctgtggtttgagtcgtactgcacatttactcttccacaataagtccagtattatttatcatatcacttgtttcaagaggaccgccatttgatcttgcactaatctaacttgttaaactagctggagattaagttgtatatcttggaatcatatttgactatctgcatttctacacaattgcgcttgactatatgtacgctggagcttatttccttttgtctgtctgttgtgtttataccaatgaacaagaaagctgcttatttatagtttgagaacaactacagttagcaggggacttgtttttctagactgtgatgttcactcatgcttctcttcatatgaataatctgtaacattcattttctatcagacttgataatctgtatgccatttcatgattgtgcagcaaaaa

SEQ ID NO: 11983 - DNA, 1501 bp, Oryza sativa
cgatgtcattttcgcgtaacggttttgcgagaccgacaatatgttttttgcaaaaaattttacgtctcgaatattcccgagaaaaaattgaatgaaatgtatattttcaaatttaattatgctttggtatgtcgaggacgacgtagtgagcgatcgacgagcatggacgcggcgaagacgaccccgccggcggccggcggcgaccacggcggggaccagctcggagaggccggcgacggtgtacactccggcgcagtgcgccaccgccgacagcaccagcagcgccgccgaggcgcgcatgtacgtcaggagcattttctagcgcctaactgtcactgcacattgaagaaaaaaatggcatgaaaaagtttgttcgatacttggaactagtgttaattacagtaccattttaatatggctcgtagataattcagaacgaaaaagtaggtaatttaattatcagtaaagctttgccagcagagtcaccaagtatacaactttctttcagccatcttcagtgtgtactttctcacaagactccgctttataccagttgaagaaatcgttgaaagataacggcagcttgagctgacgattctattctaatcgtttgatctatggcctatggctgaaaagccgtagaaaattaaagaaaaaacatccaaaaataaatatacaagtaaaaatttcatatgttattagcaatcgaaaagtaaatactagtagaaaataaactcggaaggaaaacaaacccctcaaagtcaacataaaatcaagtttgaaataatttcaaattttggtcgtggctgataagaccaacgagcaaaacgacgaaaaaaattgttatctggaacgaaaaaaaaaacacggtagagattaatactgtactaaattttcaacggttgggtcaccttcaattaccaaccgaagcaagcaactggtaaagcaaatcaaagcaaaagatgctagtagtagatacccaccaacgaaagaagccgacgctcctccctccttcctacaccgcgtccaccgcacaccgcccgagggcccaacacccggtccacggtggaccgcgtccacagatcgatccctcgcctcgagcaagcaaaaaaaaaatccgtactactctacgtggcgtggcagtcgtcctcctccctcccacgtgagcctcaccgacaggtgggcccggggagaccgtggtccccacctgcagtggcgcgcgtggtcccatctcccaaagcgagatgagtttgctgctgcagaataaaaggcacccagaaaaaaataaaaaggcagaaaaattcggcggaattcgctgttggagtgagtattcatcgaggcaaagctcgaatttttggtactatccgattggtggcgaagcagcggcggagcgagagaaaatcgctgtaggaatcgggggagaaggaggagtagatagagggaggtggattgagctgtgggaggttaggttggtgattggtagaggaggaggaggaggaga

SEQ ID NO: 11984 - DNA, 1501 bp, Oryza sativa
ctcaagcgtgaggattatatctccaatttggacttgtttcggatacattccacatggattcatagtcatgagtctattttctatgctcaaagactggaccaattatttttccccgtaagggctatcaaccgaatacttgcgccagtcgggattcaattattatatttattttggagtatcccataagggataatcattcagatcagaagctattcatatgagctacacttggtctatattacccagaagatttgttactcgggagcatgtcacatgcgtcatcctttaaagggtgtcgaaggcatattttttggcctaagcctaatatgtctgcagcccatattttcaggtgtggcctgtcacgttcttttagggacttaggcactttttgcttaggccaaagtgcgcgtgatcaagtgcccaataccttaaaatccttttataccgcagttacttaattttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatattatggcttaggctgattatatattgtggtcattttctaggtggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttgattgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcatagggaataacttatatctatggaatatgtaataggtcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 11985 - DNA, 1501 bp, Oryza sativa
tcccatgttatatgttgatgatacgtacatataaatgcgtgtgttttaatggaattgatttacatttgtacacatggaatggagttactagtcacactacaattcgtacaaatgtagacattacacatcatcgatcaacccatgcattacaccaaacatgttattgatgttatacatattaaaatttcaatcatatttgcaaaatatgaggtagcgtcacaaacggttcagaccagacctcgcaatataccaatcacacaacccaaaatcaaaccatatgcacacgcatatacaacacaaacacatgaaatcagccatggcaatcaatgggcgtagacgaagcggtggcggcggcgctcttgttgtcggcgacgacgaagtagacgtcgctgcaggacaccctgacgttgtacggcctggtgtacaccacgccggcgaccttgaaccgcacctgcgccgccaccgccacgttgaatggcccgtgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggtaaacgccgagtttcctgacgacgagtgcgatggaatcaactttatgagtcgccggcttcgtcttcactttgggagctccttgattcctcgccgccgacgacttcaacaagacgaatcgtcgctgctattctctgcctgatcttgttcgcatcagcacgacggcaacgatggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatccataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgct

SEQ ID NO: 11986 - DNA, 1501 bp, Oryza sativa
ccagggcgatgctgggcagggtgatgctgcggacgccagaaaagtcgtagcacgtgtcgaggatggacaccggcggcgccggccggtacatggtcatcgcgctcctaaacgccgcgcgcagcgcctggtacgccgtcggcggaatccgcgagatgacggtggcggagtcgatcacagagctggcggagaagacagtgggcggcacggggagcgggcgtcccgccacgatgatggagcggaggagcaccctgtagaacgtcggcgacatggtgctgctgctcagcaacggcgtggagacgaaggtcgggacgagcgcggcgcgctgcggcggcacgccgaacatgatgaacccgaaggagctcgtcgacggcgggacgcagtacgagaacaccctgctgtactgactcgccgtctgctgcacgaaagactgtgagccgccgccgagagccagggttccggcgacgtcgtagctgaaggtgcttccctggtcggcgtgcgcgcagccgaagaggaagcccctgacgacgtcgtaggggcccagtgtgaggtcgtcggagctatacgtcccggtcgccgtcgcgccgttggcgtaggtgatgccgaactggcactgcgagttggccaagcagccgcggcggtaggggccgagccgcgcgcaggcggcggagctgcaagggacggcggcgtacgtggtcgaggtggccgggtcgaacagggggtcccgctgcgggtggcacaccagcagcgggcatggctggcattgcacccatggcacgtcgctgcccgagtcgatgatcaccgtctggctcaccgccgacgtgccatccggtgccgaattagtcgtcgccgtcgttcctaacctcgtcgtctataataacaaatcaatcaacttatatatgtataatagtagagaattgaagtacataaaaatatacgtagtactataaattcattcacatatacaggatgatgagatatttgttatatatatataggagtatcgagcaaggagatggggcttacagttagatggggcttttggccaatgccagcaccagtagcgacctggaggctacttaccacatgagtgtctccaccctcaacaaacttatgtggatccgcgccgtcgccggtgtcgccagcgagcctcttctggatataggcgacgcggagttggtcggcgtcgagcgccttgcccatggaggccacatcgtcgtcggtggtgctgttgtccgtgtccgaatacgccggcgagcatggcccggtgcccaagtgctgttaaccgacggttcgttacttggagcaactgtgcatatgacactagtccgttcgtcagaggtttaaaaaaccttcttatgaaaaactactccagtatgatgtgtagacggttaagatatttaattatttcattagaaaagacatatatatatatatatatagtagctctaatctacacccctctcttagaataactattctacacccctctcgcatcacggca

SEQ ID NO: 11987 - DNA, 1501 bp, Oryza sativa
gaggctacttaccacatgagtgtctccaccctcaacaaacttatgtggatccgcgccgtcgccggtgtcgccagcgagcctcttctggatataggcgacgcggagttggtcggcgtcgagcgccttgcccatggaggccacatcgtcgtcggtggtgctgttgtccgtgtccgaatacgccggcgagcatggcccggtgcccaagtgctgttaaccgacggttcgttacttggagcaactgtgcatatgacactagtccgttcgtcagaggtttaaaaaaccttcttatgaaaaactactccagtatgatgtgtagacggttaagatatttaattatttcattagaaaagacatatatatatatatatatagtagctctaatctacacccctctcttagaataactattctacacccctctcgcatcacggcatcacccaacccactcctccctcccgtgggcctcctcccgcgcgccgcccctcccctcttcctcccgcacgcgtcgcgtccctccccctcctcatttttctgtcgagctcccctcccagcgccttccccctctcgatcccctcctcctcctggcgcctccctccctccctctctctttctgttccctcctccccctccgtgtctctctctctctctcactcccgttccttcttttcttttttttttctatttttccaccaggatcgatcccttctctcttccttcttttctttttttttcctcctatttttccaccgggacctcctcccggcgcttgatcgatctcttctttttttatctcatattttccctcctcccaaggtctattctctttcccttcctttgcttcaccttaaaaagaaaactaaaaattaaaatagcaaaatcaagacttgaacacatgaccccatagtttataataagctctcctaaccaatttacccaataacactatgtgattaggggttatcgcttgcttgctttctacctctatataaattttatgagaacaaaccagttatattactataggaatcgtaccttgttactatgatttggtagtaatattatcgcagaagtgcagtaacacggtacgttactgcgaaatttataggttattactgcgaaatttataggttgttactgcggtttttacagtaacatcatgatgaaactgtagtaacagagaacatatgttattaatggtactactacaataccactacttgtgcatagctaaattattaaatctcaatcttgtgcaaaatacaagtgctaaaaatacatgtgcatatgcatagtcacaagttaacacaaagtgctaaaagtacttttcttcgttcatataaagatacatagtagcaagcttagtacaagtaaactattataatctaatctttaaacaataatacaatagtcttgttactacacgataatcgagacaacatgcttaacgaaactagatccatcatgactattttataacgttgttactgcggaaagtagccgt

SEQ ID NO: 11988 - DNA, 1501 bp, Oryza sativa
tagctgaactgaagaagtagtacgtagctagtgatagtgaagctagcttgggttccgtagatatccatatatatttaggcatgagcacggcatcggcaggcggcggagcgaaatcttcatcgagctggagtagtagtacatttttccggtggatcaaggcggcgaggtacgtagttgcggtggcggtgatcgtggcgatcgtggtgatgatagcgtacgccatcaagatggtcgggcgagagaggccgctggtggtgagtgtgaccggtcatacggtgaaggtgcagcggccgtcgaacatgtccgggaacctcaccttcgccttcaccgtcagggccgccaacaccggcggcttcggccaaatatactacaccaacatcaaggcgttattggccggcaggagcgcgtcgtcgccggcgtcgccgacatacttcgtcaaaacgggcctcttggacatggccgtgataccgcggctgacggccgtctcgcagtccttcgtgatgtccggcatcggtgccaacggggacgggacgatgagctccaaggatctcaggccctacttcatggacttgtacaagggcaacaccatgcgcgacgccgtgctccggcttaacggcacgctcatgaccgagatctactccggctacaacagcaccgcccgcaccgttgtctactgctgcgagcccatcttcgtcggcgacgacgacgacgccccggacacgcctgagagaccctgcgtggagcagaacgaccattccatcgacatgacaaataaaaaaaacatgctaagctgcgagctcagctagctcgatccatcattaattattcgatccttatctatatattttcatactaattaatttcttcgtcgttttattatatatttaattacgtacgtatgttccgatgtatccatctctcctgcctctctctatatatgcattccttttgcttgccgtttcctcactttacccacccattcaattaatgaaaatggcttcattttattcacgctaccagtaatatttctttttttccctctctatctctcatttttatataaactagaaaaaatacccatgcgttgcaacgggtaaacaagagcttagcaataaattaaaatattaggatcactatacattataattgaaaaggttaatgaaaattctaacattagaatcgctatatatagattataattagtgaaaatcttttctgggttttgggccgaaagctttccttcctttttagccctaggcaaatctactatctccctctgtttggcctgcttcccttcaaccagggagtagtggaaccgtaaacccaactcgcaccgtccactaccatcttcaacctcccgaagatagtcccatacggttgactgtcacccaaaatctcctgaagatagaaccatacggttctgtcacccaaaatttgttgatgatttttgaaccactcgatctactctttcccctttttttttccaaaatcagagcgtaaa

SEQ ID NO: 11989 - DNA, 1501 bp, Oryza sativa
tagagccttgtacttggcaatctctttctcactataagcatggagctcctcaaacatactcacaagctcatcataggaaatatcatcaacatcatcatcactttcactatcactacttgatgttaccttggtggagcctcttggcatgaggcaaaatggagagaatagtgatggagcctccttgatagctactccggccatgttcttcttcttggagcttccatcatcatcactctcgttgtcggacccggattgagaatcgaagctctcaacacttgagtcccattgaccaatgaaagcctcgatcttcttgccctccttcttgagcttcttcatgagcttgtatccaccactcttgttcttctttgatgacttgtcctcatcatcacccttggaaggacacttggaagcaaagtaccccttctcgccacactcaaagcatctcaagttggagagagtcttgttgggtcttctattccttcttctattggtgtttgaccctcttcctctctctttccttcttcccaagaggtcattgaaccttctagtaagaagagcaatctcttcatccaagtcatccttgccttcatttaccttgccctttcccttgtcttccacctcggtttgaagggcaatgctagtcttcttggatggtgatgctttttccatctccttcttcttcaacttgtacatgtcattggtgttgatcttgcccaaaagactagcgggtgtcatccttgacatgtccgagttgatgaggaaggtgacaaggttcttatacttgtccggtaaggctctaagcatcttttgagccacctcaaggtcggtgtagatggccccaagacccttgagatcattaactatcacatttagcctcccatacatatcattgacgctctcatccggcaacatggcaaaggtctcatattggatcttgaggaaatggagctttgcatccttgtactcactagtgccctcatgtatctcactcaacttgttccatatctcataagtcgtctcaaggttgctcactctatcaaattcgtcttggctcaatgagttgaacaaggcattcattgcttgagcattgagtagaaggttgcgatgatcaacctccatcaaggggcttcccgtgataacaaaacctacatccacaatgctccaaatatggaagctcgtagccttgaggtgagtagacattttaattttccaagtagaataatttgtgtcactaaacatgggagcctttcctacatggttcacctcgttcgacatcttctctctaggcggtaaagcccaatcaagagagaccaagctctgataccacttgtaggatcaacgatgttgactagaggggggtaaataggcgattataaaaattaacatctaatcaaaaataacctaagttgctagtcttggtaagggacaagtctaactaagcaactaagttaagttttgcaatcctagggtgcaagtggttcaaatatgtctctaataaagt

SEQ ID NO: 11990 - DNA, 1501 bp, Oryza sativa
tcaccttcctcatcaactcggacatgtcaaggatgacacccgctagtcttttgggcaagatcaacaccaatgacatgtacaagttgaagaagaaggagatggaaaaagcatcaccatccaagaagactagcattgcccttcaaaccgaggtggaagacaagggaaagggcaaggtaaatgaaggcaaggatgacttggatgaagagattgctcttcttactagaaggttcaatgacctcttgggaagaaggaaagagagaggaagagggtcaaacaccaatagaagaaggaatagaagacccaacaagactctctccaacttgagatgctttgagtgtggcgagaaggggtactttgcttccaagtgtccttccaagggtgatgatgaggacaagtcatcaaagaagaacaagagtggtggatacaagctcatgaagaagctcaagaaggagggcaagaagatcgaggctttcattggtcaatgggactcaagtgttgagagcttcgattctcaatccgggtccgacaacgagagtgatgatgatggaagctccaagaagaagaacatggccggagtagctatcaaggaggctccatcactattctctccattttgcctcatgccaagaggctccaccaaggtaacatcaagtagtgatagtgaaagtgatgatgatgttgatgatatttcctatgatgagcttgtgagtatgtttgaggagctccatgcttatagtgagaaagagattgccaagtacaaggctctaaagaaagatcatgcttctttggaaaccttgtatgaggagctaaagacttctcgtgagagactcaccatttctcatgagaagcttaaggaagctcatgacactctccttaccactacccaacatggagctcacattgatgtttgcatatcttgtcatttgcttgatgatagtgcttcttgtcatgctatatattttgcatcatctagcatatctacttcatgtgatgatcttatggatatgcctagctctagctctgtgcttctatttgtgatgtttcacttgtggttgtgaacaatgagctcaaggagcaagtggccaagctcaacaagagtttggaaaggtgcttcaagggtaagaccactcttgacaaaatcttgagtgagcaacagtgcatccttaacaaggagggacatggattcattccaaagaagggtaaaaaaaccttctcaccatgctcctcgttttgttaagagcaatggtaagtattgccataagtgtcgtggggttggacatatggcaaatgcttgcaccggtggtaagccttctaagacttgcatgtttgattctcactacatgcttaggaaggttcatgatggtcgcattgttgctagatatgtgggttcccctatacttggtggtaaaaagaattccatttgggtctccaaagctttggtctctaacctccaaggacccaaacaagtttgggtatttaaaagagcttgatcttcttttat

SEQ ID NO: 11991 - DNA, 1501 bp, Oryza sativa
tggggccatctacaccgaccttgaggtggctcaaaagatgcttagagccttaccggacaagtataagaaccttgtcaccttcctcatcaactcggacatgtcaaggatgacacccgctagtcttttgggcaagatcaacaccaatgacatgtacaagttgaagaagaaggagatggaaaaagcatcaccatccaagaagactagcattgcccttcaaaccgaggtggaagacaagggaaagggcaaggtaaatgaaggcaaggatgacttggatgaagagattgctcttcttactagaaggttcaatgacctcttgggaagaaggaaagagagaggaagagggtcaaacaccaatagaagaaggaatagaagacccaacaagactctctccaacttgagatgctttgagtgtggcgagaaggggtactttgcttccaagtgtccttccaagggtgatgatgaggacaagtcatcaaagaagaacaagagtggtggatacaagctcatgaagaagctcaagaaggagggcaagaagatcgaggctttcattggtcaatgggactcaagtgttgagagcttcgattctcaatccgggtccgacaacgagagtgatgatgatggaagctccaagaagaagaacatggccggagtagctatcaaggaggctccatcactattctctccattttgcctcatgccaagaggctccaccaaggtaacatcaagtagtgatagtgaaagtgatgatgatgttgatgatatttcctatgatgagcttgtgagtatgtttgaggagctccatgcttatagtgagaaagagattgccaagtacaaggctctaaagaaagatcatgcttctttggaaaccttgtatgaggagctaaagacttctcgtgagagactcaccatttctcatgagaagcttaaggaagctcatgacactctccttaccactacccaacatggagctcacattgatgtttgcatatcttgtcatttgcttgatgatagtgcttcttgtcatgctatatattttgcatcatctagcatatctacttcatgtgatgatcttatggatatgcctagctctagctctgtgcttctatttgtgatgtttcacttgtggttgtgaacaatgagctcaaggagcaagtggccaagctcaacaagagtttggaaaggtgcttcaagggtaagaccactcttgacaaaatcttgagtgagcaacagtgcatccttaacaaggagggacatggattcattccaaagaagggtaaaaaaaccttctcaccatgctcctcgttttgttaagagcaatggtaagtattgccataagtgtcgtggggttggacatatggcaaatgcttgcaccggtggtaagccttctaagacttgcatgtttgattctcactacatgcttaggaaggttcatgatggtcgcattgttgctagatatgtgggttcccctatacttggtggtaaaaagaattccatttgggtc

SEQ ID NO: 11992 - DNA, 1501 bp, Oryza sativa
agagtaagtttataatcagttgccagtaaattaaacatcagacgcataacatgtgcaacctagcataaatcggcatgatggatgctcaggaactgcgattcatgaatagacgtgaggaatatccgtgactgatgaaccctagctcacacacatcggaaccaacaactcctccaccaaatcccgtagaaatcatgatgcgccaatcccccaaatcaaccctgctaaactccctcgaaattcgaaccaaaacaattcatccacccccaacaaacccccgcaccgatccgaaattccgaatcaatcacccgatccccacccccacccccacctcccccggcgcccgcagcaaccaccgcgcgatccccaaatcaaactcatcagacaccccaaccatggcacagccaagccacgcgtcgattcgattcgattcaccaccaccaaatcagcccaaaattgaatcggaaagtgggacgacgagcgagcgagcgagcgagacagacctgggtgcctctcggcataaccgtgcgccaccgccgccgccgagggatccaggggacgccgccgccgccgcctccagcgctgaagaggggggagggggagggggggaagggtggggatcggatggcttcgtctcgtctcctctcgcgtcggggatttttttttcttcctctcgccttcctgtcctctcctctcatttatctctcagtcgtccaatgtggcggggcctttttgcgatacggtccctgtactactcggttatacctagtccaaccttgccgcgttttctttgttctttactcggagtagtttttttattttattttatttattttttttggaatcgccttgcggttgccgcggtttcagacatgccgctttatttgacgtgtctccctgttttgagtgtgcagagaaattaattgcaaaaatagtgttttttgacttgcgttttatgtgtttctttaagcatcagatagatcgactttgttctagttcattgattttagttaagtcatcttattagtgtttttttttctggttaagatgttaaggtggttgttcagctcacttagcatgtgttcttttgttgcatatgattaattaactattagctataaaaacttgaattgattaacataatttttatagcaacttttctatataattttttaaaacatgccgtgtagcaatttaaaaagcatgcatacaacgaataatggagcagtaaatgagaaccatgagtagtagtaggtctgagcagacccttagtaaggtggtgtttggatccagggacttaactttagtccctatatttagacattaatttagagtattaaatatagactacttacaaaactaattatataaatgaaagctaattcgcaagacaaattttttaagcctaattaatccataattagagaatgtttactgtagcatcacataggttaatcatggattaattaggctcaatagatttgtttcgcaaattagtccaaga

SEQ ID NO: 11993 - DNA, 1501 bp, Oryza sativa
tgcttcgactatcatccaccctgctcggatcgccgccggttttgctcttttggttaggggtgtgtgggtgcagcgagtctaggcggatctggcggcgatcggtgtgtacgggatctcagcctcctcgttggggcggatggtcgccgggccgccgcggcggcggttgacccgaatttcgtgtcgaattttgcgtgttagtgattgatctcggtctgcttcccctcccaattacttggaggttcttcagagttggggttgctggtcttcagaattgggtggggcatgagacaattcgcatggcatacacctctttcgatttgtgttgtgcgtctgtgttagttgcgccatcaacgaccgggaaggctttggtgaaatgccgcgccccactttgtgggggaatgagagatgattgcggtattgacgcgtgcagactgatcttagtgctttgttgtcgttgaggttcacgaaacatgagcgaagaggtgaggtgaagaataaccgagacgtttatggtccttatcatataatcttgtctaactagtggtaactaccatgatgccatggaccaataacagctactagaactcataagactacgtatccatccacaataggaatatacgcgtgaccaactcttagttagcacacttttttcctaaatgcacacatcatgtttcagtcctttatggtaacatcttgaccttcactgagccatttctctgaccaagtggcaaccttgagtccttgaccatacaagaagtcgagtgtctcttggtgcgccgttggccaccaacatagatagacaatgccattcatgtagcaggggcaaggaaactcttgtaagaatctgatatcatttggttaatgaaatgggagaggagctcctctctttctcaaaaaaaaaaaaaaagtagcaggggcaatggcagcatctccattttttttcccaggatgtactcatctagcttgactttgtaagtggttttattccttatgatgtctaatagggttatgcactgtttctccgcccttttagaaaatctagtttgctaaaaggtatgaatgctgtttttagtagaacaaaaatgattgatctagcatggcactgagtaagtgtgttatgttatatttctcactttgtaaagcaaacactcctgaaagtactatactctattgcccttgtaattcatttagggtaatgtagaatcacagaaccagctaaattaatgtcctccatgtctcccccattagtaaaggtacaatgcgttgcttcaacttaccaggcttctcttttgctctcacatgcgcatgcatgctgtttgtttgagggtgatgtgagtatgcttaattatcatgacggtattatttatttcctcatgctcaagtgtgttgcttccacgatcctcatttctgcttttttaaactacatttactaccataagattatttatgttcatttggcatggtttctccaggatggaaatgttctttggcagttttc

SEQ ID NO: 11994 - DNA, 1501 bp, Oryza sativa
tttattgtgataaccatgaaaaccgtatagttatcacggttttaataaataagaagatttactacacgtgttagctgcgtgattttgcaaaaccctggtggggactcacggcagatttggtagtaattgatgcctagagcctggcattaaaattttaaaaaacgcgtgaatcattcagatattcaaaaaaaataaatttgtgcagaattcaccgtcactggcaggtgtttgttggtcacctggccagctgcatcctaccctgtaatacgcgcttccttcctggtacagctcttcccctcctgcatatgcacgcagcagcaggccagcagccgccaattaaaaagaagctttaagattaagaaaaaaccacaacaataaataaataaacaaagaaagaaacaaacgaagaatttctctcataagggttcgactctttataggagcgattttttcagaatttaacggctttgtcctttcaatggtatgcaacgtatccgtcgacagcgaaacgcatgtggtgatttcgtcaatcttcagatttgccggcccagtctttaaagatactcatagggatagggtttacatgtctatgttcaaaaaaaaaaaagaaaaggaaatctctccgtttgtttgaaatattttggctccccattcccaagtctcccccatccccatgtgagcacgcgtctttgtgctgtgctgcctttttccatttcctctgcctacaactcctcctcctactcatttcttcctcgctgcagcagccgcttgcttcctgtgagacttcgtcgtcgtcttctccgagcttagctttcaccaaaccactagtacttgtactcactcttcgcttcccaaatcttcctcatcaattgctaacacgagtagtctatcatcattaactcgcatcccttccccttccattgctcattgtctttccattcatacggtgttgtgttgttgtggcccaagaagaagaacaagtacaccacacgccattactcccatctctcttactcctcctcgagtttgattgattcgagtggtcgcatcgcatggtaagaaaaccatttccatccatctgatctgatgaatctgtgggctgttctctggtttttgaatcggtcagtctgcgtttgccggcggtgttggatttagggttgagtgaacactgaatttatctcttcggattccattcgattttttttatgcttcttgcttcgtgttctgtgggcgacggcgacaaggttttgctgctcagatttgttcttcccttttgctttccaaagtttgaatcttgggtttgggtcccgggatttcagcctattctctcgctgcctgtctgattctgatttctttccaaagacgggaatcttcgagcacaaatctgccatttttatcctcgtacgcgataaagactagctctttaattttccgatccccacctcgcgatgctgatttggttccttcgattcgcagatcagaaagtgaggcgatcgatcca

SEQ ID NO: 11995 - DNA, 1501 bp, Oryza sativa
ttcagtcaagtttgtactactaattctgtatgcattgacgtgttccagttttacagtacgaagaatcagattgttcttacaaaattttgaaagtagagacatttaactcaaacatattatataatacgttcatccagtaaccaagaagatcaattcgatttcaatgcgttttagaagcaattagttaaagtgagaaaacaagcaagcggtagggcagcaaacctacatactagtagctacagtagtacagtgacaagacatggatcggatgacgatcaatcaaagctctgtactaacgtataagtgcagtcccaacccataatgtctataagtagtgtctattatgccatgtcaataagacatcacagcagaaagagaaaatcccctgtgtacccttgaaagttcacctaatcccttctataccctgaattttgctcaatcccttacatacccctgaattttagtttggatcccttccatgccctttccgctagttgaccgttagttgaccgttaaattcttatgaaaaagtccattttgccctttggtataaagaagcatataaattaacagataaattaacagagtatattgttggagcatagaaatttattatatgagactattatgtttattagatagttatgcaccatattatttgcgataaatatacttttagatatgacataaaaaattaatactaatttattagttattaaaagattttttttagcatatgtgttctgaagtaataaacaaatctgttgtattactatgaaaacacatatgctacataaaagaacttttaataactaataaatacgtatcaactttttatatcatatgtaaaagtaaatttgtcacaaataatatggtgcatcacatactcataaatataatagtcttatccaataaatttttacattccaacaatatacttcattaatttattatgtttctttatagcaaagggcaaaatggactttttcaaaagaatttaacggtcaactagcggaaagggcatggaagggatccaaactaaaattcaggggtatgtaagggattgagcaaaattcaggggtatagaagggattaggtgaacttttatgagtacataggggattttctccaatagaaactacactctacaacccatggtttcttaaagtggatcattaataaatacatcatctctcttctctaccaatcagatttattcttcatctattatgaagacactattatctcccaatgcaaaacttgacagtgtctagtgcataggttctcgtgttgaagctatgtcttgcatgagacatagtttcttcctctcttcactctctctctctctcttaattaatatagtgccacataagttaaaagtcctatatggcaatgtagttaatgccataaacaccatcttaggtggagggttaggactgccctaaccagctagctgtatcatatctgtatgtgtgttgcttgatacttttgctgcaatgca

SEQ ID NO: 11996 - DNA, 1501 bp, Oryza sativa
tttgatggcaattatatatattctgaaatgtcagatatagatattaatttgtctttttcattcagtgcctgcatgcatgtgtctccggcatttcatttcgtccaggctagcaatctactccagctaataagctagcaagatggtcagataactgactgtctggctcccactaactaattatgcatccacagtccataactgtagcacaagtactcagcaaaacactcatgttgcgcgcggtcaatgctattgctacctagtacctacaggatacttgtaattggttgggctactgagaggagaggaggaagaagagctagcagggtgaagaagaaatactatactccattagttcatttttatagtgtttgtttattttaaaatctattttcaaaacaataccgcgcttatattcacgttcgtacactcacttctaaactcatacacatacactttatctctatgagtatgcacttttaaagactggatcaacgtatcttaaaattgaagaagtcaccgtagacatgaatgtgagcatttgtgctaagtctaggaattgaacttgagtgagcaggtcccatactcccatcccaagggatcttttgagctcagtttcattctttgagaataaattttaaccatccatttgaatttatcatgacatatgtttctaatggatataaaactaatgttggttggaaatactttgaactgtgagtctgatagtgtaagttctatatactaactatactaccttaattaattattgatcaaaatcttttgagtttaactttcggaaatcaaagtacgtcatgtaaaagtaaacgtaaacggaggaagtagaataatttgacaatcaaagaagagagcccaatacaaatacaaaccaaaccggcctcataacgtgaattcacatttgggcttacctgataagcccataagtttgagaggcccatgttggtctatccggtcgaagtcggacggaataagttcactttggatccctctatttgtcgtccagtctgattttcatcccttgatcgcaaaaccgggtacgataggtcccccaacttacgaaaccgtttaaataagatccctcggcagtatttgaccccggttttggccgaggtggcgcctacgtggctaatttgactcggtcttcatccgacgtggcattgacgtggcgcttacgtggcaattcaatccaaaaaataataaaacctatgggacccacatgtcagtttcacacacacaataaaaaaaaatggtggggcctacgtggaccccacctgtcatcctcactacagctctctctatcccccctctctctatcctctctccttcctctcctctctatcccgctctctctctcctgagaatggcgagcggcggcgggcggcgctgaggggtggcgacggagctgacaggcggcaggcggcttgtggagtagcggcgagcagcggcacacgcgcgcgtggcgtgggcgctggcacggtggagg

SEQ ID NO: 11997 - DNA, 1501 bp, Oryza sativa
tgggtcgttatggcattgaagtaggcaaatgtctataggaatatatttttatccaactaattatttgctgatctcttcagtttttttgttaatgcctgagttcaagttaaatcgactagcatgaataagatactttgtgtgcactggtattcatacgaagttatctgctgctctgctttgttttcagttgtaatttgtaggctcaaactggcttcgttattcttgtttttccagggagccgcggtggcatatgttgctgacatgttttcaacaccggcaatctttgtgaaagctgtgactgatattgttgatggggagaaaccaacagccgaggagtttctgcagaacctggttgctgtgacagcagctctggacaaggcagttacagaagtggttgatttcatcagtgggaaatgcatatcggatctttgaatgatgaagcttagaaacctgttcatcaaatccaagctctgctgcttcaatgcactatactatactacatcactgctgtatgatttttcatggggatgcgtatacaatttttaggttcccctgaggccctgatcccccgtatgtacaaaattcttggcaattacttggatcaatagcgtggaattttgtagaatattctgcaaaatgtgcagtgtaatgaaactaaataaggtgatattctgtcaaactaagataagtggtgggcggtggagttattttcttaatagagcattgagaccatcttcattgtttgctctacgattggtaaactgtgaaaaaaaaaacccgaagaagcaataaacatagtttacgtgtagaccttttatgtttgtattcttagtgattaaaaaactcatgctagagaataaatacgatgctataaaattcaaacagtggtgaagaaaaaaaagaaaagaaaaacaataaaacaagaggcaatctgcttctctcactgtctctatgcactagaggtagaggagcaattaagcctcgtgttgtgattggttggctggttggttagttggcgcttttatcgtggtgcctgttggcatgcctgaacctgaagagtataaattgactcctggtagttttgccattggtagatacagcccttgactctgctgcctcttcagttcaggtactgccctctcctcttcctttactctgctctctttttctttatttttttaggacccttctgcagtagtactacatgtttgtccagctgctgctgctgctgctatcagtttcttgtccttgtgatacataattctggtgtgaatcttgctctctacaaattattgtgcacatgaatcttgctcttcagttcctatgttgcaaattctagcacattgcaaaaggttttcgtcatggcatgaacagaaatagttttgcagtacataattttgtcaagtttgctgaagaagctctgaaaattccttgcacattttactaggacaatcgatttccctattttgtttacaatgaatggcagattgatcttgtcaga

SEQ ID NO: 11998 - DNA, 1501 bp, Oryza sativa
cgtgtcacgcttggaaatgaagtctttcctattagcgtaggacctccgtcttaccaaattttcttcccacatgaagtacatgtgacacaatgcgtcatatttaacgaagtcgtgtgtctgtatggaatagctttttgatgaatgtcattggactatctatttcaaaatatataaacctagttactaaattagacaccacctaaaacttttaatcatgacaatcatttaatttcaccatattcttttaatttaaaaagtctaaaggtatatatattttaggattgagagagagtaacttattgtatctgatagacacatttaacaaatcccaaactaacacagaagtacaatcatatatggaaaaataagcagatagtaattaaatacaaaagcatgaatcttcgtgaggccccttcatcacttcattactcactattgatgtatgatgtgttaacattggtaaatgcaaatgtgatgtagcagaaaaaaaagaacacctggcaagctcaaaagaaaagatttaaaggaatatataaatagacctttatcaacttttcgcttaggaccactgcttcctttactatcttttccaaagcatctcacaaaactttagttagtctactttaatacacctccaaagcttacatctactttggatctgtttttcttttagataatcagctttggatcgatcggcaccatcggatctttttattttttgaaataagttttgcatcgttaaacaatgattgtaccatctcacttttctaggtccggacagaccaattcagagtttcagatatatttgttcatctcgacgaaaccaaaataaccaactaaggcagcatgaaattagtgcacaatcacacgaagaaaataccgtgcaaaacattaaaaaataatttgtgcagtcctttcattttataggcggtttaaatttttaaccgcctatgaagatggctaagactgctgtcaaacaccgcctataaatttgggtgattctaaagagtggttttcttaagaaaacacctaaaatatttgattttcagaggccctctgaaaatggaaacaggagattatggataccacatacctacatggcatggattgtctgattacaagtaggggtagttcatgtatagatattatacggataaaggcccaagttacgtgattccttatgtattaaggtaataacttaggagtccgagtcctatactattgtaacataggcaatacaataccgaaccgtatgaggtgaggtattttcattgtaatcctagctcctccgactatataaggagggcaggacgcccccaaggggcataagactttttccacaatcaatacacccggcggacacaatccccgaaacaggacgtagggtattacctctcaagagagagggcctgaacctgtctaaagctttgtgtctgtcccaatcgcacttttcgagctcatacgcaacccccaattcatattgccgaaaactagtttcgac

SEQ ID NO: 11999 - DNA, 1501 bp, Oryza sativa
cgtaagccaatttcgaaggcgtattttccacgtgtttcgaattgcagaggtgcgcggagatggagcatcagccttaattcggaaaggaaatgaagactgagctggtgatcccctccatttggaaacatatcatatcattatcactacactaaggtaaggaaagattggactgattaccaaaagaaggagatcaggttggcagcactgtgtcggtcaccagccgccacggagttcctaaatttttttccccaagctctcgcgccgctctcacgcgagcggctcgggagcgaaaccctagccgcccgcgccgccccctcccaacgcctccagccacctcgccgccgccggagcccgccgccggaaaccgtgcggccggccgggaaggcggcggcggggaaaacgtgccggcggcggagcaacccctcggcgtgggaggcggcgcgacgcacgcacggcggaaggcggcggccggagcggccgcggggccgaatccggtcgcgccggacgcggatccggcctccccgatggaggatctggccccccgccggccagatctgtagaggggcggcggcggcccggcaagacggcgggcggcctcgagctcgcggcgacggcgatgcggcaagtcggcgggcggcccgagctcgcggcgacggcgggcggcctcgagctctcgacgacggcggcgcggcaagacggcgggcgacctcgtgcttgcggcgacggcggcgcgacctcgagctcacggcagcgggggcgcgactcggcggaacagctcgcggcggcggcggcaacgcggctcggaggagcagcccggccggcacgcagcggaggctgaccggccagacggctgctggtgacggcggcgacaatcgtgcccgccgtggtgctcgtggcagttggcagcgtcgtcggctggcaacggtggcgtcgagttggctgcttggtggcggaggacgacggcgcaacggtttgcggaggcggaggctggcatcgatggcagtggcgacggcggccgtggctgtggacggtggcgacgtcggcggatgcgggttgctagcgaggtggctgggcgttcggcagcaacggctgcggtggcggtgaccgtgtctgcggtcaccggaggcatggcggactcggatggctagccgagggcgtggcagacggctgcttttggccggcgtggtgtcgtttggtggaggggtcggagaccggcttggcgcagagaggcgcagccgatggcagtggaggccggctcggcgcgagaggcgcgggcggcggaaatggaggccggcttggcgcgagaggcgcggccgatggagggaggctggaatggcgcgagaggcgcatccggtggaggaggccggtttggcgtgagtggcgcggccggcggtggaggaggcgacctaggtgtgaggaggagctgccagtgggagtggcgcggtcttcggcgcacgaaggctggccggcgggggacgccggtgcaggggttccacatgtc

SEQ ID NO: 12000 - DNA, 1501 bp, Oryza sativa
gtcttcagactcgttgaggtattttccataatatctatagatttccttaacaaatacgggaacaatacccgtccatcatggtataccgtatccgtatattctatgagtcgtaggataggaggtatgccttatccgtaaccctgacagagatcacttggaataggactcggctgtgttcggtaggtcgaacgggatcgagtcggaagagctccccgactggttcgaatccaagtcggagagagaaagcttgccgaagtcatcggtgacgagctcaaggctaccaaagacgtatgtctgcccgggtgggaagacgaagtcatcgacgcttgatggagatcccattccactagtcggtgaagaaatcgacactgccctacctggcgcgccaactgtcgaaactagttttcggcaatatgaattgggggttgcgtatgagctcgaaaagtgcgattgggacagacacaaagctttagacaggttcaggccctctctcttgagaggtaataccctacgtcctgtttcggggattgtgtccgccgggtgtattgattgtggaaaaagtcttatgccccttgggggcgtcctgccctccttatatagtcggaggagctaggattacaatgaaaatacctcacctcatacggttcggtattgtattgcctatgttacaatagtataggactcggactcctaagttattaccttaatacataaggaatcacgtaacttgggcctttatccgtataatatctatacatgaactacccctacttgtaatcagacaatccatgccatgtaggtatgtggtatccataatctcctgtttccattttcagagggcctctgaaaatcaaatattttaggtgttttcttaagaaaaccactctttagaatcacccaaatttataggcggtgtttgacagcagtcttagccatcttcataggcggttaaaaatttaaaccgcctataaaatgaaaggactgcacaaattattttttaatgttttgcacggtattttcttcgtgtgattgtgcactaatttcatgctgccttagttggttattttggtttcgtcgagatgaacaaatatatctgaaactctgaattggtctgtccggacctagaaaagtgagatggtacaatcattgtttaacgatgcaaaacttatttcaaaaaataaaaagatccgatggtgccgatcgatccaaagctgattatctaaaagaaaaacagatccaaagtagatgtaagctttggaggtgtattaaagtagactaactaaagttttgtgagatgctttggaaaagatagtaaaggaagcagtggtcctaagcgaaaagttgataaaggtctatttatatattcctttaaatcttttcttttgagcttgccaggtgttcttttttttctgctacatcacatttgcatttaccaatgttaacacatcatacatcaatagtgagtaatgaagtgatgaaggggcctcacgaagattcatgc

SEQ ID NO: 12001 - DNA, 1501 bp, Oryza sativa
acgcacttctctttatttttctcccctattcattttctctatgcattaatgatttagtaagaacaaatacacttacatatagatagatactccctaaataaattcacttttatgcgtgaatctcgacatatagcccatacttttatatgataatttagacatataggtgaacttacttttgggtggatgtagcaattaatagaattaatatagtatgcacaccacaggtggtatatagtatattaataaagtatcattaaaaaaagaaaagaaaagaatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacgatggacgtaagtctttggactaattgaagtcccaaagtgagaaatcaattagtgccaggcataagagtcagagctagagacagaaaggaaggatgtttgcttgcttgagcccacaattaatctcacttagcttagctagctagctgactcgatatgatcgatcatgcatgcatgctaatgctatggtctttgtgtacttgtctagtttatttatcacttaaattaattagccccgttaaataatattagggctctctcttcctcttctcctataaaaccacccccaccatagccgtccatctaacctatcatccaaattaaacatactcttgtggccatcgtctagcttagctagcttcttcctcctagctcagctaacgaacgaggagtagtagctaggaagagagatcgaga

SEQ ID NO: 12002 - DNA, 1501 bp, Oryza sativa
accaggattgctagcatagacctctttatatgtaactccaaataagcagccaagacacgaatttccattaaagaaaataatcagatacagataaagaatatgaagttcaatatcggatgttattcaaacaagggagaaattttagttaccataaggaatacaatatctagttaaagaatgtagtaggggaatacaggagatcagttactacaaagtaattaggaaattatgagatagtaaagacaaagattctgaaatctaagttaagaaagaaattacaaaagattggaagaaaatattgtctaggaagatgttgaatccaatagtaacatacaaagatcattcatcagctttattccgaagatatgagaagaaatttgaccacttcaatgttgagaagaaccagaaggtcataatttaacctcctcgacaagtatcatcgctacacatatatgtgcaaggaagattgaatcctagacagaaataccctataacatgtttaagttattaagtgttggatcctcaaaccttgaatcacatgagattgaatcaagtgatctgacgctgtccaggtactgcgcttacctggtggtgttccaaccggatctcctccccgactacagtgagaatgcggaggacctgttccaggacatgaagacggagctcaaggatatgctcggctgttaccactactatttctctcgaggccgtaagcgggccaacgccatcgtcaatccatcgccggctaacaacaacgacgacgacaacaacaacagcaagaaacagggaagcgtgcgcaagggcgcagagttggccacattattgctacaattacaaaaggacatgtggaagcttctggcggaggtgtggacggagatcgtcgtgtacgtggctgcgtccaacgaggtggagcgtatcatggcgcacaggaatgtgctatgccaaggaggcgagttcatcaccgtgctttgggctctcacgacacacaccggcattacccgagatcgccacgaaatcgtggttgaacaccacccgtagtaatcccccaaattaaagcagcacaaattcgatcaatattattggggtccatgtccatcccaaggccctagctatatatatattatgtgtatttgcttgctttcttaattatttgcttaatttggatgcatatatatgcatgcatcaaagtgattgtttttcctactctttctttaattctttctttcttttgttgtaataactaatgtctctactactgtaattgcgtgagtacgtgtgcttatagagtgtgctactctctacctatatcttcatgaattaataatataattccatgcatttttattatgtccgtcggtcggaaagtatttctaacgctgcatatgtatcgtacctagtactgcagtgcggctatggaaattttcactgagctaggtggaaggggaagttagaggaaattcatagtgtgatgagacaaagttggtggcgcaagatgatggaa

SEQ ID NO: 12003 - DNA, 1501 bp, Oryza sativa
tgatgcagttctattaaaatatactttaacttcgatcgcattatcctgtaaaaatggaagcaacaaatgcctataggggggccaattaggatatagtatctacaacatcagtcaatcagtgatcatatgaaatgacaaagccattgatctcctaagaaaacctgcagaagttgtgaggttgtgcaagaaagctacctccatagtccttgtactcagggtcgacataggaatcagggaggacaaacagaacaccaggaagccctgtcatacaacacatacatagtgcatcagatacatgaacacacacagtgcgctaaaagtattctcattccaggtatttataaaaccaaaacataggcaaggaacaaaccttccagcttgttggacgtctcctcatcgatctcgcacccgaaaccaaagtatctctcgcaggagacgttgtagatcttcttcttcgcctcctcctcactgcagcaaacacaaccacataagaaatcgacctccgaaccaactaactggaagtgaggagcaaatacatggcaaggttagcacaaactgagagacaaatcggcggagagagaggcttcaccttccgaggaccttggcgagggtctggatgtagcagtcaatcatctgctgcttggtggcgccctccccgcctggcttgtccatcacgatgagccagtgctcgtagtcgcacccggggaacagcggggccatctccgtcggcgcgcggtctccgcctcctcctccgccgccaccggaccgcatcggggagtacccatcgccgcccggccgccgcgcgaacccgcgaaggaagccgacgcgcgagaccgcggcgacggtggggcgcagcagcgactccggcgcaccggggccgccgcggcggaggagagcggaggccgagaaggaggtggcgcggcgggagaggagcctccgcgcggcggcggcggcggcggcggccatcgcggggtaaaaccctagcggagtgaagggagaagggacaacgcaacgaaggctggggtttggaatcgcgaatttaaagctgcgtggcgttgaagtgaggttcgtgtttagatgggcttttagtaggccgtatttgaggacgaatgaagcccagtgaatgaaacatcacactggtggctgatagtactgagcaatgcgagcaatggcgtgtttatgaagtttcaggatgtcttttacgacattattcaaatccgagtaatttacaggtcgaaaaattcaaactcaaacgtgtaggttacagatctgtaaaaaggctatatactccatccggtttttaatatatcatgccattaacttttagacatttatttgatcatttggcttgttcaaatcttttttacaaacatacaaaatataagtaatacttaaagaacttttaatgataaataaagacgcaactaaatatatgataattgtataaactttttgaataatatgaatggtcaaacatatcacaaaaattaatgatatcata

SEQ ID NO: 12004 - DNA, 1501 bp, Oryza sativa
tctccaatagacatgttcttcatggcgctcatcaagccctcatcacctacatcatccaaattctcgtgcccctcttcagagccattagtttcatcaaattgaacatcggcggtttcttccacaatacctttgttcttgttgtagacccggtatgccttactatttgaggcataacctagaagaaacccttcatcacaccaactttcaaatttggttagtctaacaccttttcgataaatatagcagttgcaaccaaaaactcgaaaataggcaacattaggcatcctcccaacaattagctcataggaagtctttttcaaaagacgatgcaaataaagcctattgattgcatgccaagcgatgtttatgtgtgacatcccagcagcttggtcttggcttggcccaaccatgcaagcgcagcaacagcccaagcaacgagtgagcagcagcttagacactgtagtatcgcgtgtactgtagcacgcgagtcactgttcaccgaatagtaccacctcgcctagctagcttgaggagcaccgagatataaggatgtttgcctaaacacgtgtaacaccgattcttttgtgtgaaaagcgatgtcacgccccgaactagtctcgaccggaactaacccgtgacgctccaaattaacctgttaatcgataccagtcccaggaaacagtgctggtatcacaggtgctccttgctcctgggagacagaatatcacagtagaagtaggcgcgacttgggaactaggccgaaaccctaaaactcatcgtagccggtttgctccttgctcctggaagaaccgctccaaattaacctgttaatcgataccagtcccaggaaacagtgctggtatcacagggagacagaatatcacagtagaagtaggcgcgacttgggaactaggccgaaaccctaaaactcatcgtagccggtttgctcctggaagaactcctcattagcaggattcgcttcatcttcttcagcaactggggggatatttatatagagcaagggtgagtacgggagtactcagcaagccaggggaaataagtgtttaatgcaggcttcaaggaatggctgatgtttttgcaattgattttgtttgaactcttttctaaaagcaactaagtgagtgcttctcaaacgacacagatgagacagtgcgtctcgtccggtcagagtatgtgcaatgtatcagtctttagatttgaacaagattggcacccggccaaaagctttttaaacggccacccgggccaacacttttcaaacggccacccgggccagcaactttttaaacggccacccgggcctagctgatcccatcagctgcaggttttccaaacatcgaacccagtttcactacagcaatttcacaagcagtagtcaaacaaaactacgctaggaatcacctcacatccgcccatgaccgtgggcacggctgttcgaacagtttaatgacctctgcagagggggtacactttacccaca

SEQ ID NO: 12005 - DNA, 1501 bp, Oryza sativa
gtccctatcacatcggatgtttggatactaattagaagtattaaatgtagactaataatataattaattgcataaatgagagctaattcgcgagacaaattttttaagcctaattaatccataattagcacatgtttactgtaacatcacataggctaatcatagattaattagactcaatagattcatcttgcgaattagtttagggttatggaatgggttttatcattagtctacgtttaatacttctaattattatcaaaacaaccgatacgacaatgactaaaatttagtctatagatccaaacagggtcttactcttatgacctcggaaggcagctagcacctcaggaatcttggttgcttgccgtttgccgacgccttcataagagaactcgatcacgattataactccatcttacttcttaatatgtccaattatccatgcaatcaagcatctagagtgctatttaagaattatcttctccatgttcttaaatcaaaaggctcaattaataaaggcaagtttttatattacacataaatatgggtgcttcctcgagcgtatatcaattaatgcttcaagattagcacccatattatatggctctctcattttcataatttaagtcattagttttattctaataaaactaatataggtttgatcgagtttataaaaaaaatacaccaatataaaacgccaaaatatttccacaaacacaccatgcatgatatatgttttaatagtgtatttatttaatttattaatttagatgttgtattcatcaaccatctcggtcatcgttaaatgagtttgacttagaataagactagctaaaatgacttacgagatgaaaaaagagataaaaattgttaactctttactatcttcatcccaaaatataagaatttaaaatcggataaaatattttctaatattatgaatctgaataggtagcttgtctagatttgtagtatcccatctagttagatacttatattctgaaatggagagagtaattagtaagtagagtaataataagcatctgccttggagatatgatcaacaacaactctccattattttgtaaagttattccctacgtaccacatgcacgccatatatataatgcctttaatgccccccccccccctatatatagtcgaacagggagctagctagacttggcacagcacatcatcatcagtagcacagcacaaatacaggagcggcccggctatggcaatggcttgtgcagcactagtgccgttgctactgttgcttcttgttgtgctctctggctctacatctctcgctgaccacagtgcaggtgtagatgaggtcaactacatcgtggtgctaaccagcagctggctcaagccaaattccgtctgctccagcctgagtaccgtcttaatttttctctctcttcttcctactctctccgtaattttttcatatataagtttatccaaatttatagaaaattagcaatac

SEQ ID NO: 12006 - DNA, 1501 bp, Oryza sativa
ccgcgccctctccttcctcttccccggcccgaggccggagagattactcccgcgccgtcggcctctcgtcacagcgcccctcctcttctcggtgatgtctctctccgttctccctcctcgctccgtctcctcccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtagcttcatcgccgttttccccttctcccgccgccggttgccgccgccgcaatccgccgccgtcgagcaacccccggcaaatccgagccgttggctcgtctcccctcgtcccgtgcaaccgcccggtgtgctcgctcttgcccgtatcaccgtggttcgctccgacgctcgccgccgccgcccgccgtccattcgcggccgggtcgtcgtctacctcccgccagcccacgtggccgccacgtaggcgccacgtcggcgccagctcagcctagaccgggtcgagccgaccccggtcggtccctccccgtgcgcgcgttccacctcgagccgtgaggctgcgcgtgggcccgtcgcatccgcgtccaccgcaaaccgcgcgcgtgcaccgcgttcctccccgcccgcgcgcgtgcgccgcgtgctccctccgcacggtgagccgagccgctgacaagcgggtcccacccgggaccgcgcgtggtgagcccggtccaccggactctctctcctccctcccgcgcgcgcgcgcttgggccgtcttgggccggccggcccgttaagctcggccgagccaccccaaatctcttgggccgcaccctagccgcccgagaaaagtctatattccctccctcccttctttctttttctttttccaaaaaggatttaattaaatcctttttcctttagaccaaaaatccgataatcttagaaattcaatatcttcccaaccgtaactccgtttgactccgttcaacttccaaaattcttcaaatctcgagatctatctagtggcacgcttagaggtcattaatagggctttattttcgctgtatgttgagttgtcccgtttcgcgtgtagtttcggagcccgaagacccgcagtgcgaggatttcgaggatcaagctcccgatctcgagcaaggcaagccacctttgaacatcttgagcctatatttgaaatttaattatgttgcttgcaaaatattatgcattgataggatcacacttaatctgttgtcccgtctgcaaggcagattggcggactcacctaatttgtcgcatttgatccttccattgttaattgctataccatgtccccttgtaaccacccagttgcgcctcgatactcgtgcactctgtgcgagtatc

SEQ ID NO: 12007 - DNA, 1501 bp, Oryza sativa
aaattcagaattaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatactattatatgagagaaaatataatgatgctagccgcgcaatctgcgcgggccactatgcttgttttgctatataagagtatacaagggtgggatttcacttaaatatataagagtggcagcttagcagattgggatttcacttaaatatataagagtggcagcttagcagattgggatttcacttaaatatataagagtggcagcttgagggcaaaatatttacttcatgcaagcgatccaccagttactagcactgcaagttactagcatagtggtttgtaaaacgctctcgcatcgccctcccctaggggcagcacgggaggcatcgaaccccggccgccccctccccccatcttcctcctccgcctcgccgccgcctgagcggccgccggcaaagccgcgcggccacaaggacggcggcggcggggctcctcgttcctcgtcgagctcgcctcgtttcgggcggcaaggggagcagcccaggacggcggcgacggtgaccgctaaatccgcgccgcctcggccggatctggcggtgtggcagctggcggctggcggcggagacggagacggagacggcggcggggatggcgacggcgacggtagaggagcggctgggtcgacggcggcggggatggcagaggctgggtcgacgccggcgg

SEQ ID NO: 12008 - DNA, 1501 bp, Oryza sativa
ccagttctttactacatcttgatctctcatttaatctaaacaacaacaacaggaaatctcttcctcccttaagaagatacttccaggaagaaaaaggaaaattgtaaaaaaaaaaggttaaatttatttttttcgttactatacgtagaagttgaatttgaatttgataagcagcatgtacgtcaataatgtaataagttctagatctattattcttttcatcagatcaatcaataatgcataagaagttctagccaattttattaatattatatattgtgggtaattattaaccttttttaattatataaacttagctttctaattaattactagtaataggttaattattattattgttatataattattttacttctttttgcatatgtgtgggttaaataattttacctttgatgacattggtgcaggtgcagggtagtacgtgccatagttaagatctccttctatggactgctgttcgtagttagttgacaccggcacgtcgtcggccggctgcagcacgccggcgaccgagccggagagcctccactgtatgtagtcggcgcggtgctggtccgaccagagcatgccgtcgacggtggacggcgccgccctacccttcgccggcgaggagctgcacggcccgtacggtcggctcaacgggacccagttggtcacgttggggtgtgggctcactaacatccacgtacaacaattatatttattaatatgatatattaataataattattattaaatgccaaaataattcgtttcatttgttagagaggttatttaccaaggtaaacaaggaagaatatatagttaaaagttgcccaacgacggcaaagtctagtaaagagtcgagaagataaatgatttatatttataataggaggaaatagtataattgctctgacttaactacttattaaaaacgttcaagttttaatcttaggtactactacctctgtttcatatataaagtcgtttttattttttttctagtcaaagtttttttgtttgattaaatttgtaaaaggacgtagcaacatctacggtcccaaattagttttcaattaaatgtaacattgaatatattttgataatatatttgttttgtgttagaagtattgctaattttctataaatttggataaacttatatatgaaaaaattacggagagagtaggaagaagagagagaaaaattaagacggtactcaggctggagcagacggaatttggcttgagccagctgctggttagcaccacgatgtagttgacctcatctacacctgcactgtggtcagcgagagatgtagagccagagagcacaacaagaagcaacagtagcaacggcactagtgctgcacaagccattgccatagccgggccgctcctgtatttgtgctgtgctactgatgatgatgtgctgtgccaagtctagctagctccctgttcgactatatatagggggggggggggcattaaaggca

SEQ ID NO: 12009 - DNA, 1501 bp, Oryza sativa; identical to SEQ ID NO: 11980

SEQ ID NO: 12010 - DNA, 1501 bp, Oryza sativa; identical to SEQ ID NO: 11983

SEQ ID NO: 12011 - DNA, 1501 bp, Oryza sativa
aaaaccatgggacccacatatcatttacactagaaaactaataaataaatgatgggacacttgtgagacccacatgtcatcctcattcccattttctcctctcctttctttcttcttgttttctcttctcctcgccattcggcgccgggcagagcaggcgagttcaccggccccgcctcctccctctccatcgctcaccaccagcctccccgcttctctctcttcgtcgcctaccgcctcctcctacatgttcctcgccaagcagtacaccacgacactcctgtatcggtggtcgcgacagagagagctcgcgccacaggagtaagtggtgtggagcagggtgtcggtagcgggcacaccacgtcgccggtcaaggcttcctccgcccgtgaccttttccaccacatgcaccaccatcacccccaccttgtcggcgatgatgatgacgaacttcctctatcctcccctttccctcctccgcttccccttgggctcctcctgctactatacctaggctcttgctccacaggcttaccgtgcgtcgcctcccacgaacatgccgcgtcgacgacggcatgcacctgccgccgcaaccctttcctctcccgcagcgtgagctctctccgccgcaaccaccggcaccactcacgcattggaaagagatgagggaagagaggggaaaggggaagaaaaagttgtgtttcactaacatgtgggtcccacattgactcagctgccacatcggataaaattgcagtcaaccagagtcaatactgcctaaggatataaagtgatccggttttataagttgagagatgtcatatgtctgattttccggtttagggcgattttataactcagcaacaagataagggaccttatgtgtactttttcctttcgaaagtgtgctccgtggaggtggtaggcccgttttatacctaacccttcctttctcgcttttcctttccttctagctgtggtgaggtccagttcgcaaatatctggcccattattggtcaatggtatctttcgccacatagagtatcggtcaatgggccacacgagtacttcttttcctctttggaacgggccacagtgccacaccgggggacgtcgtcctcaacgcagccatgacgcccagccgcgtcagcgtagggctcgtcccgccacctccaccgactggtgggcccgcgacgacagcgccgtttataggccagggaggcggaagaggacgcggttcgtgcgtgcgccaccgtcggccgtgcgcgagccaagccaaccaccacgagaaagaaactaacatcggaggagcgactagcgagccgtccttccccaacccctcgtcgtcgtcgtccagcctgagaaccaaacgaagaaaaaggagggggaaaaaaggggaaaacggggagaggctaccgacgcggcaggcccggccgtcctcccctctcccggtcagcgcgccgcggctttttgcgtccggagaggcggagacggggcgcca

SEQ ID NO: 12012 - DNA, 1501 bp, Oryza sativa
cttcatctttatctttaggagaaaagaacaacatctaaaccatgtcgatgtggaaagtttgtgaagaaatcatatttttgaaagtgttaactgaagaatgcaaattgcagaagagggatcaagttggagccttggaagacgatgtccttgttggtgatcatgaccttggagcgcccatgcggccatgtctgacctctgatcaccatcaacagcccatttcatgcccatcatggcatgatccacgaccacaatcctggaacgtctaatcaaattgatcattaagccgcacaaggcttgaactttcttcagtccattcaaccgaaaggtgagataatgcgacgtgggaatggtaatgcgtgacttcttctctacagaagttcagaggaaactggcgatcacagcaactcagctttacaaattcatcatcctctctcagttgcacttgttgcacaagacagagttatcaattaatattgtgtgcactaactcctgggatgtaatttatttcttaagatattgtgtacactaactataataaaacattttgcattacctggctatgtggcatgatccttgcaaattattgacaaaagcatgcgttgagaaaaaaaaaatctcagcacgagctcgtcgtgacgtgagtacggcaccaggtgtgaaaggtaacatttttactgtcagctgtcaatactactgtaaacacactgttactgcacgtggaaacgagcttaattggacagatttagctcgggtgaagatgatcagaccttgatagaatcagcgcatgtggtcccgaaaacgagtgcgcttttccttttcaacatttttttctcgatatgaaagcatgatggagcctgattttttcttatttattggatatataattgatctcgacagaacgacctttttgcccgcttctcctgcaatatttattcgccatattgtgccgaagaaacgatttactagacagtaacttgtcctacaaaatgtgctagttgttcttttcttagtacagagaaaaagtattgcttagagcaccagatgcacatacaacatggagttgattagtcctggcaataattaaggttacttctctcacaagccctgatcactaccatgtagtatagtcatctcccaatcagcacgaacacgattcataagactttcacaaatcagggttaggttgatttgcaggggacaccgccttttcagctttattttcctttcacctcggcctaaaaccggccgtgccactgccgccgcccaatatataaacacatctactctctcgtgcactacaactaccactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagaca

SEQ ID NO: 12013 - DNA, 1501 bp, Oryza sativa
tactttatgcgtgacttatctttttaattttttttcataatttttttaaataagacgaacgatcaaacgttggacatgaaaatcagggtttgtctttttttttaggacgaagggagtacgtatgttgctttttgtcttgtactacctataaaacatagcacgagaccttggcctgggtcagcttgcctgaatcgggagaccctgaaacaccccacccctgtgaccaagcagcaacaatgtgcaccgcaggtcccttcactcacatcagttggtgcttgtcggaaattaaagaatcctggccaacgctagaacagcgagcgctacgaacccgcaaagcacaaacgctccgggccaacggtcgaattaggcgtgcatgattcaaaccccccccccccccccccaaaaaaaatcatatcaaattaaagcagaactaattaagcgtgtcacgcgctgtttggtccgtctcgcctccagtagctgcgtacggcgggggagaagctacagcgagctacgtggagtagcttgattgccctaggagccgcacgaggaggggcgcacatgacgaagcgttggacattggcgaggaccttgtcgcggcggggtttattccgcggtactactgtctggccattcgcacggcacgttaggtgcgctccccacgcgcgcgcgtcgattagccggagccacgagggccgacacacatcaaccccccctactactacgcgaccgcggcgtttacggcgagcaaccagatgagatgaccaaatcgcgcgcgccgcgcaacgcagcgacgggccggcttgcgcacaccgcagccatgcccgcccgctgtctcagggggatatatgcaaggcgaactgcttagcaaaaggccagggaagggaagagctagcgcgcgctagctcgatcggggaacagagtaacatgcgtgccgttgtgcgtccgtccattagacgaacaccgaaggcgtgtccttttgcggaaagcgagcaaccgcttttgcattgtgatgcaccgctcgccgggctggctggttaagatttgaagaagagctagcagggtcatgtgccggcatgaggggcgagccaagtaaaagccaacatgataaccccatcgatctgtatagatagaaacgagcccaagttgcgttttgttagtttcgggcacccacagctagccctggctgtgctgcgtgctctgaaaattttactcccactactccacacaagtgtaaactcctctttggatgattggagcatctgtgtacgtattaagcctgtagtttaaactccaaagtgggttcaggtgtccacttaaacgtagaataacaaacacccacccatcgtcggagcctgtttctagacatacagatgcgatccgtccacgcataaagaaagaagctagggggaagataacaagagagcggaatcgaaagggaggggaaaaaaaaagaagaccagcagcagtagtacgtggtcccgatcgatcgaacaccggagat

SEQ ID NO: 12014 - DNA, 1501 bp, Oryza sativa
ttcgttatgcatcatcatcagcatgcatgtgcatgttcggtttgtgcatttgtaaactgttattttaaacgtcaacaaacatttgtttatttttctttcaatattttacagtacttcattcgtactactaacaacttaataatacacagcacatattgatatatacatataatggggtgatcattgtgtagtttggagatgagatagaatgacttagactatccctctttttgaatggaataatcatatcatctatttggtatgagcgtgtagtggtcctgcattttttaggaatcggatggtatgtggggtgatcctacgttattaagggatcgaccgggtgcggcccacatgttagtgagagagaggggtggattggattagtccaccacttaggtgtgatcatatggaatattttcttttggggaccatctcatcccacccatgctcaaacaaaacacctacaaacaccctgacggtccagcatgatccatcaaatccatcgaactaggtgtgtatcgcatgataacataatatagagatacaaccaggcccacatgttagtgagaaagaagggtgggttggattagtccaccacttcttgaggtgtgttcgtagggaatattttcttttggggaccatctcatcccacccatcctcaaacaaaatacccttgcaatccaacacgacccatcccatccatcgaaccaagtatgtatcgcgtgataacataatgtagagatgcagcctaacccacatgttagtgagagagagagggggacggattggattagttcaccactacttaaggtgtgtttgtaaggaatattttcttttggggaccatctcatctcacccaccctcaaacaccctgacggtccagcacgatccaccccatctatcgaaccatgtgagtattgtgtgatgacataatacggagttgcagccagccgtgaggcacatatgctttgtacacgacgagacgatggttaggggatcaaacgagacggacggcgagaaacgcattgtcactgtcacatcgtcgtccgggtctatctcaaagtggtcccggtccacgtcggcatccgatccacaagtcagcgaggggcgcgtggccggcacacgccgagcgatctgggccctccatttcgccaaccctagcggcctcacccgagtcacccctataaatgccggtggccgaggcgtgtggccgccacactgcgatccccatccatcttctccgcacacgctacactcctctcgatcgatcttctcctcccgtctcgatcagctgattcgcccagcctccggtagcttgcttgtgcttcgtatccatggatcctcaccacagctcccacgtccatgccggagccgccactcctaactgcacgtgcaggttgcccaaggaggaggatctagccgccgccgtcgtcgtcgtcgacgtcgaggcggctcctcactacacgtcgttgaaggcggccgaggccgacgtcgtcccgag

SEQ ID NO: 12015 - DNA, 1501 bp, Oryza sativa
gtggaattagtgattttctggaaaatgaatgtggccttacagactttgtggctagctcattcaaccatccacgattccaccgtgtgcaagagttatttattttgtcagaaaggtaagagcaagctgttgaactttcggttggacgctctgaagtctgaactggtcagtgcgtgctggaatagccatacggtgcaatgctccgggtggacttctagtctaccccaataaaatggactaaactgggcatatgaagaaagagttggacaaacataactgaaagagagttggggttatgtacgtatgcaaaactgtgttctgctgcctgctggtgtggatatttcgccaattggatacgaggcttgctacagatcaagctgatctttttccctattcatagacatggatgtgcaaaagcattgtcactaattactgttctggcttggatatcaagatattgtatgtcttgatattacagaatccgtatggttttttttttaagaaatggcaggagctctgccaatcaaataaaatgaggataagagagtaccaaggccggcccctttagatcacaccagtatatgttcatttacagttgttatccagaagccataggaatcagataagggattgttgtcaatatgcagaattgctaaattaagaatgtaataagaattggagcgctaactgtatattactcttagctttatccaaagaatactggatgtattgtaccatctaataccccctaaacaacacccatatgcataactaaaaaccagaaaacaacaaccacttggatatctttgcaatcttttgtgcttcttgcgggggaattaatgggcctgtaatatcataaaccatattttatttctgagagtacataatattattatccatgacaatggcgcttgtaagttcattaatatccattacataaaaacaaaagggtaagttcaagtggaataatctctccaactgtaacacaaagaaaaagagagatactcctagatgagttttcagttcaggctatttgattccctctgtcttccttgtgctcacacacctagtactacacgatgcaatgctcttttacaacaaatattcttgtggttgccacgtgcctcgccagtaatttagaggctaagattctagctatgcatcgaaccattcaagccttcccgtgtcagccacgcgctcgggattaatataatgctaatatgtccatcacatgagctggatacatctaacttggccatcctccttttagcacccatttgcactaattagtccatccttgacttggaaaatttgtggtctttccatagccaaatgacaaagaggtgacaaaggattaggtgagagtttacctagcttgtgccatgattataaatagctatgagcccctagatatgttctgcccataccattaccatagacgcaggtctttctcaggaagtgaagagagcagcagagttgcatatcttgcagggtttatcaggta

SEQ ID NO: 12016 - DNA, 1501 bp, Oryza sativa
actcctagctggctacccctctctcctagcaaaaggcaaatttatctactccgtatgtacaattgtcaaacgtacgaggagacagcaaaaatatatatattgtgtgtatgagtgcgtgtcgccattagtctaatgggtgcgacttgattagtgattacccacttgggaaggcctcccctgcattatgccattaacaaaatcaactcgacgacgtcaaaaccaggcgactcaccccggcctaggacggagacgatacggtgggcgccgtgcctgacctgacgcgcctcgttccctctcccgccgtattcaaatgcaaatggcagcacgggctgggctccatgtacatgtgatgtgagcatagtttattttttgatgctccctccttgttgatgcagagataatgagtatctcgtgcgtgtttctccggaaaggtaatttaatcccgatttggccttggatgggccagagatccacgtacttggatgttggctcccgctttattttcttttcctttttaaacactaattacgtttttttttgagaagggttttaaacactaattacgtaagctggaccccgggtgtttctttcagaagtaagctgggccaggtgtgcttagtctctggcaggtcaggtccatctctaccccagcacacgcttgctgttggcacggacggcccaaaatgctgtaactctactcccgggacaaaagcccccaaaacatcgaaatgggctgagaagcccatttttccaatccgacgagtgacaccacatctgacttctgaggaataagttcactttagatcccttaatttgtcgtctagtctgaaattcatccctggatcgtaaaaccaaatatgacgcgtccctcaactagcaaaatcagtgcaaataagatcccaaggtggtttggacgacgatttcagttgacgtgacgcatacatagctggtttgacttggtctttgtcctacatggcggtgatgtggcattggaagcaaaatataaatttcatttttataaaaaatgtgaggcccacatgtcattgggtcccatcctcctctcaatctccatggacggcggcgccgaacatgggcaacgcccgctcatccccgacaagtagaggatagcggcggtggcatcctgccccacccccaccacgaggggaggagcggcaggacgagggatcacctggcgacgtggaggcggtggtggcatcgatgaggagggcacaaaatctgctggtcgtcgtccgccttgacctcgccgaacgtgccatccccattcaacctccctgcacccctcgtgtcgtcctcgacctccacttccttcccccgcccgctctcgagcaatctcggtgggctgaccagatcaaaggcaacagtggtggtgagttggggtccgtagcggtaacatcagcgaggagggagtggtggttgagggggagacaatcatcgtccgcttcagcctcgctgaccgctctatccttagctagcctccccg

SEQ ID NO: 12017 - DNA, 1501 bp, Oryza sativa
atcgatagctagatagccgaaccacgaaaattgaagaatgtggtcatgatgtgagcatacattaacaaggccaaccaaccaacacctatacctcttggaacaactcaactcctagtagttattaatttccagacaacggcaaatcaagccagcaaccagcgagttttgaccagataccactctgtacgtcgccgttctgtgcacaccagaaacaataacaataataatctattaattttgcgctgtactctctgcaggttaataatacttatcgttttttataagggcacggtctctaaagaacaactttaaccattattttttattataatatgtataaaagtgttaacaaatacatgattttattaaagtactttttaaaactaatctatacatgtaatcaccatatttgaaagacaaatattttagaaatgatttataatcaaagattcgagtttaacctcactcttgtttaaaacgataactattatgagtccggaggaagtatacgtagtaccgcgggtaaaataaatgtaaattgtacacttagatcttcttccattccgagataaatgcgagctggattaattccctctgcaacaacaacagcaaatttccttgctaattctgaagagagtgacactgcacgggaagctcagctcttccgggcttcaggcacacgcaggaaacggattggtctccctgtcaacgaaagctccgagttcccaacttatacgcaaggaaatgagaaccctgctttccacagcttgaaagttctcatcaggctttgcaggctcaaacaaactcaggggatatttagtaggaagcaacctgtggttggcaccttctcctgctatttttgccacacttttacacttatcaagaacaatttgcagaagtaaaaattgaataaaatgtaccatccccattatttcctacttattgctttgattatcaacattctccaatacaaatgtttatgaagctactattagaaatataaccatataaaaatatttttcatgacagatctacctatatcatttattcatttttctcaagctaaatcctaatatctctgtattcacgagcataaaaattaccattgaattcgcagacgctcgcgtcgccctcccctgggatggcacgggaggcgatgaacccggccgcctctttcctcccactcctccccctccgcctcgccgccgcccgagcggccgccggcaaagccggccggccgcaaggacggcggcggcggggcctctctcaccgacctcgcttcgcttcgggcgagcaaggaagcgtccacgacggggcggcggtgaccgccagatccaggccgctccggccagatctggcggggtggcggctagcggcagggagggcggcggcaaaggcaggggcgtgcggcgccgggcggtggtggttgaaggcggcggggatggcgatggcggtagggatggcgtcagccgagggcgcgaaggtggcagcggtggtcctt

SEQ ID NO: 12018 - DNA, 1501 bp, Oryza sativa
gtcggccatacatgcacagtcgcaaagtggtactgtatggtacgagcaacaccctgacgaatcagggaaggcacaaagctagcggtcgtccttccactcgtactcgtactcgcccatcatgcttgctgccatagccgctaatgattgtggaactgcacctccacagcgcttaaaacgaacgtgagctctcggacaaactcgccttcttcacatgttgtctcctctctgtctgatgacagtgtgtggtgactgtctgactgacactgcatccgtctctgctggaagaaacacacgttttcagacaggctaatgataggcgcacctaccgcgcgttttcagttgaacacttgcaatatgcaagacgattaattatgttgtagcaagtttatttaatttccagattttttttcttttttggccatttggccatttgtgctgcccatcttaaagaggacatgcatcgcaaatgcccagacaagcattttgttgcttccagaaaatatatgcagtaagaaatactcgtcacttttgtttgtcaattactcaatttgcaaaggctttacttaaagcgttgcagggcagcacgagatatcgtgctaaaccactaagcatttttcatcaggtggcaaatataagatatcttaaaggtgctagattagccggcttctcagcgatttaggaggccagtgcccaatacgatctcaccacgtcatttgactactgctttcagcgggtttgcacaagacgatgggcttgcgagccattcggcccaaccgactggtcaacgggcccttattcgtcatcgtggtctgctgatatggtcttgtaatagtaagggcctgtttggtacaactccaactcctaaatataactccaggagttgagtctggagtggagttgtggagctgcctaaactcagctccacaactctagtacattttgtgagagagctccacccaactccactcccagttttggtggagctgaaagtgtttggctgagctccagctccaggaggggtggagctggagctggagttgtgccaaagagggcctaacactgatgaataaattcaagcatcaggtatttgggccttagggcccaactagctgagtgccactcgtgaggcctagtccatcatggcctggcccatctaagccacctagtaagaggctaagctaggccgggcccactaatccggatgcgtcaaccaaaccggactccgactcgagcacagcctcgccgatctggctcgaccaagccgcggaattccggaagcgactcgctctcgtcggctcgtcgcacgcgcgagcccactttgccggccaccgggatggcgccgccgcggccctcgccggcggcgaggctgctgagggagtacggtgagtgctctcctctcgctctcggcctcgcgaagcctctccaaatcagggctctgctgcggtggtgggagggtttttgggatctgatgcgtcgggggcactactctcgcttgcagggt

SEQ ID NO: 12019 - DNA, 1501 bp, Oryza sativa
cgcgcgtgcgacgagccgacgagagcgagtcgcttccggaattccgcggcttggtcgagccagatcggcgaggctgtgctcgagtcggagtccggtttggttgacgcatccggattagtgggcccggcctagcttagcctcttactaggtggcttagatgggccaggccatgatggactaggcctcacgagtggcactcagctagttgggccctaaggcccaaatacctgatgcttgaatttattcatcagtgttaggccctctttggcacaactccagctccagctccacccctcctggagctggagctcagccaaacactttcagctccaccaaaactgggagtggagttgggtggagctctctcacaaaatgtactagagttgtggagctgagtttaggcagctccacaactccactccagactcaactcctggagttatatttaggagttggagttgtaccaaacaggcccttactattacaagaccatatcagcagaccacgatgacgaataagggcccgttgaccagtcggttgggccgaatggctcgcaagcccatcgtcttgtgcaaacccgctgaaagcagtagtcaaatgacgtggtgagatcgtattgggcactggcctcctaaatcgctgagaagccggctaatctagcacctttaagatatcttatatttgccacctgatgaaaaatgcttagtggtttagcacgatatctcgtgctgccctgcaacgctttaagtaaagcctttgcaaattgagtaattgacaaacaaaagtgacgagtatttcttactgcatatattttctggaagcaacaaaatgcttgtctgggcatttgcgatgcatgtcctctttaagatgggcagcacaaatggccaaatggccaaaaaagaaaaaaaatctggaaattaaataaacttgctacaacataattaatcgtcttgcatattgcaagtgttcaactgaaaacgcgcggtaggtgcgcctatcattagcctgtctgaaaacgtgtgtttcttccagcagagacggatgcagtgtcagtcagacagtcaccacacactgtcatcagacagagaggagacaacatgtgaagaaggcgagtttgtccgagagctcacgttcgttttaagcgctgtggaggtgcagttccacaatcattagcggctatggcagcaagcatgatgggcgagtacgagtacgagtggaaggacgaccgctagctttgtgccttccctgattcgtcagggtgttgctcgtaccatacagtaccactttgcgactgtgcatgtatggccgacagacaggcaaggtgtgcatatgcatatgcctctcgctttcggtgcccttgcatgcatcgcagttcgcagcagccatgtccaagggcttttaagcaggcaggcatgatccaaattgccagactagactagcagtagtgttcactgtgcttggtacttcgtcaggtatatgtaggagcatgcatgtctccaca

SEQ ID NO: 12020 - DNA, 1501 bp, Oryza sativa
gactcaaaccgacctccaaatgaacaaatggagtaattgcgactcggtagaactatggtggagccttgtggtagactctcccaacaacccccgcattcccacgcgaacgttggtcatcttggtttcttgggaaatttggtgcgagcgaaatacaagaatctttcgaaacactgcctcactgccggcttccatcctcgctaagatcaaggaggaaggtcgggcatgggtaaaagcaggagcctcgaagcttcaagagtttggaattttaggtgatatcacttaaccctcactttttacgggtttagttctttagactagccatgtacatatttctgtcgctctatatttttctccatctctatcaatatacgagggaaagcttttgccctcctttaaaaaaaaaagtagaagaaccaaaagtatcagcttcaatggcttcccaaggaggtatgtaaatcagtaattttccgcaaagcggaaaggtgatcttgtttaagaattgaattaatctaaattagacttcaatatgactctttcctaggcttatcactatctatctttcagccgaccaagaactgaaaacaattgtatattttcatttcaagtgctatatctcaattatatattacaatcgtctatgctctcatagccggttgagtgatttgtttttagagcatttatcccctataaatccctttattagaatttgcaatgagaacttaacaaaataacaaaagtctctcccgcaatcgcgcgccctcccctcaccaacaaatgttcaatattctatcccctaaatccctttttcaatttccaatgagaacataaaagatataattctttataagagatagcttaaacttaactcctaaaataacaaaactctcccgcgcaatcgcccaccctcccctccatgagatcacaggcgagaggcctattgcgagcgaacatgttcctgtaggtgtggagaccgaggactttggttttgtggatttcatctttttttttactctatccgttttttaatatataatgtcgttaactttttgatatacgtttaaccattggtcctatctaaaaatttatgtaatattatttattttattgtgacttgatttattgtcaaatgttcttttaaatatgacttaatttttttaatttatacaaaagttttgaataaaacaaatggtcaatcgtttgtcaaaagtcaacatcgttatatattaaaaacggagatattatccttatagagaaactattgtatccaactttttttttacaaaattcagaaaaattaaaattatgatccgttttgaacaaactgctgtgcattctcttagatcgcctgtgcatacaccgtccaacaaggcaatacgcctgtcgccctgtcggcgtcgcactgatcgatcgacgtctgacgaataacaaactcttgtctcgagccatcctgtcgtaatgtgtcaaccacagtatcagggactgtcacactgttgccgatccg

SEQ ID NO: 12021 - DNA, 1501 bp, Oryza sativa
gtgcgagcgaaatacaagaatctttcgaaacactgcctcactgccggcttccatcctcgctaagatcaaggaggaaggtcgggcatgggtaaaagcaggagcctcgaagcttcaagagtttggaattttaggtgatatcacttaaccctcactttttacgggtttagttctttagactagccatgtacatatttctgtcgctctatatttttctccatctctatcaatatacgagggaaagcttttgccctcctttaaaaaaaaaagtagaagaaccaaaagtatcagcttcaatggcttcccaaggaggtatgtaaatcagtaattttccgcaaagcggaaaggtgatcttgtttaagaattgaattaatctaaattagacttcaatatgactctttcctaggcttatcactatctatctttcagccgaccaagaactgaaaacaattgtatattttcatttcaagtgctatatctcaattatatattacaatcgtctatgctctcatagccggttgagtgatttgtttttagagcatttatcccctataaatccctttattagaatttgcaatgagaacttaacaaaataacaaaagtctctcccgcaatcgcgcgccctcccctcaccaacaaatgttcaatattctatcccctaaatccctttttcaatttccaatgagaacataaaagatataattctttataagagatagcttaaacttaactcctaaaataacaaaactctcccgcgcaatcgcccaccctcccctccatgagatcacaggcgagaggcctattgcgagcgaacatgttcctgtaggtgtggagaccgaggactttggttttgtggatttcatctttttttttactctatccgttttttaatatataatgtcgttaactttttgatatacgtttaaccattggtcctatctaaaaatttatgtaatattatttattttattgtgacttgatttattgtcaaatgttcttttaaatatgacttaatttttttaatttatacaaaagttttgaataaaacaaatggtcaatcgtttgtcaaaagtcaacatcgttatatattaaaaacggagatattatccttatagagaaactattgtatccaactttttttttacaaaattcagaaaaattaaaattatgatccgttttgaacaaactgctgtgcattctcttagatcgcctgtgcatacaccgtccaacaaggcaatacgcctgtcgccctgtcggcgtcgcactgatcgatcgacgtctgacgaataacaaactcttgtctcgagccatcctgtcgtaatgtgtcaaccacagtatcagggactgtcacactgttgccgatccggggccagtacgacgaggagcactcttttcgcacggcaagttcgtgtcctccgtgcaaaatgcaaaagataatcgctgtctttggtccgggtgtgacacgatcggtttggtgcgatcggaaacttccactgggatgctc

SEQ ID NO: 12022 - DNA, 1501 bp, Oryza sativa
tttccgtccctccttttttttggtcccccctcttcgtaggcatggtcctccttttatatctcaaggggataccacatacaccatttctacctacccttcttttgggtcgggacccatcctactttgaccaaaacttggctcgtactttcgcctgacaccgggataaccctgtcctccctcattaatgggcggagatttgcaatggctgctgtccgaatgaccctccgacgggatgggtcataccaacctccactccgccggaagcaggtgcaacgtggaagcacggttgtttgctgatgacacgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgcgccaactccaggagttcccacgccggctccggctagggacgagtgcctggaggctctcatcattccgacgggacggggcgaggcgtgtgtcaggccgcctgttgccccctaacccgcgatctgaccggtctgtgaccggtcacacactgcgaccgatcacggaccggataagcatgcgctatgctgcattaaatgcggcgtgaggcgctcgtccaacccgcaataaacgcggttaggtgagcgccgctgtgctcacctaacccacacacgtggcgccaaaccctcagggggtcggggcaccccagcccccggggggtcgaaacgggagcggcccgacccctcggggagatagagggaggggcggcctcatcaacctcgggcccgacccccccgagggggtcaggccacgtgggtgaccgcggctgccccaaacctctagtcaagatatccccggtcccatgtcaccgacagtagcccccggcgttatgccagggcgatcgccctcctcgaggaaaacgctcgggcgtgacgccactcctcaggcctggtgacaggtgggaccggtctctacaggcggacaggaatccagtggtcgcaaatcgcgcgcatcggcaagggaaaaaccgaccgacaataatgagcggctttcttcaagaccgctacattacttgagtagcgcgcgaattgggacgagccggttcgtttcgcctggagatgtgatgatggtgcatcggtcggcgagcgtagttaacgcgcgcatgatatgtcccatctcgactgccacggccgcacatccgcctcgtgcgccgcaaacgggcgagcaggattaatggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgtta

SEQ ID NO: 12023 - DNA, 1501 bp, Oryza sativa
tgataaacatccacagtatgaatgtgatagcaatggatataagctaaaatattgatgctacagtaatggattgatctgaaccgtccgttgttaatctaactactcaaatactactgcaaaacattgtagcatattgcattaatagttcaattatagaggatccatatccggagtagggcatatatgtttgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggcgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccgatcacagaccggtcagatcgcgggttagggggcaacaggcggcctgacacacgcctcgccccgtcccgtcggaatgatgagagcctccaggcactcgtccctagccagagccggcgtgggaactcctagagttggcacgtcagccccggccagatacattccaggcttcatcgcaaccattgcaaggaagtcattgtatgaagaagtgcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtccccacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaa

SEQ ID NO: 12024 - DNA, 1501 bp, Oryza sativa
gtcggcgagaggggtgtagaaccagtcactcttccagtcatcccacttcttgcgaaggacgcagggaatgtagcggttcagcaccggcccccgcggctggaagtagcagccaccgactaccgacggtggcgacaccggctgtacggtgaagaaccaccggaacaaccggagagatgggcgcaccccgatgaacatctcgcacaggtgcgcgaagatggccaacgtcattactgcgttgggggtgaggtgcgccatctggagatcataaagctccagaacatccatgaagaaagaagagaatgacgggaccagccctgccattgcgaagggaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcggcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgcccactcctccattaatcctgctcgcccgtttgcggcgcacgaggcggatgtgcggccgtggcagtcgagatgggacatatcatgcgcgcgttaactacgctcgccgaccgatgcaccatcatcacatctccaggcgaaacgaaccggctcgtcccaattcgcgcgctactcaagtaatgtagcggtcttgaagaaagccgctcattattgtcggtcggtttttcccttgccgatgcgcgcgatttgcgaccactggattcctgtccgcctgtagagaccggtcccacctgtcaccaggcctgaggagtggcgtcacgcccgagcgttttcctcgaggagggcgatcgccctggcataacgccgggggctactgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggtgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccggtcacagaccggtcagatcgcgggttagggggcaacaggcggcctgacacacgcctcgccccgtcccgtcggaa

SEQ ID NO: 12025 - DNA, 1501 bp, Oryza sativa
ttttgtttaatgtattggccattcgacgtatatgaacatatggcaaaggaatctttcaatggacgccggaatattgtcaaattttagtatcattcatcatgtgatcttagtatacagcttcagaggagttactgttgtatatttgtgttcgttagaagaataaagaaaattaaatccctcattttccgcttacacttccggattgctgaacgggagttttttaaaaaaagtggatagaaaagttattttaaaaaattgttaatttattttttaaaaatttaaaataataactacttaattaattatatgctaacggtggatctaattttgtccattttcttaaattttttatccccttctttcaaacacatccttaaaaaacaagaggagttactgtagtaaattattaaaatatcgtgtgctttgctagcagcttcttatctttgattatgggtaaatgttttgtcaacaccatattccaccttctttattgcgatcgaatagctttacctcttactcctctttttcatggactttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctccgccccgaccacagccgtcgcgaggagtcgtgccgcgagctg

SEQ ID NO: 12026 - DNA, 1501 bp, Oryza sativa
actttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctccgccccgaccacagccgtcgcgaggagtcgtgccgcgagctgccagccgtcgcgaggagtcgtgccgcgagctgccagcgtaggctgttggagagaagaagattgggagcactgggtaggctgttggagaagggaatttttgagtgtccgacctttttactgtgcatcactcaatccatgatgagtctctagaatgggtctccgctgttggagacagtcttagaagttctcttctatccttggaagacaatacatacatggtacaacctcgccaatggagtgtagaaaagaatgtatgcccgtagcgactgttaaaactgttccatgctagctacgaacataaacatttgttctttctttttattcagctgagtgcctgagtccgatcaaatatgatgggattgagattttgtacagccggtaaatattgccttgctttgtacacagaattcaagattggaacatagactcgctgaatggctacttctgaatgctgagtggctgttaacattcggaagtctttcgtgttagttgaacatacattttaaccttgcaattcaggtgatatagaact

SEQ ID NO: 12027 - DNA, 1501 bp, Oryza sativa
aaatctgtgtcacaagcgtggctcgatttttatcaaaaagacaaaaacacagacaaaatagatacaattaccatcaatgatctgaaaaccctgtggcaaaataaaagttctaatcaagcgtagaattgtctcaagttggttcagtcaagaaaataatggttgcaggcagtgttcaaattttaaaaaagagaacaacttatgagcaccgcaatattttcaaaaagaagagcaccacagaatctcactgaagcaatctatgtattaatgtatataagcaagtttaaacaatttcaagtgggaagagaataaatttacctttaatggcaagaagtaagacggccaacaatttctgagtagaacatgccctaaagaaaggcctcatggtatcttgatatgaaaaacagtatgctcaacattacagttgttctacaaaaaagagaattttctgttttctctgttttctgttttgcaatagatcaacttgattatcaaaaaagcaaaatttgattatcaaaaacagtatgctcaaaatttgattgcagtatgtttttctttgtttcctggtatctattgcttttgatcactctgtagtcaaattttgcatggaattttctggaggcattcaacataggtgctatttattattttctaatgtatgaatttatttagtgcacactatcaggaaacaaagaaaaacattatatgtaatttgaacatcactactgctttttccttccgcaactgcttgaaataaccacttagagagttatagaatgaagacatacaacaaatgacacaacagaacaatgtgtacaactgtgccatgtaatggtcaactggctactggatattcagatctatccaacaaaatgacatccagaacaaagattatgctctgcttaactataaatatgagaccacgacatgagaacttgcttgggctaaaaaaatttagattgtagttctgcctctcggtttacaaagttagtatcagccccaacccagtaaggatggacgaattagcaaatgaattctaaatccaagtcgctggaaaaattttctgctatgaaaagcgaaatctggtacaatcaggatacccccaaagctcaacaacatcaatatttccagtgaattcctttttcttccgcttacataatctgctgttagggcatgtaagtttttatcttgaccattcattcatctcacctcattttatctcaaccctctattcatttccatttcccaatcccacccctcataacccttaacccattatccaaacacctccttagggcttcaattgactacttgggcagttgtcacaaaggtatcaaccatgtcgacaagctgcaaaagaacaggaataactgatttttggcggtcagaaactgcaagtctggggggagatgcagttaaattctactatattctagagttcagatatcttcaaattaggttgccacacacaattgaacaaattaaagcttgagacaaaacaata

SEQ ID NO: 12028 - DNA, 1236 bp, Oryza sativa
tccccgatccaccattgtaggacagcccccaccccacccacctggccccattccgccgcgccccctccccgctgcctccgtggagcgtcatctccgcgtgcagggttagaggcttctggtggtggtgggggcagtgcggggggcgttggatggggatcccggaggtggtggtgccgccgagggcggccggcccgcggaggtacaaggggctcgtgccgtggcgcttccagccgggcttcgtcaggccgcctccggtcaagccccctgccgccgccgccgccgttgccggaggaggggtcgcgggcacgcccggcggcaagggtcgcgggttgggggcgtcgggggaaggcgtcgggtccagtggaggccggggagatcctcaatcgaggagatgcacccgcagcgcgagcgcgaagggctctggtgatgcgcggagcgtggaggagggcggtccccgtgttgccggagacgacggcggttcgggcaaatccggcgtcgcggcggagggctccggatttgagggtttgaggaatggcaggggcggtggcgttggaacggcagctgccgaagattgtggtttggagaagtccaaccccgatggcatcgtcggagatgctgatgtgcatcttgagagcggcagcgatgcaagagatggggaatgcgtttctgagggtttgaagaagccttgtgtaaataatagcaatggttcttctgccgcggattgcgcgccgaaggtgaaaaagggaaatgacagtggcaatggaggtgccgatgagtgtaatgctgcagccaaaagtagcaacttagcatgtcctggcaacaatggcgacgaaacgaatcgtaaggggcggaaggtagtacttccatggaggttccaggttgggttcaagcggtcgttctcgaaagctttctgctccgatagtgaatcttcagggccctctggtactcaattctacagagcccaagactcttcgacaccgtgcactccagcaacaagaagttctgtccggtgttatgcgagtgctcattctggtgttagagtctcggccatgcgtgatttctcagtgaaaggtgagaaggaaacatcaactccatataagaagagcaaaactggcatggatggtcctagtcaagggatgccaaagaatggagttgtcctcgctagggaaaacattatgggatctctgcagaattttcgcttaatttacagggaccttttggatgaagaagaagaga

SEQ ID NO: 12029 - DNA, 1501 bp, Oryza sativa
taaggggcgagcggctcagcaggggcgcggacggagtcaacacattggcgcatatccacataatttgagaatatattctctcacctctcaagacacttgtaggattagcttgcattatgaatgaccttagaattccacaaattagctacctagctctcgtttagagtttaacaattagctacctagctttcgttgaaagtattactagttcaatttttcatcctatataaaattagcttatgccaaaatttaaattttaaaaaataattttagagttaattttacaagtttttaacataggttttttagcattagcttttaaatcttcaaggacgtacaaacataaataaagttgtttagcatataatcagctcctggccaaaaacggggctgatggtaggacactactaggtagtttgtcccgaagacctgggtgactggttctgtgttaatcctggtatcttctctgatttttcgggttgtcatccgtcatcctaccgatgatagcttgttgtttgtccccggtgacaggtgacatggttggctggttctgttaaccctgccaccctggcatcacctgtaatttttcgtgttgttgtcatccgtcatcctactgctactgatgggcaagtgggcggagctccacgcccgcggcccgcaccagccacaccctaccccaaggcacgtcgacgacgtgggcggcaacgccgtgatggcgtgggtctctcgactctgccccgatcccgatcctgatcgaggcggccgcgtcaacacgccgcccgccgttgcacggtttcactcgagctgcgcctacacgccatccacggcggaacccgcgggcgccgcgccccggctgccgcgcacggcacgcgaccccgcgtgaccgcgactcgggccccgtcggtgcggccgtcccaccgcacgcgccgcacggtgaggtgacgtctcggccgctccatcctccgacccggccgcgtcgcccacgagaacgcgagcggtgggtcgcgccgcgccgctcgcggcgtcatcgccatgtgggggtctcacatcacggccgcgtcggcgaaaccacgcggtcacacgcacacacggggccccaccgccgcgcgccgccgccgccgcaccgcgcgccaccttgccgctcccgcacgctaccgctacccccttcgcgcacggcgttacaccaagtcgcaccgcatgccgccgctcccggcaaacggcacccccacgggcgtcacggcggaacacaaaactacggccaaacagtaacaaattgtaccatttttcttaaaaaaaacactatatccatcctaaaatataataatttttagcctttttataatttatcttaaatataatatcttctacacaaatattttcttctcaaccaattataattctttattatttaattttttcatatatcttttctactaaattattataatttttcaccacttaattttatcggttttcataataaccgtatttaactttaaaa

SEQ ID NO: 12030 - DNA, 1501 bp, Oryza sativa
gaaatttggtaggattggtaggtacattataacctacctcacaatattattcaaaaaaaatcgttactatatacaaatatttgaagcactaagcatgatttaaacaccaatggatctacaaaattttagcttttgaaaatatttttgaactttgataatagtgttatctatagctctacaaaattgtagtttaaaatgcgactcatgtaaagagaatcaaatatgagaaatgctatattaagcaataaagtaaactatttttaatagtttaaaggtaaaatgaaccaaaaatagtttagttggtcaaatgaaccaatgaaataattcggagttaaataaactcttttttttttcaatttgtaatcatcacaatggtaaatgggccatatttagtgggccaagataaacccaaattccaagaaaagccatctccttggtcaaccttgggcctagtagaacaactgcagcccaccgttctttccgttctccgctaccgctagcttcgttctccgctgcggcagccggcaatcgcacggcggaagcaaaacgaggaaaaaatggggagctcgcggcgaggggaggagaagggactccctgttcctcctcctcctcctcccaaccctggtggtgtcacttcaagacggcaaaaggaagcagccatggagatcgaggccgtcggggccgatggtttgtgcccttttccccttagcatagctgtgtattagtaactcgttcgtgtccctgcggaacggaagaactatggttgggtagtaacagcttgtcgcaagatctccggttattgttgcggcggcgcggggtcggtgccgtggattttccattcgggccgcaaagagtcaagagtgttcttcctgtaggtgcgccttgtgattgggcacaagcacaacagcgtcaccatggatctttgtgtgatttggtggaggtggaagctaggttggttcttgcagtcactcaaagaatgccaaggaggaaactgagaaaatgtatttttgtgcttgcagtgtaactgctctttcttgaaatcagatcagatgcatatatgtttcacaatatctatccattatctaaaaaaaaaaaaagaactgattctgtccatgtagattcaggggaatactattctgagaactgcatcccaaagtgcattgacttgcccttaattaacctccgaatatgcagcttcagcttgtttggttttattcatcaatcttgtttggagatgtatgtgtgctttcggtcttcaccaaactccaggatgataatccaactcgactttaattaaaacaaggacaatcaaaaagaatgcttggtagttgaggactcgaagctcccatggagataggcaagtgcttattgcatgcttgtcttggctatgaggaagacatttgttgatcctcacctaacattctttcaggcaatcctatgcttgcacttataaacgcataccttcaggcatataagtttcaaacttcatacgattgttcaa

SEQ ID NO: 12031 - DNA, 1501 bp, Oryza sativa
ctgcctgcattatataagaaaaatgcgctacctgtaatttacgtttcgtcaagaaaccaccttttaagtaaggtaaatgtaaggtactaaggtgcaatttcagtagttttgggttgaatttcagccaacaacaagcttctcttgccacccacagtcccacaccgtccgtccccttttatctcatggccaaggtggcgccatctccaccccatcatggccaccaccagcccaccgtagcgccggccaaccctctatctggtggtgctaccaccttttttcgtcgtcggagaagacgctagtattagacagtgctggaatatattgatagaatagggaaagaaaaaaaaacgattttgctagatatttgtcattaaatttcttctcccgatatttgtcgttttttttggtagtccgatatactttaagatgcgtgcacggtttggtttggatcaggacgcgtgggagtcaaaacctggtctcctcggtctcgtggcgctgttaaatttcgatttccacgccatgtccgtagccgttttttttttcttacttatcgctttctcctcgttgtctccgcgcgcgctctctctttcgttcactctcgctttcttgttctctctctcattctctccagcgagagggagagagatccatcgtttggatcgattttctccccctggattcaaccggtgagtccaatcttcgtttgtagttcccactggtgaaattttttcaacggttttttggttagttttctcgatttgaatcggtcaaggtttcgaagcttggtcctgagtcgatttcgttttcgttttagtttcagtggatccgtgatttctatgtattgttgatcagatttatatgttctaggtgattagtgccctgatctgttgatttctatgtcatgccgatgagatttatatgttcaaataattattagggaactgcctagctgttgcttttttattttgttaagttctaggtgagcagtgctctgatctgtttatttataggtaaagcgacacactatttgaaattttctaggttatttctgttttttttgcaggtgaactttcacagtaccttttccttctgtgttcatgagatgaaagattgagagggattgcccagatagagtacatggatgagattatcagcatatcaattttctgctttgtgtgatttgggattagactaaatcgtaaccaacgaactaggcatcggtggaaacgatggctggatttttttttttttgccttgtcactgagctcggatttgtggctggtagatagggattttttttgtgtttgatttgcatttttcggagtaaattggacatccttttagcagatttacaggtttgctaggatttttcccctctgttctgttctgtcctgtacaggggattttgttatttccttctgttcttaacatgcacaactccttctgtatatgtgatatgcaagcagcagatttagtgatgaactgtgtacttgtcaaatga

SEQ ID NO: 12032 - DNA, 1501 bp, Oryza sativa
tcctgtacatcttaccaatgcttcccatattatcagtaatcaacagtataaaataggttgtgaatatctgaaaatataatacatatagcacaatagaaaaccttcaggaaaagtttatttgagtagtattacatatattttgatctattaagatgtgagatttgtgtcaagtttcataagtttcatatattttcagcaaatataccactggagaattgataacaggaattattgtaactataaatgaatgaaagtccagctactctaatgacatgtgaacccaaatggcatgtaattctgaacatacatacattagcacaacttgaaaagaaaaaaaatgaatcgatcgttgctatctcaggctagatcaagtcctaataatttttagtcatggataccaaatgaacgggatgaaaattttagtcatggataccaaatgaacgggatgaaaacattgattttatttgcacagtttgtactacactttaaccatcagaaaaacaaacacctcggagaaacttgacaacacttcaatcaggggagaaggaggcggcgacaacaaattggggatcagcgtcgactgaacccggcggcgctcccgacgaggagagggaatcggcgacgtgacggcgcgacggaggcgggggatcggcaagaacggggcagaggagatgcgggatcagtgacggcgacctgggaacaggggtttgacgatgccgcgacttggatcggcacgacggaggcgggggatcggcgaggacttcacgcgacgacgacggaggggcggcgcgggagaggagagaaatcgtggatggggaatcggtgacgcgcgggtggggcgacgtcgggtgagtgcgagagagagagaggagagaagagctagagagaaagagaggagggtggatgcgccgtgatttcaggagtgatggggtgtgagaaggggaggcgggggagacgtggggcaacaggagcggttggattcgatgattttcatccgttagatttgatgaataaagtatgaaggatgtaagaggtagttggtgaattataggttagattattagaatataattcacaaccatgctacgagcacacgccctcgtactcacccggacggcgatggatcgccctggccctggcaaaatcctcaagttttctccgtggcatgggcgcatggcatgtgctcactttttcggtcctagcaaccggcagtagtaccaatgatgcacctttgcaccagtttacaacaataatggacgtcaattctactgaaccgccctggtgccagcatttaattcgtatcatgcattcatgcgtagcgtaggccataggctcaagcgcacgtcagttgccataaattggcctcgccggcccgaggctttcttcaactttctgcttgcaaagtttcaatacactggagtgagtcagtgaggttggtgaagcagagtgaggaaaggaggatgggaagggtggcgcctagcgtcgaggaggtcgggggcga

SEQ ID NO: 12033 - DNA, 1501 bp, Oryza sativa
tagaaagtcacggtactgttaacctctgactttaacacctaaagtcaggatctcaatccgtacgaattacctctctcaattaaaaaaacaaacatattttttcaccctcaacttgttacactgaacgaaggccaactccaaagcagtttcagtcctacgtggcacacacatggaagtccaatcagcataaaaaatatataaacaaatatggggcccacttgtcagttatgcttctcttggtcagtacatgtggtccctatctttttaatgtatttttatgatgactggactgccacatgtgtcatgtaggacctaaaccactttggagtctattcgagggataattcgtctggtattaaaaattgaggacgatgaagaatgtctagttttttaattgagggaggtaattcgtagtactacaattttttttttggggggagggaggggtattcggattttttcagaaagaaacatgctgaacattgggtttgacgactgaagcaatattctgagacaacgccccaagtataaactgattgccacccaaaagaaaagtactttagttccaactatcaagcgtcaaactagctaccaaaagaaacagtggtagctctgtgtatgttgagtttttctgggacggagagatatattcgtctgaagtactactacgaataatcaaagtttgcatgttagcaactggccctactagcaacaggataccatagcacagctattcgctgttacttaaactcaaaagctgtattgaatccgacaattcaaggactatcgtaagctaatcatgtgcactgagctatggtactagtacaccctttgagctgaaggagtgttggccagccagacaatcggtaggacgtaaatgagtgttgctatacgtccgatttcctcgtccgacccccatccaatccaaccttatctaccaatcgtttcgctccacgcagaccaacttctctctatgtgggcctctatgtgggccagagcagttacggagtagcagctaagtgctggtcggacataccagtcatatgtatagcgattttcgacgttaaataccctcacacaaacacaataaatcgaatagagccttctaatactccgtatatacgtttgctatatatatattgctattcttctatactcttgtactgctagcagcatgcatcgccgcatggcaggcagccatagctatatttgtcccgacaaagtataggtgaaaatttaatggaccgattcatcaatgcgagagtagcaccgttttcctgacaatgcttcacatgggcagccgcactctctgctaatgctcttgcttgaagaagggtaaacgaaggaaaaaaaatcgctgtgacctgtgagagattgatgatggtttgcttacccaacgggacattccagcaagagaagacgaggatgaccccgagcggctgcggctccagctgcgcccttgccgggaacgcgattagcggcacccagacctgcaaccagc

SEQ ID NO: 12034 - DNA, 1501 bp, Oryza sativa
tcctgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttaaaaaaattagttaataccgtgttatgttcttttaatgtttttattttttattttcaatttcagttgtttcaacattgtattcctacttgaactctcttttaatttttctaattttggatattattttattttttattcaaaattttaattaatctcgtattgggttcttatatggattcttctttcaatattgcttatttttaattcagaatttaagctaattttaaattgtattcctacttgaactcttcttttattttcttttgctaattttggatttatttttatttttattctaaattttaattaatctcgtattgggtttttatatggactcttcttttaatattccttatttttaattccgaattccagctatttttaaattgtatttctacttggactctcctttccttttataattttgtattttattttacttttatttcgaattttgattaatctcgtattgggttcttatatggaaacttctttcaatattactttttttaattccaaatttcagctatttttaaattatattcctacttggactctcctttccttttctaattttgtattttattttacttttatttcgaattttgattaatctcgtattgggttcttatatagaaacttctttcaatattactttttttaattctgaatttcagctatttttaaattgtattcctaccttgactctcctttcctttttctaattttagattgtattttatttttattttgaattttggttaatctcgtattgggttcttatatggaaacttctttcaatattgcttatttttaattccgaatttcagctatttttagattatacttctacttagactctccttttctttttttttctttttctccgattaatgtgggaatttttagcccccacagcgaacgtggtacctcattttcaagctgtcttaataatataatagatagatgctgcagctttgctgtaacctctagaattgtgttttttttttgaataaattttaaacgtcgtaggacggaacgaatattattttctcatttatgtgtgatatcgcctgttgatatggtatctttccgagataactgtaggtgtggtgtggcatatagcatgccaggttatcttgaagttgaaatgtttttttcccctcaacaatgttaaagttctaaacagtctaattaacttaaaaaaaatgttatttaaattgttcatggagcacaattgatttatttagccatgagcacaactgatgtcacactgaaatatgtcaatacaactatagaagatcacttctattttggtttgaaaag

SEQ ID NO: 12035 - DNA, 1501 bp, Oryza sativa
ctcaagaggagctcggcgatggatgctggagaaagatgaagaagagaaggaggaggaggaaaaagaagaggctgacatgtgggtctcattgtcatagacttaaaatagtgtagatgaatagactattggagtaagtaacgagtttgactctttaaatcagttggagaaccggctatataagtatttggagagtttaatttgatcattcggttggagatgcttttatccaaggaaaaactatgagtaaatttcatttttgaccatcttttattattaatgtttcactttagttcacctcttatttttttttttactttgggctggtaattttgcctttgtttcactttggaccacccccaactcactcatcaagcatatgaacaacctcgagtatgatggctcctattcgtcagtaaacttactcagctataagtagaccttttttttgacttatgataaattggatgtagatggataaaaaagttgaggttggtccaaagtatcataaggtaaaattatctagtccaaagtgaaacattagttgaatagtggtccaaaatgaaacaccggcaataaaaggtgacccaaagttaaatttattcgaaaataaatgagggttggaaacttgttaattatcaggaaaactttggcattttacatgaactctaattttgtttttctattgtttaggtacgcatagtggatgagagtacatttagttttttttttcaattttacaattgttggtgggaggaccaatgggatatttcacaaatgacaatttcatacctatataaaaaagacaacttgatagagtgtgacacgctcttgtgaataatctcatcaaacatattcaagagcagacattagtccaaaatgtagcagaatctttgtataatatatggacgtgttgcagcttttatgaacaaattaagctagccacagaggacgacaagtaaggtcacattatattgtatcacaacactaaaaaagtcgtgggcgagacaaatgtttgcttctaataacgggtgagcaaattttgcttctaagaaagaatttaatcttataaagcaacattttcttaggatgaacatttcctcacccatcatgaagcaaacaaagcaagttgcttataaaagaaaacgttgcttatagtagaatttacaaaccaagttgataaacaaattttgctttgttaaacaaatccagcactataaataggatcggcattccctggctggcctatccacgcaaagaactatagctccctacaagtaatcacagatatatagggcagaaattaaggctacaaattaaaatggttagttaattattaagtagtcctcatctcgtttgcttcaatacactttttttttccgaaacgcatgcccatgttttaattgcatccgttatgatttgcctgcaaaaatgttcgctgtagtattatatatatgatataattcaattaattttatgtttgatatgtgatgtgtttgtttgc

SEQ ID NO: 12036 - DNA, 1501 bp, Oryza sativa
atcccaattcaattccaacatcaaatccttctccctcaaaaccctacagaaagtctagttcccctccttcctctttgggctgtttcttcttggccggcccaacccactccttcctctccccgcctgggccatgcgccactcctctcggtccagccaagcagcagcccacctcacccttgcacgcatgcgcacgtgccgtgggggagcgccgtctcgccgccttgctctctccttttgtcgccgcatgtggtgttgggtgttagttcgttggttttcgccgcctcagcttctgctattgctgttgctgcttcatgtcatctgctgcattctctggtttgcccaagagttgcaacttaagttaacgtaaataagttctctattttatttaatttaaagaatgcgatgatttataattgttactgtggataccaacgctttatcctgggactgtgtaacataccgaaaattaaccattttctaatcttgcatcatgccactttttatgttcttaataattttataaacctaggaaaatataattagagggaccttctaaaactaacttgcataaaatccttctctggtatttaatttcttttgtgtttttcatttaaaaatatatttggctaaattgaggtatttcttgatttggttttaatttaaaaccttttttcaactaaaattcttttattcaaatttagtttgaaaaccctttctatttttatgaattatggtccaagaaattccccactattgccctagaacctaaaccaagtaattccgattttaattggaattaattgtggacccatcctttgattataaacctatcctaattccctttccaaatttcaaatttctattttgatctagactcccattccagttcctataatctaagacttctcggcacaagaatagatatattataaatattagaatgattgctcttgtgctaagaagaatatatttccctcttccaaattaattccctatttaaccacaaataattctcctatccaaatctcttccaaatttaaagtctaaccatccaaatcccattcaaaatgtagaaaaacatttattttcagtttgggccaaagtccttcactttctcccttggcccatctccttttacccttccttgttgtgccagcccaactttggcacgcggcccagtcggcccaaccaaactccagccgtgccgctcctctcttctccctgttcggtgggcgccgccgccgctatcacgcgccgccaccaccgccgtgcacggctctgcttgcagctctgccgaccgccaacgtcctgccgtcgccgctaaggcatcgccgccgacgtcatctgccacctcacgccgccgacgtcagcctttggagcaaaccgccatctccaaccaatcacaagccacagccggcgccgtcgtcttccttctcacgtcgccgccaccaagaccaactccatcttctcctctacaaccgaccttcaaaaccgacgtccg

SEQ ID NO: 12037 - DNA, 1501 bp, Oryza sativa
ccactgcatgtcacctccgagcttggcctgcactgatttgttacatccctctgaagactgaagcataatagtgaaaaaaggttgcggatgtttatcatcgagagatcaataattcaaattcaatatggtgcgtttcaacgcgaagtttgcatcagcttttcgtcagtagaggttttgtgggtgtaactgtcactctgtcagataggctattccgttgccaaggccggataggttcgctgaataattggatggatgaattatacgatgatgagaaggaataaaaatctcggccattagtcgtgctccactttggttcgcgcctgcaacccacgcgaacattggcggatggaaacgatagaaacacgtgcgttcaggttactggcgcttcggttcagagcatccatccacagacagattgaagagcgctgctgactgttgctgtttttttttcctttcttcagaagaagatggtcgcctgttgtttctgcagcagaaaccactagctgattaaatctgtcctacagatcttcgaaaagactgaatcttttgtctggttttgttaatccaccactaaagaacgggtttattagcgggaaccaaagaatgtttccgcttttaggattctcaaaccattgtaaacagaacagcatagtgattagtagatgagttgaatgaggctcgcggtagtgacgatggaaccaacactctcctccgtcgagggagaagagaaagttacggggacgacgacggaggtgaggagggggtgagcacctgagtaaggaaatcacgcacccaattcgaccaatctttagaggcgagcggcgtcccctacgatggccggcgtgaaagcgctaggagtcattgcgataattagattaatcatgcacataagtacacatagacccggtacatctctatctctacaatctatttatagaaacagaatcgagagagaatcagagaaaaagggtaggagataggaatacaaaactatatctctaacaccccgatgaaactagaagggaaataacacagagctaggaagaccccttgatgaagatgttagcgtaaagtcagcacatgaataacccgaacagtaccaagaacgactttgtcccgaaaccctaacaattccgggctccagctataggcggtgggcttcagtaagaaacaattccgtccgcatcaaagcaaagttcagagctctgtttcctggtcgtcgtggttggaatgttggatatcagctttactgacgaataatctccattgctcgtgcccttgcgtccgtctgcatctgactgctacggattggaatttggaagaatcatgaagctttcttccttgcattgcagggcagtagggcatgcgagaatcgtgatatgatgcttcactgacgcggtcgatatggtttcaggtcggtctggtggttggcatctctttgttgactgttgaacatttgtggaaaatatcaggttggttaacgccagagttcaggttcttc

SEQ ID NO: 12038 - DNA, 1501 bp, Oryza sativa
tgtatgcctttggtgatggatcaattaaaaaaaaacgaaagcttagccttttcgaacacctgatggactaatttaaacaatctactagcttctggtggtttctgatgcagaagtaccaggcaacatcattcgcaaatctcaggtcgtacatgcaccacttcaccaataggctgtggccctagtaactttcatggatagtatacttcaagcaatgcccacgagaatttctccctttccacacgttgttcttttgcgtgggcagcagccatgcaggcgtgaggaaagcagagcacatttcatggcctggaatttttcctggtggtgttaggtgcttagttgggtcactttccgttgagcacaatgccattctctgaagttttgagaaggctgctgcagtacagaatgtactgcaaggagtaatcagaggtactacctccgtcccagaatataaccatttttaaagttgaacatggttattaagaaagtagatataagtgattgatgtagggttgtgattggttaagatggaaaaagtgaatggtggagggttgtgattggttgagaagagaatgttggtgaaaaagttatatttttggataaatcttgagagttaaaagttgttatattttgggacggagggagtataatggtatagtacattgtactactacttcaatttggacgatcgtgtactatagtcttcgtgtgattactttattaaattagcgtaccaggtgcctgcaggtattcgtagttgaagttgacaagcattacttgtcagtaaacgtggacctttgcatagtccaaagttaggctgtggccattacaagtgcttgcatattcttggacagtcgagtaacctcactatgattggtatttttttgcaagttttttagtactgaattgcttttgtactgtcgattgtacatttgtactacgaagaacctgaactctggcgttaaccaacctgatattttccacaaatgttcaacagtcaacaaagagatgccaaccaccagaccgacctgaaaccatatcgaccgcgtcagtgaagcatcatatcacgattctcgcatgccctactgccctgcaatgcaaggaagaaagcttcatgattcttccaaattccaatccgtagcagtcagatgcagacggacgcaagggcacgagcaatggagattattcgtcagtaaagctgatatccaacattccaaccacgacgaccaggaaacagagctctgaactttgctttgatgcggacggaattgtttcttactgaagcccaccgcctatagctggagcccggaattgttagggtttcgggacaaagtcgttcttggtactgttcgggttattcatgtgctgactttacgctaacatcttcatcaaggggtcttcctagctctgtgttatttcccttctagtttcatcggggtgttagagatatagttttgtattcctatctcctaccctttttctctgattctctctcgattctgtt

SEQ ID NO: 12039 - DNA, 1501 bp, Oryza sativa
gaaactgacgctactttcctcctggtactgctactctgctaagaagattttaaggctacgaaactttcgtagaagcctacataacgaaaaggttgcatgggcacgatgaacaacttggagacacgagacccataactgggccatcaagcccatcatgccgtcaagaatcaggaaaaggcccaaactgtaaccgctcctactacatcagcccaacgtaccaacctcatgggcttaatcggcccattacgcgctggttcggcccggtacagcgcatgctgcaaccgcgtacaggccatcggaacgacacgtcggatcgtcggcgtcggcagcagcggttaaattaacagaggcgggagggcagcaacaagtcaacctgccaccgtgccaccgcctctccgtccccatcaccctcgcaattactccacccgccggccagcccaattgtcgaaatggcaatcacccacatcacatgcagatcctccctaaaccactcgatcatcccgcccccactcctcctcctcctcatccaggtagatcccaacagccgatcagatctcccactccattattcgcctcgcccattgccccgtggccacgggcgaagccggagggaggggagagacgcggttcctcggtcgccatggacgggctcatcaaggggctgatcaacgtggcgatcgacgccgtcgaaggcgccggacgaggtgagcggggcggcgaggacgacgcgccgaggaggcaccgccccgcgcgggaggaggaggagggccgcggcgacgagcggtcgcggtcgacgtgggccgaggtgagcgccacctgttcgcgcgattgcggaagaagataaaggaaatcgtgagggatgtaattggttgggtttgtcggtctaagcttcttagtgttttggggatgtggcaggtggtctccgatcacaagggcggcgaggcggaggagcgcccggaccatcggaattcgaggcgggtgagtgacgattgctgttttgtctgggagaacattaatccagaccggaattcggttttagttaatcttcttctggtagtttgcagttagtgttatggtagtaggggcgtagttaaggcccgtttggcacagctctggctcccaagtccaacttatttggagctggagctgttccaagcggtccaaatcctttgtttttcggagcggagttagcagagctactccacaaatttgtactacgggggtggagctgggtttttctgctccacagctccactctaccccaaaagacccataagtgcttaataatttaattctctggttgaatttaggatgggaggcaagagaggagggaggatggggattgggagagggtggatggccggaagcagcatcagcacaaccaggttttccattttgtgtacacattttctgtaaaaattgtaagtgtgccactctgcttacgtagctgggctccacgtctgtagtatgaggaagagtacaggagggacagtagtagccg

SEQ ID NO: 12040 - DNA, 1128 bp, Oryza sativa
tcctgcagcccgaatagtgttttgtttttaattcgcagacacatttgtgcgagataatttagaaacagttccaaatcgttttgcatagactgcccttttagggagaggactatgacacgaacgcccaattttattcaaatcattgaacggcaaataaatgtttcacatgtttgagcaatcgatgaaaaatgtttcaataaaaactgtttcctgtcttcctgatgtttcattactcagtcaataaatgttttatcacttaatccaaagatgttccaatcatatatacaacatccgaaaatgctgactgcaatagacaaaatctataagtgcaacatccgaagaaaaccgactgcaatataaaaaacaaatggtgcaacattcaaaagagagaaattgcaacatccaattcattgtctacattcatggtttgcaacatctttgctagctcttcaccagcctcactttcacctgtgctggctcctacctatccaccacctcaaacagcagtgagcaacaccaagaaggagacggtgactgcaggaaaccctaacctgaagcaatctcccaatcttcgtccccctctccagtctccatggcggccctcccctagatccgatactctaaagttgtgggtggctagatctgctcggaggagatcccgtgaagattagggagaagaggtacgagaggagagggaacgattagagaggagaacaatgagggaaatgccctagatggcggtgacagggatagaataaagagaactgagcgagaggggaaggaagcgggcaagatgggtgcggctacaagcataagatggattctgtcacatcggatggtcgatctgaagccccccccccaacacacaccccccccccggcccctagtggtgtctgtacaaagaaatcttcttttacacatatttatcacatttgtggctttgtgggtgtggtcttcccttgtgctgttgatggtatctatagatttgaaatgaggtttcgcccacaataagatccaatcatagtgtttcatgtacatcgaagcaacttatttgtagtagtaagtagtaactcatgtgcatagcttctcaaaatttaggatcattaaaaataggctttcgtgcattta

SEQ ID NO: 12041 - DNA, 1501 bp, Oryza sativa
gtttttttctgatgcgagtgtccgagtactttggaatagagggagtacttttgttttggcctatactctttaatttatagggttaatgggatcatgccatcataaattgttgagtttcaaaaaatatctttacggtttatctattttgtaacgatgccatcataattttacaactataggagatatgcaactgcatatataccgcttcaccgtgtttatcaatttatttgtgttatgtaaatagatgcacaacggagaaacgaattttacatggaaaacccttacgggaaaaaaccacggacgccgaccgaccatgatcagtgtagaggagttggatacaaatgcaagagatatattaggctgtcgcaccctccccatgcggcttacaaggaatatataaatatatatataggagaaaaataggagtccttatgggcaaagactcgaagtcctaataggaaactaatcctataatgcaaagtcctattagaaaactaacccaaatatatagtaggcctaaaattcggatcacatatttaaccatctccactttaagacgaatttcccttgtagcataaaaatcttcaatctccaaagaggacgatcaggacgatgtcgaccacgagtggcggcggcggggagcggcggctgcgcgaccacggcgacgacgacgggattttttcaattttattttttttccgtacgggtggtataatttgactgcatgggataatcgattatcccgtgcagttgggccgcccgcacgtgaaaatattgattttcacagacccttgggtgcagacgggtgctacctccgcatgaaaaaatggattttgaccacacggaaaaatgaattatgtactagtggaatattctaaattaaaaatgtgcattttcttattggtcggtgtgagcgtttgtccttcatatcactgtaaggtgtcaaaaatcataattgatagtattgtttgaacttatttgaaactagtaatcatgcaatgcacgttttccacaaaatatatcactggaatacataattacaccaaaaaatttagaaactacatcttcctagcacaacctatttacccaaaatttataaaacatatcatcatgtaatgtaagttgtaacaataaaaataaccattattatgagtaaatagttatttttagcttaatcagaaatgcacaaaaaggcatcaaagcaagatattgacttgttattctcttagcagtcatcaacataaccactcaggcatactaccagtagtccagtatgcagaccacaatcaaatgagtaaaatctcggcatttgttggaccttgaaatggggagacaaaaagattatattgacttcaaatttatttatgtggttatatgtcaataatgtgtcctaacaaattcaggcttgaattaagagcatgatatcatggcttctgttgtatagaaacagacataacaaataggacggttttccgtgaagaagaggaggatgatgtgacca

SEQ ID NO: 12042 - DNA, 1501 bp, Oryza sativa
actttttaaacttttctagtgtaggaataatccaaaagaagtggatttttctgctagttttgtgcttgtgtgcctagcatttttcttgaatgcccaaagcatcaaggcattaaggaagacatatggggcctccatgcaactcatgtcccttgtatcctcatcatgcaccaaactccagcttgtagcataaacatactcttcagttttcagagagagggagagaatcatagagagagaggtgtgtgtgtgtgcctccaaaaaataaaaggtaaggtaggataacaaacaaacagtggtgattgcactaatgctctgtgctgctttcagatggaacagtgctcacctcaagcagcagcagcagcacaaggccccatcatataggcatgactttgttacttgctcttcctctccttttgctgttctcctttttctgcacaagatgttgccaacttggcctcatccctctgtccatttatgtaggctggcctcagtgttcaaatgcaggcttgccatgatcagcacctatatatattgagtttgatatataattgatgatattgatggacaaaattcttctctggctctgtttcttttaaaacaaaaatccatatgtgaatagtagttgcgagttttcagactgcgacgcgcttattcggtttcccataattctgaatgaaactcactagctaagtgggatgtggactgaagcatcaagtgcagctagcatgaaatgcacagcatgtgccagattcaatgaagagtgggggttggtgccctggaagagaattgcatgatggaaaaggaccatgcaacacagggatttaatgtttgcagctggtgccttgcaaaattagtacaactggtattcaatgtatttatagctaattgttgatgagcaaagaagtacaaagagaaaaacgttttccatgaatgaaaaaggaaatatatgcaaaaaaacacaaacacaagaaaggaggtagttactagatgtgagtgatataagtaaacatgattgcactttttgcagtatgggtgtgaagtacaaatccccttgatcattttttttatatatctcaaaatgaccaaaagaaagcagcatgtgccttggattgtgcccatgcacaataaaggctccaataaaaataaaacaaaccacaacaatttttttttaaaaaaaacatatatgattcactagaaattaggatggaagaactgagaaattcccttgtgacacaaggcatcgaaagaatgaactgcaatataaagcttgatgctcagcatatatgcttatacagtttaatgaatttctgaagaaatcatcatgcatggatccatgcaaatgatgatcagagtcagtaatcagagcctcaagagggagagagagagagagaaatcaccttgataaggaagctctcatacatgcagctatctgagagtttagcaatctttctccagatgatcgattcagggttcttggaaactcttcctttgtcaagataga

SEQ ID NO: 12043 - DNA, 1501 bp, Oryza sativa
aggctggagttcatgattcccataaatgatggcattatcaaaatgtccttgatgcccgagtggttctattcgtctatcaagcatgaccaccctagcttgcaatctacgcaactcagttatagtttttgcgagatatctatccatagcacgaaccaggccagctaagaatagtcctggagtgtcaatctctctcatgtttccctcaagacctggatagtaattagcggaggattggtttgtgcgagctggaaagaaatgaaagaacccgtccaaccctggcctataatgtcggtaatacacaatcgcttgtaatgcagcttcctgcattgctgagggtgcatcccaaccacaagcttgaaagtaaaggggtggttcatgggtccaaagtccctgtatacacagctcagccatatatgctcgagagatgaactccgctcatgagaaaagaaatgatactccggtggatgatcataacctagatgttgcagcataagccacaggatgtgaggcagtgattcttcctcaaaacctccagaatagcccgatggttgccacatagaagacatctacaagatattggaagtatagaccaattagaatttcaattgaaactctttaggaacttggaaatggtgttttggttattatgtcaggttctgtccagcatactgctctgagtaaaaaatgagaaggacgactgctaccagttctagaatctgcgcagtttaaaaaaaattatatatttttttttaaaaaaaatgcgagcatgtaaaattcgtaccaattttgggacatgctaagaacttaatgtagaggctttacaaacatctggtggcctttatatgacaagcaaactatggttaaaacaaatcaattccatcctaccccgtactaccactttctaggccatcgataaaattttaaaattttaaattcaaatttagaagggaaaaatttagtcatctatttactgagaagttttcaaatcattcaagtactgacttgaatcgaatttgtttcattcattccttattcttctctatgagttactacttctctatttatgcatcttccggtcctatagagtaagatggggttttaaaatcaaaacaagattcataggaaaggaatttatccaaacagggctaagaagtaagaatagattagattttgcaaatatattttagtgaggacattaccctcaaaatattttcttttgaagccttactaccgctcagtcttaaaagggttcctacagtcggtcttggctctgataccaaagctgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaa

SEQ ID NO: 12044 - DNA, 1501 bp, Oryza sativa
tttaaccatagtttgcttgtcatataaaggccaccagatgtttgtaaagcctctacattaagttcttagcatgtcccaaaattggtacgaattttacatgctcgcattttttttaaaaaaaaatatataattttttttaaactgcgcagattctagaactggtagcagtcgtccttctcattttttactcagagcagtatgctggacagaacctgacataataaccaaaacaccatttccaagttcctaaagagtttcaattgaaattctaattggtctatacttccaatatcttgtagatgtcttctatgtggcaaccatcgggctattctggaggttttgaggaagaatcactgcctcacatcctgtggcttatgctgcaacatctaggttatgatcatccaccggagtatcatttcttttctcatgagcggagttcatctctcgagcatatatggctgagctgtgtatacagggactttggacccatgaaccacccctttactttcaagcttgtggttgggatgcaccctcagcaatgcaggaagctgcattacaagcgattgtgtattaccgacattataggccagggttggacgggttctttcatttctttccagctcgcacaaaccaatcctccgctaattactatccaggtcttgagggaaacatgagagagattgacactccaggactattcttagctggcctggttcgtgctatggatagatatctcgcaaaaactataactgagttgcgtagattgcaagctagggtggtcatgcttgatagacgaatagaaccactcgggcatcaaggacattttgataatgccatcatttatgggaatcatgaactccagcctcttacagagactttgcctcctcccatgggtatttatcataatataaacactagagcccgcatgagagttggttttcatcgaaatcgtcgaaccatgccagaccctgcacttgctggagatccggtgctgctggggccattctatgagttcgagcggaatgggagacaataccgtttgactatggccactccgtcaaccacagtgcctcaacctcccatcggattctccgaagttccatagaatggtgtactggaaaaaaagaatatgtatggggtgtaactttcatttcttttctttaagatgtatgagatgacaccctaatatgtaatctttttaacggtcaaaattttgtaacaccaaggcatgaacttggtttcttatgaccattatccactcctatgtatctgtgatcacttagatcctttaaaactaatgtactggaatgaacttatgctccttttggaatggattgcttgctgtccagaaatttgtttcatgcaaatatatgatggatgacttgtaaattcggctataagaaatcattcctgtatgctacctatttagggtaatgtatatgccaattctatgctcaagcagctcatgtacttttgtactttgagtgcaggatgacacata

SEQ ID NO: 12045 - DNA, 1501 bp, Oryza sativa
tggctttttttctaattacattgtatttctaatcggattcttcttaactggaattttagatatttccagattgtatttatagatggactcttacctaatatcaattatggcggcgggcctcggctagggtaacagtgccggcggcgacggctggattagggttagggtttgtttattctttttttttgtttcgattttttatttttccgtgcgggcggcacgcgaaaatcgattttcccgtgcgggtgcatcgcccacacgaaaaaatcgcgtatttttgcagacgatttcttccagacggtcgaatcttctgcacgcgaaaatcgatttcatccgcacggaaaaatccttgtagtagtgtaatcgattttctctatttttaaaaaaataaccggtagccaatgaaattgtactagataatgcatgttgcatgcatgcattcacatttggcatatgtctgtcgttaacactcgtacgggctactccagaacatatattgtataagaaaatgcttgcttttgtcaaaagggacaagcacaagcaatagcaaacatacagatcactacaggttctacgcgtgcatatggtcaaagaatcattcgtatctgatcaagcagaagcgtatgtatgtacgtacatagctaggacatatacatacatacatacatacatacatatatatatatatatatatatatatatatatatattaactccctctctctctaacctaatggcgccatgagctacagttggacatagctagcttattaggcagattgtccagtgtcgtacttaccgagctgtctcacatgtacagtgcccacacgcagaagcatcccatggtgcaatgctaacaccaagctgtacgtgccatgcacacttctgatttgtccatgcatgcatggtcactcttatcatcatatcggttccatccattcattggccctcgatccatatcgatctatcatcgcatgcatgcaagcgctcctactaggtaggtatggtactccagtaataactccactctggatcgatatgatcgattgatcgtcgtcagacaccacacccaccaactacacatacacacatccttctcgagccttgaacaagctatccatcacctttcacttttatataaaggcaaacaaaaagcgatgatcttttaggtgagaatttactgtgtgtttgctatcacattattgtgtacgacatatgcaagaaatgtatggaaaaaatatattatatatatatgatgtggcttcagggctagtagctattttttccctgcaggtagatctcattaaaaaagaaactactagctagtgttgtccatgtttgccaacattgttggaattttttttttaaaatggaattagtaagcttagttggttaatttcaatatgcaaccatccgtgcatgcataaagaaatttgtgtagtctgcatctaagctggagatactattactacaaatactgcatctatgtttgaatgcatcc

SEQ ID NO: 12046 - DNA, 1501 bp, Oryza sativa
cagatgacattctgggcagaccagtgatgaaatccatcccaatttcctcccacttccattctggtatctttaaaggctgcagcaaacctgcgggtttctgatgttctgccttgactcgctgacatacatcacacacagctacatactccgctatctcacgcttcctactcgcccaccaaaatttctccatgagatcttggtacatcttggtactaccagggtgaatggagtataaagtgtcatgagcttccttcaggactgtacccttcaactccttgttgtctgggacacaaattctctcacccaaccatacagttgtcacgcctagaaatttactaataatttctgaactaatttgtgcatagaatcctcgtccaggaatcagccgaggtacataaactgacaatttaatatacaaatccatcataataataacgttacatacttacaaaccaaaagaaaaacagcagcggaataacggtctagcgatggcttcagctccactcccacaggcagctcaactggggtataagccaaatgtcttctccttcggatcctttttcttcaactgaggttgattgattattgcaaggtgagcatatgacatactcaacaagccacacagcaaatatgcaagtgcacaagggtaccaaaggatggcataacataggctcatttgcaaaagcagcatttagcaaacatttaagagtagtaaaacagtagagtaattaatcatcaattttaaccaacactgcacagcaccccaatgctgcacaggcccaactatcctgaacaaccatacccggctatacagatctaactccaaaccaggagttaagcaaattattaccaattatagcatcaataattattgtgagaggtatgagactaatcacgaaaaacattgcttaacccgcccataaccgcgggcacggctattcgaatagttttactctggccagaggtgttccactgtacccacaagacacagctccacgacatgttaccatgcgcctcaatgccaccacggtatctcggaaaggaactgtgacagtacccctcgcacaacacaactcaccacagtgcaccattcctggatcataatcaccccctcaaaaaaaacagaggcatggacaccccagcgaaccccacggacttctcgccacttctcagtctggtgccctgcaatgaaccatgctatacaaaaggtaaagtcgttgcccacgctggattgtggttggcacggttaatgtctcacaacagtagctcatgaaccggttcttaattgtcaagagcatgaccttcaaaaccatgtgctcacaacccaccattaatcaggttttaattatcaattaattatcataacacaattaaccatcgtgagctaccattaaatataatcataaataataatgtagtgtgattcatcccatttatgagctaatgtttctaagcatggctaagcaattatatatatatatatagcatttagctgaaccaa

SEQ ID NO: 12047 - DNA, 1501 bp, Oryza sativa
aattaagagtataatgcaattactatgatgtgatacggtgccctgatgagtagtactacaaacatactgcaaataattaatgctttaatgctttaatagcaattttctaaattcaaatataaatagtaagtattcaaagccaatgggacctcacttcagctctctatttgaaatttgaccgaatgcacgctgtatctagagctgcaattttgagcaatttccaattctagtaagcattgcaaagaattcgagctgtgtctaaacaagcatttatttgtgccaactgaggctttgtttgaggattgggaaataatatcctaccctccaaagagtaatattgcatctaaccatccattcttcccacctcatttaatcctagccatttattcatttcccttttccaatcccagctcccatatcccatttgctaggttgggtggatgagcctgatggaagatggccgcccgatttttttttgtgtttggttgaagggcagggtagatgaggcggtccggaataaggaatattctctcaatatgctggataagtgcatctggtcgatttggctggatgaagtcattagttttggtctgggtgatgtgtcctattttaattggctgtggttgtttgattttctgttaagcaagctccaaccgatttttttctcctaaaccttttatctaatttatgattttattacacattatatttgttacaattaaatctttaaaacaagatctcagatgattaaattttgatatatatatatatatgggtcccactaacttttggttttttcccatacatgctatatccctctaacaaaacaaaaaattggatcgccatatctatataaaccaaacaaaaaaaattagatcaccctatccaacgaaatatagatcgtcatatcctataacacacgctaaacctaaccataaaaagcataggaaaagctgccatctccttaaaatttctttaattaaaaaaaagaacagaggaaaaatgaaaaaggaagagtataaaagaatagataaatgattgtgccatactcctatgtccaaaaataggcaaaacacggtaagctctaacttcgacatcctgggaagtttcacacaaaccagcacagagccacacgtgccaaaacaaaggcaagcatttgaagcttgtgagcaacgcaacaaatccttcactaccacccaaacagcaagtactccagcacactacaagaaaccttgatgatgaaaaattccatccaaatgattcaaaaccttctgtattttccggcgtttggagggtcgccgttttcacccaacatgtggcaacacttgcaacacaaacatctctctcccctcctcccccaaatgatcgctgtcattgcacgtaggccacaaaccgaatcgattactaagcagaaaattacagggattaattgcaccttatcacatgctgatcaaaatcgctttcaccgaggattccaggctccatgggaagtaattacgtg

SEQ ID NO: 12048 - DNA, 1501 bp, Oryza sativa
gcctatttttggacataggagtatggcacaatcatttatctattcttttatactcttcctttttcatttttcctctgttcttttttttaattaaagaaattttaaggagatggcagcttttcctatgctttttatggttaggtttagcgtgtgttataggatatgacgatctatatttcgttggatagggtgatctaattttttttgtttggtttatatagatatggcgatccaattttttgttttgttagagggatatagcatgtatgggaaaaaaccaaaagttagtgggacccatatatatatatatatcaaaatttaatcatctgagatcttgttttaaagatttaattgtaacaaatataatgtgtaataaaatcataaattagataaaaggtttaggagaaaaaaatcggttggagcttgcttaacagaaaatcaaacaaccacagccaattaaaataggacacatcacccagaccaaaactaatgacttcatccagccaaatcgaccagatgcacttatccagcatattgagagaatattccttattccggaccgcctcatctaccctgcccttcaaccaaacacaaaaaaaaatcgggcggccatcttccatcaggctcatccacccaacctagcaaatgggatatgggagctgggattggaaaagggaaatgaataaatggctaggattaaatgaggtgggaagaatggatggttagatgcaatattactctttggagggtaggatattatttcccaatcctcaaacaaagcctcagttggcacaaataaatgcttgtttagacacagctcgaattctttgcaatgcttactagaattggaaattgctcaaaattgcagctctagatacagcgtgcattcggtcaaatttcaaatagagagctgaagtgaggtcccattggctttgaatacttactatttatatttgaatttagaaaattgctattaaagcattaaagcattaattatttgcagtatgtttgtagtactactcatcagggcaccgtatcacatcatagtaattgcattatactcttaattaattcagacctgaatcttctccaaaaatgcccatttctatatgcatcaagcacgtgttaaaaaagagcacccaaaaagaaaatagagtgcaaaatatagttagctgtaaaaattaatgaattagcatagtgcccctctaaattctcccaaattatagaacccacccctcagcagtcaccacctcatcgatagcacaaccacacatgcacagtgtcacagtggtcacatcacccacccctatacccccctgcacgccccccatcttttttactttacagtatcccccaaatattcccgcaaaaattaaacccactcctccccattcccccgcaggcagaggtagtagtagtactagcccaagaagaggaagagcaagacgaagctggaggtggaatcctcccgccggcgacgagaggccgctctagatcgaca

SEQ ID NO: 12049 - DNA, 1501 bp, Oryza sativa
gtggaaaacccttacgggaaaaatccaccacgggcactggtcggcaatgatcactatagaagagttagatacaaacacaggggatacattgggctgtcgcaccctccctatgcggcttacaagggatatatattgtttcatttttttggatgtcttatcaaccttatctcaatcgatcatatctatgagatgtaatatctttcttattgtaataaactacccttctacagtattcattaaaatataatttagaaataactgatattttggttaaaagttgtaaaattattcaataaagaatccatatcagatacaactagtgaattgacccacacaactttgtgtgaggttagataaattaatgtagaagtggatttgtatacaacacttaacatttgatatataattgtaatttatatacaatagaaaaaccagatttggtatacaactcttaacacatattttcatagatacaattgtatagaactcttaacttctgtttttatagatgccatcatattttatatacaactatatttacaccgttataatttggatatatcacaattggacggttaatatctttttctttttatctaatgtgagaatttttagtcttgagagcgagagtggcttcttttctttggaataaaaataataaattagcaatctgattttcacatgtgaaagttactcccgctgtttctaaatataagtatttctgtgttatttagcaaagattaaggtaaacgagaaaaaaaaaccttttagttatcttattgttcaaattttaaattgcttagattcctcttgtaagcacatgattgctcaaaaatgtttgaattcccgtgcattggaatcaatggcctggaaatgttgatgtccggtataaattttgagtcatattaatttctatatttgggagtatattaactactatgtatctttaatcccgattatttcactcgggaccgaattcttgatcctagtttgcaacccaggattatagggggttgcaaaccgggataaataagggtttctccactagtgggagtatatgacaaataccgttccactttcatcttaccaatacacttacccactaaaatgaactttgtgatcgtgagttcctatgtatgatgtagaagctgttttttacaagctccataaaatcgttttaataagaatatagagctagttaaaattctggcccatgcgtaaagagttagccggccggcccatatatattgcgtacttgcatgcactggaatgacgtagcacttcatacatcagaataagattcttttttggatgcatcgaagatatcttttttcgaaggtggatgcagcgacgatgtcattcgattcttgactatgacgctcgcagccttggctatctattctatataatgtgagcagagtccaatccaattgtacgtcctcaagggtaattgtttaactatactgaaatctctgtagtttcaactgatttatttagcttg

SEQ ID NO: 12050 - DNA, 1501 bp, Oryza sativa
tgaaaaaatcgcatgacgtggcgctataaattccaagcattcccacagcgtttaagtaaaccaatatgcccatgcagcccatctctatataggccgttgcaatgcacggtcacgctagtactatgagataaagccattattagtcaaagacttatcttaataaaaaaaatcatgtattacaataataaaaaagtaaagtgcacaattaatctctaaacttgtgcgtcggtgtcatgtaggtcaaactcccaaaatgcaaaaaaaaaaagatcttaaaacatgttaaagtgtgtcattctggtctgatattgctacgaagccctctgggatgttacttggtgctgacatggcatgccacttggatgctgatgtgacaccaacactaactttacattgactgacaagtgggacccacctaaaacattttattttccttttttttcttcttttgttttttttccttctcatccgctcccttttcatttctcttgtctcttttttttttcctttctctttttccattgtggcgttggcggcaatgatatgtgtttcatctctagcaccgcggcagcgcaccctgaacacctcgtctgcgtcactaggggcacagattgtagctcactgaagttcctctccacctggcataaggtggggcgagacggtggcttcacgagtggagcggtggctcatccagctgcaaacacgaaactgttaaatagagattaaattccgtgaattaaagccgaattgaaaggggaattatggaaaaataatgatggaggagtggagaattaatatttgcaataaattaaaggaggaaacatacggtgaagtagatcgatgtggcgatggcgatagggttcggcccaccggtggctggaggcgtgctgcgcacatgtgcggatcagaccagacgagataaaaaacggacttaacgcgtgtgcgaaaaaaaaaccttccacgtgcaaaaaaaaaatcagaaaaaaggcaaaaaaaaaaaaaaggatgaaccaacaaaaaccggaagctttatgtattttttttattattagctataaatatagacataattttcttcctcttactaaaataaatatataagaatggcttattgggtatgcagaagcatatgtattcacagaaaatatacaaccatctggaatctaattcggaaaatcagttccaacttgtatagtgttttttttaaaaaaatgttctctttgttcccaaataaattacttgttagatccatagcaacgcacggatggtacttctagtgtaacgttaaccggtcagccataattgaagctttaatctgctggtgtcatggttacactattaattaactacaggaaaaaaatgcagtaacagtcaacatatttttttccccttatgttgctgtctccgctaggtttggtttctttggtgacaaaactgaacaagatttgcatgctcatctcgttcttactacatatcatcttaaatcaatcttccgatccgt

SEQ ID NO: 12051 - DNA, 1501 bp, Oryza sativa
atggatctcttgctcggccaatgtacttcgccttgttgagtttaatggccgcgtgcgtgtgtgcaggggtgcgacgcctccatcttgctcgacgacacggcgaacttcaccggggagaagaacgccgggccgaacgccaactcggtgcgcgggtacgaggtcatcgacgccatcaaggcgcagctcgaggcctcctgcaaggccaccgtctcctgcgccgacatcatcacgctcgccgcgcgcgacgccgtcaacctggtcagtatctgcctcgtgtttttctgcacccatgtaatgctggcattaatggcggggcgcgtgcagctcgggggcccgaactggacggtgccgctggggcggcgtgacgcgcgcacgacgagccagagcgcggcgaacaccaacctgccgccgcccggcgcgagcctcgcgtcgctcctgtcgatgttcagcgccaagggcctcgacgcgcgggacctcaccgcgctgtcgggcgcgcacaccgtcgggtgggcgcgctgctccaccttccgcacgcacatctacaacgacaccggcgtgaacgccaccttcgcctcgcagctgcgcaccaagtcctgcccgaccaccggcggcgacggcaacctcgcgccgctcgagctgcaggcgcccaacaccttcgacaacgcctacttcacggacctcctcagccgccgcgtcctgctgcgctccgaccaggagctcttcggcagcggcgccggcaatggcaccacggacgcgttcgtgcgcgcgtacgccgccaacgcgacgacgttcgcggcggacttcgccgccgcgatggtgaggctgggcaacctgagcccgctcaccgggaagaacggcgaggtacggatcaactgccggcgagtgaactcatcatgaacatgaaatggattcttgatgtacgcttcgtgaacgccataaacttattatcaaatcttgtttttaccaaaagcaaatggaaaaaatgctgttcttgcactgatttttctccaaatttcgatcgaagcgagcagcacacacaaaactctgccatgaaccgattcatggcggagtggggttttagtccggaacagatctcagccgctgattactagatcgacgatgcgatcagaacagggaatctgctgggcccgtggaccagtggaacactgcagatgtggcagcccaggatggcaatgtttgattggctgactgccagattatcgctgtcttttccaacgagctaagcagtttgtcagttgtcacatgagttaactctgaattttcaatcattttcaagtcttgaaccatgctttagatatactattaattaacgcaatttgttggctttctcaactctataaaaccgtgtgacagtggaatcatctctctttctgagataataataaagatctaattaagcacattaagcaaaacaaagcatccggtttccagcgatgaatgcatcattgaataaaaaataaacataaaatctagcactgaa

SEQ ID NO: 12052 - DNA, 1501 bp, Oryza sativa
tgaatgatgagtcggtgcgtttgaactgtccgtttggcttggctaatttgcttcacgcaaaaagagacagatcatgaattattcattaagtattactagtaactattttaaacatgaaaaataaatttatataattttgttttaaaaactttaaatgtaaaatatatcatttattagtttgagaggcatactttcttgaccccatgaagaggaagatatcctatgcacacaagtttctagtgcacaccaactatcaaatgttacagaaaattctagaaaaaatagacacatattttcaatagtactacacctagtatgaaatcttatcttcaattcattatattctagacgtaacaaaaaagtgaaaaatctgacaattttaagagtaataatctgctggtattttgttttattgttacggctaaaatataatgaattgaagataagatttcatacgtaggtgcagtactattaaaaatatgtatcctttttctggaattttctataacatttggtagttggtgtgtacagagtttgtactagaaacttatatgcataggatatgttccgccgatatggagtcgctcaaccaagtatctgaatcaaactcagccgtcagtcttttgccatcttgggtatgatcatgagcacacctggctgatgaacagtttggtgaatgaatcgatggcatgctggcatgcatgctgaggggtttgcccctttttgattcttttgaaggagcattgcattgcaagatgcatgaaggtgccgagatagctcatcaaaaggtgaccaacgaccaatggcatgcatccatgatccatcaatggcgcttcacctggcaagctccttgcagttgcagttgcacgcacggggaggaactcgacgaaaggctgccaaaatcgcacaagacaagctcgcacgtttaggtccccatcactgatatgagcgacagtgcgccactggtttgcattctttcataacttttcttggtttattggtctttgttgacttagaccgaagatgtaggttatttctattattaaaaaacaaaacaaccgacacaattttaatatttataaatacgataaaaagtaccttaaaatcaaacctaaaattaaaatttaaaatctggttacagtgaataagataacaagcaaagtgaagctgcaccacaaaatccatttccgtgttgtaaatcaaacatgctatcaaaattattttctaaaaaacacattacaaatacaagcgtccatgttaatttggtttgatgccggacaaggcaatggcttaattcttcacgtgaaatcagggacggatatagcgtgggtattgaaggagggagggaaaaggaggaagaagaagatagtcctcctctatcctattctagatccgtccctgtgtgaaaatactgtagtacttctttaaagttaacaaaatgtaacacaacgactgaaatcgaacctcagaaaatccccgtgttgtatttgaaaagaaaata

SEQ ID NO: 12053 - DNA, 1501 bp, Oryza sativa
tttagaaaataattttgatagcatgtttgatttacaacacggaaatggattttgtggtgcagcttcactttgcttgttatcttattcactgtaaccagattttaaattttaattttaggtttgattttaaggtactttttatcgtatttataaatattaaaattgtgtcggttgttttgttttttaataatagaaataacctacatcttcggtctaagtcaacaaagaccaataaaccaagaaaagttatgaaagaatgcaaaccagtggcgcactgtcgctcatatcagtgatggggacctaaacgtgcgagcttgtcttgtgcgattttggcagcctttcgtcgagttcctccccgtgcgtgcaactgcaactgcaaggagcttgccaggtgaagcgccattgatggatcatggatgcatgccattggtcgttggtcaccttttgatgagctatctcggcaccttcatgcatcttgcaatgcaatgctccttcaaaagaatcaaaaaggggcaaacccctcagcatgcatgccagcatgccatcgattcattcaccaaactgttcatcagccaggtgtgctcatgatcatacccaagatggcaaaagactgacggctgagtttgattcagatacttggttgagcgactccatatcggcggaacatatcctatgcatataagtttctagtacaaactctgtacacaccaactaccaaatgttatagaaaattccagaaaaaggatacatatttttaatagtactgcacctacgtatgaaatcttatcttcaattcattatattttagccgtaacaataaaacaaaataccagcagattattactcttaaaattgtcagatttttcacttttttgttacgtctagaatataatgaattgaagataagatttcatactaggtgtagtactattgaaaatatgtgtctattttttctagaattttctgtaacatttgatagttggtgtgcactagaaacttgtgtgcataggatatcttcctcttcatggggtcaagaaagtatgcctctcaaactaataaatgatatattttacatttaaagtttttaaaacaaaattatataaatttatttttcatgtttaaaatagttactagtaatacttaatgaataattcatgatctgtctctttttgcgtgaagcaaattagccaagccaaacggacagttcaaacgcaccgactcatcattcacactcacactgaccaacaaactccctgaatatcctaggctcctagcgtgaatcttgtgaattgtgaggttacattagtggagtatccaacattatctaaactctaaaccaatgcaaagcccccctttttttttcttttcattcgtgtttctttagagagggcatgcatgttcatcttcacctacctctacccctacctttctttgtctttgtagccaatcaagcttaaaagccatggataaatggagaaaaataaaaaagataaacccagca

SEQ ID NO: 12054 - DNA, 1501 bp, Oryza sativa
acttgtgagagtgtcatctaagtctctgaaatctcaaaatatacttttttttgtctccgaacttgtcgtgagtgtcatatagatctaaataagttccaaccctccatgtgcggacgtggcacaccacgttgatgcctacgtgtcggtggaccaaagtgctagtcataaaaaaattaaattaaaagagaggataaaaaataaaaataaaggagagagagagagaggagaaaaagatggttatttatttattttttactaatatgtgggtcccactaacatatatgcaccgctgtgctatgccacatcaacacatgaagtaagttgaaacttgtttagtcatatacgacacaaataataaattcgaggacgcaaaaatacatcttagaaatttaaaacctagatgacatgtccgtacaaatttaaaaattgcctgtacacttcactccttacgagagtgaacatcgggtgcttacaaatattccccttgtccttaaccttgtttatccatggactttcttttgccttatttatccatggactttcttttgcgcgagtcaacatcgggattcgagtgcaggctgccggacatatacacacacaaaggaatatggttccagtgcagttgtaatagagactgcaactttgcagttgtaatcatttttcaccgttggattaagacgatcaacggtttaaatctatgccacgtcgtttcaaacagtaactgctacagtgctcgctacgggaaatacgcagctacagcatttgtcaaatatgcccagtaatatcttggccattacttcccaatccaacggtgcttatatgactgctcaagttgcagtggctatagcaagtgcagtatgcaggtgatctcaattccacacaaagtgaacggacaaaggtttttaagtacaacgatctatacatcctaacaatttttgccttgtccttaacctttttgtacatggatttatctgcacgagccaacatcgactgccagatagctgagggggaactgtacagggagttcatgcacaaaggtcccttcgttgaaagtgtaacggtctatgcaaggtttaccttttcgtttacaaaatgaaaaccactccccactggtataacgaaaaccgaccaaaagatgataaaaactaacgactttaagtcaaccccgtaaaaaaccgctggccgttggtttgtgaatcttccacgggccacatgattgatagtcggagcaaagtcggggagacatcgaaaacacaagccactttggtccttgttgattggtcagttaaccccgtcccacacgataatactccattagtaagcttcctatagccatatccatcaatgtgactcattgccggcctgaacactctgtcaaggaaaacaaacaaggaattagaactcacagatgacagataaagcaatgctgcagattgcagtactttaatcttcaaaatacaagcatgaaaatctagctgcaccctattgtctgtaccaggca

SEQ ID NO: 12055 - DNA, 1501 bp, Oryza sativa
aatagacatctgtgttatttggatggtgaatatagtcgtcacgcgtcagtagtatgtaaattatatccactgtgcccccaggttaattgacaaacctcatgttttaagtacgagttataaacgttcacatctcaggctagaaattagcagcaatgtgtagggggagcgcacatggaggaaggagaacaagatattagagattaattatccttgctgatctttattcatacgcacagcaatacttaaattgaccgactaattaacaagtcctacaacttatttctactgcagttaaatcaactattgtaatcctaagccaactaacttgcgaccaatgtggtggcctgcactggctatgtataggtgtgctcaactcaactgcatattcgtgaaaagataggatggctaatatgtcatataatcataggttttcttcctcacagtaaagagaacgaggcacagatgacttcttcaacattacctcttccagaatttcggtatagtatttcactaatcttgtgctaaacattttaatttcttgctgttacttagatcaaaacattcttgaaatagatgttccctatttttcgccattccaagagatattttgatctgatatctactccctccattccacattataagacgttttggcctctacatccttcgtctagattcactaacatctttattaatttggatgcatatataaagcacaaacatagatctatgcatgcatatgttcataacccaaaacgtcttagaatgtgaaacagaggaaatatgtactaattgtataattcattagatggatcataccatcatgatctaaatccaatctgtgttcaatgtcatgtgccacctttaattccaaaatttgaatataaaaattagaaaagtgtagctgaggcatatttttattttactttatttaaactgctgtaactctaaatattaccaacatattgtgattaatattttaatgtttataataatagcccatgctatgcaggggttaaagactagttcttaacatcagatgtggaaacatatttattctagtctacatcgatatctgttactcaatttaatgttttgaaaacaatctgtattttatctgttccactagttctgtttcttgactaagaatattcaaagtcaatgctgagataaaccaacatgtgatatggacaaggaactgaaatgtacctggctctcattgctttcctctgtcctctttaaagacgttgcctttagaccaatacttctatcatacggcacacgacagtcgacagcaatacaactgggttagtgcaatggtcatctgaccttagatagttgtacaattttgaaagaagaaaaacacaagtccttataaaaaaaagaatcagcagcatccagagaattgcagtcctcttcttagttcttatacgctaattggggggttaaggaaaaaaaggagtgggatttgcgtgcacatggttgttgctgtgtacgagaa

SEQ ID NO: 12056 - DNA, 1501 bp, Oryza sativa
cttttttcacgcgaggagcttgccatcggaggcgagccgattcggctctcccttgtgagctagccttttctcgctcctatgggctagctcgcccccatgggctaggattttttttctgattccaaacgactgtccttgccaggccaggctaggcccctgctagccttggatccaaacgcaccctgagcctcctttactctgactcatccagatccaatggcttggaataaatcttcctttcatcagatggtcagtatttacttgatgacgtggcgcaatgtggtgaggaaaaactttagtattttcactactttagatacataatctgttgcctgtgataattagcaagcaacttcgttgtacaagctacccaacatatacatggctcagggcaccagggcggtcgcactgcccgtcctaccccaggaccagaccagaactgttcatgagtggtcgacgacggtcgagatgcgatggaaagtatggagacgataacctccacaagagtgtgcatgtagtgtctgaggcaaccgatgcgagtgtacatgtggctgaagtgtgcctgcgtcgcccgccgtgtgccagagtaggctggtggaggccgaggagaagtcgcgtggccatagaggattttgaacttgattaaataaaacatgtctttgtcttaataaaaaccaaagagaacaaaccataaatgtatttgagaaaactgaataagccttaaaaaagcacaattacttctaatattgttcattctgcccaattacttctactcttattcatcatcctcatcaagcccaattattttttatcttattcatcatcctcattaagaagcttgaggtaatcttgttcatcatcctcatcgaggagcttgaggtattgttccaacttaggtatgagggccatgacgcagggaggcggggggtgagccctagcgacacgggcatatcgcttctgccactccgtatccggatcatacctgtgcagcttccccgcccgtcggtactcctccaccacctcctcctccgtcatctccatgtactggtgcgcgtccgcgatcaacgcccgcaagaaggctttcgccgcttcctgttccgcagccgtccacttctccaagtaagcgtctatcccgaacggcttcttctcctgccgaggctgtttctcctcctccttcgcgtcgccgacggcggaattctccaccggcgtctcgccgtctttgcgctccatcgatctcaaaatcgaggatttggatggaggattacgctagtttttttttaggaaaaaattaggggacggtttggctttgggtcttggttgattgatttatttataggcgcggtctccgcctttccctgtacgcgttggcctacgagtcggactatgtttgtccgggtcggagttgagttccggctcgagatagcagcggagaccgtcggattttgatcgcacggtctgcggctccgtgtcggcctcgctggggttcagcgctgcgacgcca

SEQ ID NO: 12057 - DNA, 1501 bp, Oryza sativa
aatttcatttccagcagaggcatacacaagatcttcatttcctaccaaaagagaggacattttagtgtgtgacattggcacgccccacatatttttgggacaaaactctggagtggtttggacaacggagggcatgctgacctgctttgaaacacacagaagaaattggttgatttgtcgcctccatggtgaaaagcacatccttcgtacgcaaatcaaaccagcaaagacatccatcctaatgtggtcaaataagaagggtcaagaattatgaatcatattctcaaggtagtgcgacacacggttagaattgtaactttgcagaaaaagggaaatgccctaaaagaagaaaacacctactggctgtaagatgatatcagcaaacggatgcacattcaccaagttcatagcaattcataacgttcttgcatgtacctagtgccaattttgtagtttttaccgatcgtatatgaaatcctagatgagatctctacaacatcttcatgctgggaaagttatggtgggacaattggtactgaattagtgaactcaagtgccatcaggaagcagcaaggacaaggtgaaatagggaactggatactaatctatggttatgcaggttgctactttcacaaagttaccagtgcattattgtacacagcagtggaatgattatctcagtttgccgtcagagatgcaagacctctatagatcggccacatgactattgcctactagtgccttatgaaccagctcaaccgcccccgctaacgcacaagcagccatctaaagcctccggcaatgaatttggctgccaatagtcatggctgcagatttctgcatcgcaggggaggaagcatgcgatgcgagcctacaagattgtgccactagctcagcagacagcgcccacgaggtgttcgaccgttgtcctcagcgaagggcacccctctcctcctcctcctgctgctgctgcagcaaggtgtctcccaccagagaggccacgcgttgctccggcagaggaagtcgcaaggccctggatggcgtcgcgcgccttcccctcggaagaaagacccacgcacgagcagaatcgcttacctcgccggaggaggcgacgacgcccgggcgggaggaggaggcgacgcagcaggtgacggcgcccttcttgtgcccccgcagccgcctcggcttccgaccctccgccgccgccgccgatgaatccgtctcggacatggcgtcgcagcgctgaaccccagcgaggccgacacggagccgcagaccgtgcgatcaaaatccgacggtctccgctgctatctcgagccggaactcaactccgacccggacaaacatagtccgactcgtaggccaacgcgtacagggaaaggcggagaccgcgcctataaataaatcaatcaaccaagacccaaagccaaaccgtcccctaattttttcctaaaaaaaaactagcgtaatcctccatccaaatcctcgattttgagatcga

SEQ ID NO: 12058 - DNA, 678 bp, Oryza sativa
acctcctccccccatccctccccctcctcctcctcctcccgtcgccataccaacccaaacccccaccttctcacctcgccgcccgcctcgcccttgctctcgccgccgcggagaggaggagagaagcgtgaagcgagaagagatcacgcggaggcggaggcggaggagggggaggaggttgtgggtgggtagtggaggccgcagtggcgtgagctttgacaaagcaccgggggttgcctcgccaccgtattacccctcgatctccgcttatttacgcgcatgccaccaccgcggcgccgcgtctgctctaaccccgccaggggtagtctcgtcatttcgcaccaccaccccacaccactagccactagggtgtgcgtggggggcaccccccacgaagcgtgtctctctccctccgccggggtgggccccacccccctcggctcggtccacgtcaacgacgctgcacgtgggcacccatgcgcggtgggccccacgagcgggacacgtgaggagcctattgcttttgcgatcaacccacgcctctctgtttttttttcgctcggacgtcgagtactgtgctactgctccgtccagtattttaattttggcgcgtgcgattatttttattttttttcctccttccccacctcggcgtgcgagggtggggtggggccagga

SEQ ID NO: 12059 - DNA, 1501 bp, Oryza sativa
tagccatcccccagatctaccggcgcccgccagctggaggcctgcgccgggggctgacttggaagtcggaggcgcgcttcgtcggcgaggggggtgtagaaccagtcgctcttccagtcatcccactttttacggaggacgcaggggatgtagcggttcaacaccggcccccgcggcaggaaatagcagccgccgaccaccgacggtggcgataccgactgcacggtaaagaaccaccggaacagccggagagatgggcgcaccccaatgaacatctcgcacaggtgtgcgaagatgcccaatgtcatcactgcgttgggggtaaggtgcgccatctggagatcgcagaactccaggacatccatgaagaaagaagaaaatggcggaaccagccccgccattgcgaaggggagaaagaagacggaccgccccgggtagtctggcgccgggcgtccctcacccagcattactatctcacggccggaggcggattccggcatgaagcggcgcggcaacccagcctgcttctcgctcacaatgcgagaaggcggcagcacgctaccatcaagcagtgcggagccccgtgccatggcgccggacgaagagaagatgaagagcgagcgcgtgcggcgaaagaagggcgcagggaagaaggagttaggacgcaagcggcgaaggcaagggaaatgatggcgaaaggaaagagacaaatcccatcctcagtgcttttatacccttgccaaacgctgcgcccggctcctcgtttctcgcgcccattatttcgccccctcgtttctcgcgcccacgcttccactaatcccattcgcccgcctatggcgcgtgagatggatatgcggttgcggcagtcgagatagatcgtatcgtgcgcgcgttaattacgctcgccgaccgaagcgacattcccgtatctccaggcgaggcaaatcagctcgcccagattcgtgcgccactcagttgatgtggcagtcttgaagagaccgcccattattgacagccaaattaccattactggtgtgcatggtttgagaccgttgggtttttgcccaaccatggagaccggtcccacctgtcaccaggctttaggaatggcgtcacgcccggccgctccccataagaaggacgatcgcccaggcgtaacgccgggggctactgtcggtgacatgggaccgggagtatcatgactcgaggcttgaggcagacacaatcgcccacgtggcctggcaccctcgggggacgtcgggcccgagggtgatgtgtgcgcccacctcttggtcttcccgagggggggggggcgggccactccagcctcgcccccgagggtggaggcgccccgacccctcgcgttttttactccacgtgtatgggttaggtgagcacagcggggctcacctaaccgcatttattgcaccacggctaagcgtgtcacgccgcacgaaatgcagtgcagtgcactcgattatccggtctgtgaccagtcaca

SEQ ID NO: 12060 - DNA, 1501 bp, Oryza sativa
tcccttggattcgtttggaaaccctcccctaatcccgccggcgccattgatggagcccgagaacgccgcgccggtttccttcccctccggccgccctctcccccttccaaccctatttaaaccctccccgcacctcctccgtccgtttccgcctctcgccaccctttctcctcgccggattcgagcttgcgacgtcgctctctctctccgccgtcgccgccaagctccggtccgccgccgtcgtcgccccggaccgcctcccacctcggtgacacctccttcgggttcgccgcatcctcgccaacctcgtccacctccccgtttcggtcgccgaccgccggaacgccgtcgaccccgtcgacccgagccgcgctgccgcctccctccgctccggccgcctcctccgtcgccgccgtcgccccggggtgagccgtggaccgtcgcctcctttcccccttccctcccctctctcggccgccgctccgccgcgccggtggtcgccggcggcgaccatcggggcgtgggcgcgccgcctcccgccgactgcgccggcatggccgccctccgggcgcgccgagtggccgccgcgtggggcccggccgtcagccgcccgcgccctcgggtgcggctgacgtgtggggcccacggcgccggccggtgcgagcccgggtgcacccggtccaccgtggaccgtgaggctgccgcgtgggccccactcccgtggacccagtccgcgcgcccctccccctcggctgacgcaaataaaccctttttaaattaaaatttaaatggagaaattcgcaaatattcatttaaagagcatataaacttcaaatggccataacttggccatttgaactcggaattggaccattcaagtctctaatttttccttaagaagtcaagaacccatttttgcgctttgttcctgcttgttatatggagtttattagagtaaaagccttttcttttccgttggtcgtgtagacgctgcagcttcggaagatccgctcttcgtggaagttgaagccgacgtttggcaaagagagcaaggcaagtcacatcatccttgaacatattgaatcccagtttataaaattattttgatttaaattattgcattatcgctttatttaaattcccgcgttatcactgttttatctagccatgcctatgtacctttgttatgaccttattattgttattgttattattaccttgtccaccctagaataaacaaaacaccaactagtggacactctactcatggtaccactagtatgattttaggtagatgcttcgctggttaattaggcaacattaggtggttttacaactctagactttgggatattctcatcacctggacactatggaattgttggatcagtgtggaattggattcacacctccccctctattcaaaatcctcaaaatggatttaggttgggctcggggtgcatggttttgatagtagcacctcggccatataaggaccggt

SEQ ID NO: 12061 - DNA, 1501 bp, Oryza sativa
gggagtcgttttagacggttttaatagtttaagaagtcatcatatttggttttgtggtttaaggatatgaataagattcgacgtatatttaagggagtcaaattggattttttcctattttgaataccttgggcccgcctctataacaggcctatctctatatctgctttagttgtagatttgcagctcgcaagttcttctgggagaaaataacgcggttttatccaattcgaatacatgcaatatccagtaaatacttaacagcgatgagcagaaggcaacggaccaataaactggcaaatacttaacacaaaccgtactattacaagtacatgttatttaacctctcccagaaaagccatagaactacaagatgggatgcagatttacttttgccctggtatcttcccatacaacctgaaaagataaaatttcagttaaaacacaggttaataagctcaattgcctgcaaggctgctacatgctcaaactgacctcgattgacagatctatgtaagaagatgtcaccatcaatgatagagccatactaccggtgaggatagaaggtgcacaaaacaacacatcatgaggctgttggaattaatagatgggccttagcctattcaaaaattaattctttggaaaatcacaaaagccaccttatgggaggatgctctcctagccacgtgaggcatgtgaggtggaggtaacaagaggaatacacgaggcgaggtgcatgcacgactacacgtcgaatagttcgtcaaaattggttccttactcttgcgcagatgtggtcttcttttgcagttttattttgatgcatgaaattgttttttgtttttttttgggaaacactccgaataatccggtgcttgaaacggcgtggagtctagataagttacgtgcgacttatccggttcagttacgcggagtggagagcgtgcaggcgccctgatcaagtgacatgatatctctatataagttgagtccccgcctccatgcaacgcacgcaaaatcaatctagggtttgcctcctcctctgcatcgcgccgttgctcgtagactactccatcccactcgccgacatgcaccggcgatcaggagagcaggtcttcggaactatagccttcgacgtcttgcactgggagaaggtgacaataaggattttgggaagcgcttcgcacgactgcttcctgttcgtccacaacggctcgttttcctcttcgttcacgtgctgcgcgccgtcatcaacgcatggtaccgtgagtccttcttgctgggcaaccgattttccaaaaccctcgatacgcatttagcatgtttcgcatattcaatctattcatggtttaccgtctagtttacacgtgtagatcgtatgatgcgattatgctagtttacatctacaatgtcatgatttatttatagaataaattaaatcattatgtgcttatatattcaacaatccaaaaactttattataggaaccgtggttttacta

SEQ ID NO: 12062 - DNA, 1501 bp, Oryza sativa
caccacctacgcggtcgaccgccgcgccgtcgccgccgccattccgcccacgcctaccgagctgccgccgcctcacgtacgccaacaacgttgtcggccctatccccgtcaggcacgcacacgcaacgccgcccccttcttgtatactactcccttacactatgggacagagagagtatttgtcgattttgtttttctttttaaattttatttattttagcccatagctccgtcaaagacacggagaaaagaacaaacacgagagagaaggggggaaaagcagcaacaacaagaggaggaggcgccgcagccgagaccccagttccgattgatctccggttcccagatcggccaggtttgtccccacccccccccccccccccaattcgcctcctgaatccttcttcccccgcccggtttcatcctgatcggtgcccgtttcatgctgttccgtgcgcggattagggttcttgtgctaggatctttggggggtgggctggtgttgcttgatgggtttgttctttcgtgtgtgtgatctgccgtggaaggaaagaggaacagattcttctcctgaagaaacctttaccatttctgtctgtgggattggcccatgggagagggggggtgtagaatagttattctaggggatatatatttgtatgtataaatacatatatgtattacacacatataaattaaagcacttaacaatttatgtgcatatattaccaaaatatatatttacactaaactaaatgtgtacatatataaatatatacatatatttacaattccttcggaccctaaatataatgtttctatcatatgctcgctagctacgacttcgacgccggtgttatctcagaagaagaaggaccgacggtatgaattgtcgatccgtcgtagtagaattcaccctcgggatcaaggatttgttcgttgatgaatcccatcagttgttcttgaacagccgtgataaaatccacttcatcttcttccatttgaacccctagctcttcgtgcaatgcccaacacttatagctaggcatgaaccccgactcaaacaagtggaaatgaaaacttcttaatgcagaatactccttctggtttttgcacttattgcatggacaacagataaaacccttatgcttgttagcatcggccactctcaaaaaataatgcacgccatcaataaactctttcgaccgtcctgtgctgaaatatatcttacttgtatgggagctatggagttcaattatatctgctctagtcaatgtgagaaatacaaaacctgtcgtattaaacatttttgaatgactcctaatagaagataaatgtgtatggagttcgacaggttttctagtaaaagattcatatgctagcaccggacagatatatccatgaacccatgtcgaccaatggggttccaccacgcgcctatatataattgaggtcttctttccctttgcctcaactccacgcgaagggaaaaagtcttcct

SEQ ID NO: 12063 - DNA, 1501 bp, Oryza sativa
acccgaccggcaaaccgatcgattcccacgtgaaaatttgagctaccatggatcaagaggagttacccttacaaaggagaaaaacaaatttgaggtaaatttgcggaatcccagaaaatccccaatttttgcttatctttccccttttcttctattcccctcctcttcatgtgcccctgaaccttctcctccctgaccacacaacggcagacctagcagcaacaccagcagcagccagctttggatcacggcagcagcgccaaccatcagatcggcaacaacagggaaacgatagaaggaggagcagccgcaggaactcaccgggaagaagcaaaacggaaaggaaccaccggttgcgatggatggcgacggctgcgacccccggctatggccgtggtggcggcgcaaagatagcggcggcggcaagaacgcaggcgtgtggcggctagggctgctgctgtagcgctctcttttttttccttttttttttctcttttttttataaaagagactaaaaagagatctaacggcgcacttcgtttcaaaccccgctatttcgttcggactccgattactataaacttatatctattttgcattactcgacgagctctgcgcatccatggtttctgatcgcctattcaaacaacggtttaaaaattgaacttttacgtgtttgttcaaatattccccgaaatatattaattcaaaatccagggcattacattcttctcccttcaatcgaattcgccatcgaattcgtccaaccatactctagaacacagggtattataggtggggactagggaatggggacggctcatgcacggtaggaaaggtaggagcagtatttctggcgccgtttcggattgtgggaatgaaacgagaaggttatataaaggattaatttgatccattgccattgtaattattgtattttagataaatgtcattacaatttatctattcataattacatcatcaaaattttacaaaattagagccgtgcccctatcgtcatgttttctattttcttttccatctgcacgtgggacccacgcatcatattcttcttcttccttcatcttccccttttctttttttcccatatctctccatcacctttcagcctcccacccaatccatcacgtcctctcctcgccatatatgccacgagctgcacatggccaccccggattccctccccactgcccttctcctccccacctgtcacacccagaaattcacgaaccagaatttctaagctgaatatgtattaaatccctgtccaggaccagccagggtacacaaacgacaattgttgacatacagatctacgtcttacaaaaatacaaaagattacaaatgcagcggaaaagataaaacgagctagacttggacgcttgacttcagcagtggggcgactccactccacatgcaatccttgatggcagcgatgaaaccaacctctctaagatagctccaacttggaagaacttca

SEQ ID NO: 12064 - DNA, 1501 bp, Oryza sativa
ttaagaaaataaaattgggaactaaaccaatccttatccaaacacggaaaagattgaaagtaactctaatcaattatatctctaacagtgtaaaacatggattatcattgtttctatggatattaaaataatattttatctacaagattatgtagagggtgtagagcagggctcgaaatccataatttgttagtaattaaagggaaaaatccaaatcctctataatctttgaaataaccatagcttcttgcacccggaagttcattgtttatgatcttggactctataaaaagcttacctagaggggtacccaacccagttaaaaccaatgtctaaaaccactcaaaggattggttaagtttgggttttctctcaatgtagcacttggatatgaaactttgagcactgagacataaacaaacacatcgacattgcatcccacttaataatacgccaatcctatactcaaacgcaaatagaaagaaaactataccaacaggaataccttcatgatttctttctttctttgtcttgagggatgttaacaccaaaaccatttcaccttgtattctttaaaagattgatgatgtttacctgtagctttaaatggcctcgcacaatacatcacgacaaagccttcacttgtcctttacctccagattcggtccttggtgccaagccattgcttgcccttcaccaccacatggcctatgacgaccaatcatttcttgcccttcaatatctttccatggatagctacttcataccccacctcttcaatatcttcacagtaattctcatcaattgatctttgcttgcatatttcaacttttttcatcctttgaccaagcaaactattcatcttgatcattaggtgtcatgatgtgacttgagcattagcaccttttccatttctaaggacctatatcttttatttaactcaatgaaattgttagttacaatgatcctgttaatgatctctaatacttgaccaaccaaccgcatataaagaatatgaataaaatgatgagtattaatgttgaccgtcattaagtaccgatttcgatcgtcaattatctcgacaaagaaagagaactaacatttcttgcattgtcacttggttcaactacttttactcatacatcccctgaccatggctagtctgaccgcaggccccatgctggtcagaccgggccaggctcggtttgaccgggcctcctttgagtcggttggatgcccctagcttggcgatctagagctgccagagccgaggccaatctgaccggccgacctatggtggtcaaaccgtgctagttgtgcctatgcaataaatgaaccgtaacggcttctagccgttacaccaattggcggtctgaccgaccaccctatggtggtctgaccggcaggcaacaggggttggggatttcgaccccaatggccagtttttgtggatgtgggtataaatactcccccatcagtagcaaggggactctcatggcac

SEQ ID NO: 12065 - DNA, 1501 bp, Oryza sativa
gtaataccctactcctgtgtttttggtggatctgtgtatgaaggagctacaaagtgcgagccgacctctcctttgttctaaactctgaatcttcagagaatcaaccccccaccacctatggcaaggtcctccttttatacttcaaggggataccacatgcacccctccctttccaaactggacttttcttcttttcataaatggacggagatttgcacggtcgtcctccgaacatccttctgatgggacggcacatacctacctccacttctgactgaggcgggcacgttgcgggaaggcggctgtgtactgacggcatgagcagtgtcagaccggtcacaaatcggtcattcttgtccaccacacgccggctcagcaacgtgcatgtttgccctttttcaaacaacatcttgcttgtaatggttaggatgaagcctggcatatatcgatcggggctaacgtgtcatctctgggacgtaacacgctagctccagccggggacgagtgcctaggagctctcgtctagacaggatggggcgaagcatgcgtctgaccgcctgtcgccacctaacccgcgatttgaccggtctgtgactggtcacagaccggataatcgagtgcactgcactgcatttcgtgcggcgtgacacgcttagccgtggtgcaataaatgcggttaggtgagccccgctgtgctcacctaacccatacacgtggagtaaaaaacgcgaggggtcggggcgcctccaccctcgggggcgaggctggagtggcccgccccccccccctcgggaagaccaagaggtgggcgcacacatcaccctcgggcccgacgtcccccgagggtgccaggccacgtgggcgattgtgtctgcctcaagcctcgagtcatgatactcccggtcccatgtcaccgacagtagcccccggcgttacgcctgggcgatcgtccttcttatggggagcggccgggcgtgacgccattcctaaagcctggtgacaggtgggaccggtctccatggttgggcaaaaacccaacggtctcaaaccatgcacaccagtaatggtaatttggctgtcaataatgggcggtctcttcaagactgccacatcaactgagtggcgcacgaatctgggcgagctgatttgcctcgcctggagatacgggaatgtcgcttcggtcggcgagcgtaattaacgcgcgcacgatacgatctatctcgactgccgcaaccgcatatccatctcacgcgccataggcgggcgaatgggattagtggaagcgtgggcgcgagaaacgagggggcgaaataatgggcgcgagaaacgaggagccgggcgcagcgtttggcaagggtataaaagcactgaggatgggatttgtctctttcctttcgccatcatttcccttgccttcgccgcttgcgtcctaactccttcttccctgcgcccttctttcgccgcacgcgctcgctcttcatcttctcttcgtccggcgcca

SEQ ID NO: 12066 - DNA, 1501 bp, Oryza sativa
tatgtcttataggaaaaagtacaccgaaggtccctgaacttatcatagagttacaaaaatgtcctcaaactgcaaaaccagatatccggcatcacttaactaatcaaaactagtcacaataggtccttcgactgttttgaccctggttttgttcgacgtggcggctgagtcagtgtgggacccacgtgggccccacatgtcaggatgccacctcatctctctttcctctcttcactcccttcctctctctcagtcttctctatcgcgggagaggaggagggcggagctgcgatggccgcgggcggtggcgggcggcggctgcagcaggaaagcacggtggctccgaggcctacgacggaggcacggtggaggccagtgagagaggaggcacagggaggagagtcggggagccgtgacgctagctccccactgcttccgctgccgcggccggcattgccgtggatgaccagcctcgtcaacgtccgcgacgcgatatcggcgaagctcgtggcgcaatggctgagccgcaggtcctccagaccggaagtcgcaaccggacttgctcgacgaagcggcctccgagcgagacgccggtgaggtgcagcctccggaggcggtagtagtagcagtcaccggtggaggcagcggggaggtctaggtcgacgagccgccgggcgccgacaaagcagtgagctaggccaccacctccacctccaccggcgcggagaagcactggacaccgcagtgcacccaccggacgacgtggcggagggcatcccatgtccatcccgcgggcgacgttgacggacatccagaacctctcgagtgtcctggtgcggtgggtgagcagcagcgggtaggcgatggactcgagcttgtcccactgcaccgccatcttgttttcgccgccgccgacagtggtagctagcttagccgatcggcatcggcctcatcgtcgttgccgccgctgctgccggcggtgatgcaagtgcgcttgctcggcggagcgtccatcattgtcttgtcgattagtctcggctgcgtcctcgcgtggtcgagggcggctcctcctcccgatgacggcagctgcagtggggaagtacggcggcttcgccctccgtcacgcactcgcccgctgtcgctctgctccgccagccgccgcgcgctcgcacgccacctctgtcgggcgccgctcagccccgcccgttgctaatcggcctgcgagagaagaggggaaagagagaaatgaggtggcatcctgacatgtggcgcccacgtggatcccacgctgactcaaccactacgtcggataaaactgggttcaaaaccaccgaaggacctattgtgaccggttttgattagttaaggaacgccgaatatttggttttgcggtttgaggacgttttttacctcgatgacaagttcagggaccttcggtgtactttttccaagtcttatatggttggtataagtttattttgcatccctcttctctttaggc

SEQ ID NO: 12067 - DNA, 1501 bp, Oryza sativa
gtcgctgccttttcgatcactttgttgtcgcgcccctccgccggcagatggaccatgcatcttcttcttcacttcttcttcttcttctgcatacatagatacagatatactccctccgtcaaaaaaaaaaaaaaaaaaaagacaaaccctgatttccgtgtccaacgtttgaccgtccgtcttatttaaaaaaattataaaaaaaattaaaaaaacaagtcacgcataaaatattaatcatgttttattatctaacaacaataaaaatacgaattataaaaaaatttcatattagacggacaattacaattggacacggaaatttaggattttttttttttaaggacggagggagtagatcccatctgaccgattgatttcatgcccaccgaaaccttccaccaaagcttctccctgtccaacgtacgcctgctgtttctcgtcctgttttctctattatattatagtactatattgcgacgtgtacatgtgtttgtttaagccttctgtagcttgtgtttggaagcatactgtataaattatgcatactttgatgctaaattatactttgatgcacacggatgttctgcgtaattttgcactgcactataggggacttctttcagaagatgtttgcacgaaagaacagacctggcagcacagaatatccccccaataacaaaagcttgtctgtcaccagttcatcacgcgatgtcgtcatagctgtgaagaaaagaaaaatcgcccccaacactccctggtaacgacaacgctccggatgccagaaaaaatgtgctgtttcagtgctctgctgggtgcatagcacagacgtttctagcgagttttccgggcacctgacacacagacacaggaatttctctcccccttgtgtctcacatgtgagacaagcgagatattattccccagcaatcatccaaaaacagaggggaaagaaataatacttgtacacactacatactccatcgttcgttcttcagagagtacagagatactcctactagtaatacatacagagctgatgattgatcgttggagactagtactaatacataactattcaagggaaattcagacacaagcttattaatctatacggaggatgttgccatgtaggaccccaaaagaaaaggggaaaaaaagaagaagggacacatcagtgatagcgaagggcggcatccttttgagagcaaataattgcactccactggagtacccgtagtacgatccatcatcgacgagtccatgtcgtgtgccaccaacttgggtttaatataacggtgctcaatttacacagaaaataccttgcaaaatcccttgaaatatgcctctctgcctttgcagacgaccataaacatcaaggaaggcagcaaactgcaaacccccatcctgtccctctccccctcccttaccttccactcttgatggacacagccgccaagctccactctcccaccactcccctcctcgcccacgcccacca

SEQ ID NO: 12068 - DNA, 1501 bp, Oryza sativa
tatttttctaaaaaaaagctaatacttaggtcttgtttggttcatgggactaatccattagtccatctattttagtcccaaagaatccaaacatgggtgactaaaagggactaaaagtgcatattgagactaaaatccattagtcctcttagagcatccccaggagctagacatatttcatcctccaaatacccatatggatagtcatctaaaaaagattcctcattcatatcccttcccactccaacagatcatccatatcccaccctcctatattttaatatcttccaactaaacttacttttacttttgtatttttaagggacatattttgaactactaaattttaacggtgttatttatcgcgataatatttcaaaatgagtatatttaacggatatatttttaatagataattttttaatttatatatttgaattgagtgaagcattttttggatatattcgcagcaacatcaataaaatgaacacaacaaaaatatatcaacatttgtactctattcctatttccttttctctactcaggcagcacagtcatgaacatactgctactactctttctgtagaggaagcatgtggctagcaggcgcggtggcgggtgagctggcgaggggcggcggcgggtgtgtggccgagggttggcagcggccgggcgggcgaagggcagctggcgaggggcggccgcgggcgtgcggcggagggtcggcggcggtgggtgtgtggctgagggtcggcggcggccaggcggatgggcgaggggcggcggcggacaaccggacgagggcgcggatgggcggggaggaggcagacggcgggaggagaagctcgagggcactgctgcgggtgttcgacggtgggaggagaacctgggcgcgggtggctgacgacgggagctcgtgctatcgcgaaacctccagatctggtacgcctattcctccccaccttcactgctctatggctccagcagccagtgtaccacggcgtcgcctgctcgttccggaggagggcaggagctcgcgacggatacggtggatgggatatggcgtgaggagagagaaacgccaaatctctctaatatggagcacacgctatttttagatgactagatggaagatctgctggagcatcaatttccttaggacggagtacgggatggagttgctgctggtcatgctcttagagttatttataggaactaaagtggcaacctctcttctctctcccttggtctatgtacctttagttcctggatccaaacagtaggggactaaagtttttagtcaagagagtaattttagtctagagactaaatgatctaaacatgaccttaattaatcatatgctaatggactgctccgttttatgtgcgcagaagatttgtttccaaccagtaggaacgaacacagcctaaggtatcatcagtctgttacacatatttttaggagcaacccaacctgtttatcatcagtaatttgccacaa

SEQ ID NO: 12069 - DNA, 1501 bp, Oryza sativa; identical to SEQ ID NO: 3261

SEQ ID NO: 12070 - DNA, 671 bp, Oryza sativa
gttgtcagggatgtaaaatgtatctggctctactttgtaacgtgtggtttgttggtcttgattaactaattaatgtaatggaatgcaaggtttggtttctgactatgaaagaagtatatgtgtttttgatttactaactgtcaaaataccttatcaaatttgtagaggtagtgtttctcttggtctctttcttggtttgaagctttaccactgcaactattgctagcatgaggcccttcacagggcgcttgcgtggcgagtaacctcgtcggtctagctacgccaaaccttgacgtggaggagaaaaggaggtgagtcccgtgtctttgcaagttttgtgcatcctattaaagtcccggtttcctcacacccgaaaaaagaaccacgcttgctactcctcaccaatcctccccatttcgaagatactctgcattggatggcctgtacttttatgtgtgtcttcatcacctttttcttaggtggaagctggaactatgggctatgggcacggtgcattactcttgccatgaagctcttctccttatggaatatagtcctaggtcctaacgacaaccttgtgttttcgtcaaccctggttttcattttaggatcaaacacaagtagccaagcttggggttgggggggggggtgaattggatgagggacatcaa

SEQ ID NO: 12071 - DNA, 1327 bp, Oryza sativa
cccccgctccgtcgccagcaacctctcccccatctgccatcacgcccgctcgactacttgagagaatcaacgacagaagagaagagaaaaaaaaagaaaagtgaaatgtggggcccacaccattttctctcacttacatgtgggccccacatatcaattttattattttcctgactaggatgtcacgtcaacgaaaccaggcatctatactgtcccgggaccttttttttttacgattttacatagtttagaagtatacatttctggtattgcagttaggggaccttatacagacttgacgtaaagttgagggatggccggtgaacttattccaaaactttacagccgttttagcatgtaaattaaccgcagatggggcacaaatttttatccgtccgatatcgaacctcgcagcctcgactgccgtcgagcccgctactccgtgacgctccgtgctctgccccgccgccaccgcacaccactctccgcttcgtttcgttgttgccgctgagtcgccacgtctgcgccgccccatcgccggcgccgccgcgatccgttccgcaaccatctctactactctgcgccacttatgcaaaccggcctcgatcctcaccaccatctgctgcaccagcgtcggttcacgccgggtccgttgtctacccaccttcgctatccataagggaaggaagagctgatacaagcggagagggaatctagggcgagaacgatctgcgccgtcgcctcatactcaccggtccatactctgcctccgaccctttatctctcgtcccagcttctcctttctctgtacattcagcccacatcattggctcattgcttcaacaccctgcgagagattcggcttgcctaggctccgtatcgatatggctttgtgattcagatttgggtctattcatctttttccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgt

SEQ ID NO: 12072 - DNA, 1501 bp, Oryza sativa; identical to SEQ ID NO: 3258

SEQ ID NO: 12073 - DNA, 1501 bp, Oryza sativa
ctgaaaaatatggtcattacatgcttttacttcttgaatacacgatatagatgatttattgctatgaaaaaaacttttcaaatgacaatactatgtttagtactccctccatttactttggatagtaatattttatcttggcacacagaccaagaataagcaattctacttatcatccatttaaatataccactagtcattcctcgtaaacaagcgattcgttaatatttacatttctcgatgcccatgtaaccaatcttgtgtggaagaatggagagtcacgcattaaatttgagaaagtcattaagatgataggttgttggattgaaatatgcctatcaaaaataaatttttcagatttagaaatatgactatcaaagatagatggagagagtaatatttgtcactaaagttgctctatgtactgtaagagaagaaaaggaacaaatttgagtgtgatatgctcatatgttagatttgtccttttcaaaatataatatatatatatatatatatatatatccctccatcccaaaatatatttatcttttgattgtttttgtttattccaaaataaccgcatcttttaaacaatcattgcatcgggttttatgaaagtaagagataaatatattataccaatcctaacccaagacactagacatagttttcataaactccacatcatcaagaaactagtattagacactactctttcaatacaaacaccattgtttcatacttaaattctatactacttatctcatatgatatcttaaatgttgtgtgaaaccatgtctcatgcaagtcctggtttcttctctttccttatttattcacttggcacatcatctttcattctaagtggtaaattatttaatgctatcgacacatcctagttattgggttgggactggccttaggactagatagtgggagacaattgtattgatatttgaaaaaagtaaaaggtattttagttttttatttggtatgtgtagaagagatgataagagggagtaagtgtgagtcatgtttatgttttttttatgacacatattgtattaaactattaatgctgtcaagtgctataaacaattttcatagcaattgcatgatatttgacgaaacgagggtcgagggatatacccccctcgagtctcatggactggaagggttttctcccgtactaaagtttgttagtgttcactttcatgcacttctcattttaattttttttactgatatgggctgcaagcctccctttttctaaacacgtcactcttgttgaactcatcacgcatgactcgccgattttgcaccgagtcccattcaacaatcagcttgcgatatactgtagaagttctaattagcggctgaataaacacgggtccctatcgtttggcttatttcctaataagccaaaacggcttattgggaaataaaaatgaatttatagatgaaacttttataaatgtgttcatggtgacttaaaagccaa

SEQ ID NO: 12074 - DNA, 1501 bp, Oryza sativa
acacatggtctatcttcaaccccatgcaatgtttgtttgaagtaaactctagtttttttttcttaaagaaaataaatgtgaaggactggaacaaggcgggaagcattttaagcactcaatgtctatatcctagtttgttgtaaccaatatgaataattgcaaaatattttgacaatatggattactatttactccatttgtcttcagttgtcataagatacaattactcggaatactaagaactactctccccacccaaccaccacccctcaattcaattttcaccaaatctcgctctcaaccactctctcactccttagctattcacatggtcatctcccttcgtacttaatctctatctctattattataaaaattgaaaatgttttcgttaaaattttggtacgttatccgtgtttgaattggttctatgtcacccatatccaattcgacgtgactttagaataactactatacacccctttctaaccctaaattctaagtcatatttcttttatcatcaagaccaaaaagaattgactcatccctcatccctcatgtaacaaaactaagaaacaatatgcatacatgcaaccaatgaatattaagatggttgcttgggttcaggggcggatccaacgtgggtgcaggggggactcgagtcccctctacacccacaagacccatggatacccccggagcacccccttcaattttttcaccatgaataataaactaaaggctcctagatggctggaggttgaagaaactgtgtaattgagccccccctccaatttttttgttcttggatccgcccctgcttgggttccagtcaacaatttaatttagcatgttaaaaaaaagacaacactttcagttaagtcttagatatatggagactacaaataagctcatctcatttggaaaacccagaaaataaaatagaaccaagacttttggatggagggaataacaaaaaaatatagtattctaaaggcaaaagactataaagggagggggttttttttattgggatgttgggggcggccaggccacctccagctcttttcactcctggctaaccctagtactagtattgcattctacgaaagtgaaaagggtgtttattttcaccaccctaggattgacacttcacatttatttagagtgaacacacatgttgtttcacccaaaaaaagaattcttggatgttcaaaattatttgccgaatgtactcgatgcatgtgtgcaatctatgtgaggttttgtgcagagatcaagtttggggcatgcatgagttgtactacgggaagagaatgaagtgtgtggagttaagctaaactaaaaacggacaatgtatctgtaaatcagtgcaccgaaattcaaaaagctttccgttttttattgacttaagctgcagcaacttgcaagctacatgcctataaatactacaaggctacataccctaagagcatcaaacacacacacacataggcaacaa

SEQ ID NO: 12075 - DNA, 1501 bp, Oryza sativa
attgcagcaagaaggcaagaaccccagttgagagtggagatggccattttgttcaggcactaggcagtgggtaggacggtgaggagtgtgtcctgcactcctgcttcccctgacgatcgatccccatgcgtgccgaagcatctgatacttttgctgtgctgttctttaatttaccctgatacttttggatatctgaagcagtagagctcgttcactcaaacaggctagcctgttttgctttctggtaagaacttaattaactagttgagatcgacatgcatggatgcgtgaatctattgttgcattttttctaatggatagttagatttgttccagctttttttttgtcaattctgttacatttgcagtgtcttcaacttctgcatcattcttctctattcttccttcactttctttcttgaactagaaaagcaaaccagagttctttttccccctcttctacataaacgaaaacagcttgttgactggctccctagagctttttgtaagttgatcatcgaagtagctagttctcttcacttatcagtcatcactgttctatgttctatctgcattttccttgattttgtacttttcctgaacgaaaggacaatccttagccatcataatgctatgatcgacttattctgaagtcatccggcctcgatcctcttttgtttcggtgagatctgtaatggtttaggaaaattatggatctctgaaaaataagaaacatctagtagtatatgaaattaagaaatgtcggaccacgtcaaatcctactggtatcatataccagataactaactttttgaatggaaccaaacacgagattgtgaatatatagcagtaagaaatacaaccccgaagggtaaaggagaaaaaggaaaagcagtttagtgtacgagctgtaggagtagctttgctcctgccaaggcccagatccttgcctcttccttcatttctgcgaggagaccaggcactgaggtctcattgtgatcgaagattctcctgtttctctccttccagatctcctttgggaacaccctgtgtgtttgcaagcgcttagcttcattttcatgcatgatatgatctctggatagaagataagtagcccccacacatgcacttcgccacctatagccagcctcgagttctcatctgtttgatccgtcgcacatgtggagcaacgaagctctagagtacgtctcctaatctctacttacttttgcagtttgcacacatattgagaaatgcttatcaatccttcgatctctcacagacaatacctacaagcgtcgtttacactttgcatgtatagctagccattgttacatacgtggagcatgtagcgatcattcgttcctagcacgtaaattaatcgccgtaattttgcccatgcagacacagcacacacagctacaaatcgactgtaattaaggtacgtatatataggtgacaatggacaaccagcagctaccctacgccggtcagccggcgg

SEQ ID NO: 12076 - DNA, 1501 bp, Oryza sativa
acgaggaatggggtcgacctacagccagagcgccgccttcctccacaactcccgcagcgagagcacacgaagaggaaggaggcggggaggcaggcagcagctcgttcctcgtcgtcgtcgtcgttcggcggcgacgccggccgccggacctcctccccccccccggcggcgcgcggtggaggaagccgctgccggcgacttcgcctgtaacaccgccgccgccaccgccagctcccgtcgatctcatcctccacgccgtgctcaaacggcggaggatggggcacagtcgtgggcggcgcgcggcgggtgctgacgctcttgggttgccctggctattgctcccagacgaagggcaccatgccggggtggcggacggggccagagttgaggtcggccttctagtagtggcgcaccgaccggagtggtgtgcccaggtcctcagcctccgcctcgtcctcccgcgcctgccctcccacgtacgccggcacgccgccgtggcacgcccgtactgccgccgccacaggtttcagctcctagcgcagacgaagacaggcggtggtggggaagccgcggcttgcgccggccgcccgcgcgccgctccgttgcctgccgcccacgcgcggctcctccccccaccgcctacgcccgtgcagctgctccctcgtgcggcacccgtgaagaagagaggagagaggaagagagatggagaggggaggggaagaagaggctgacgcgtggggcccacgctgagtcagttgccgtatcggacaaaaccggagtcaaaaccaccgagggacgtagattgcactggttttataagttgggaaacgccggatatctggttttgtggttgggggatgattttgtaactcgatgacaaagttgagagaccttcggtgtactttttccaaacccaaacttacgcccaggattgtgatgtacttcagactttgtccattctactttagcccaaaaggttgtccctcccatttgacgggctatgtactttctacgtgtcccggcctgttttgagtttgtgatcgacctgacccgtttagtgacatgctatccacaactctgataccactcggccccacatgtcggtgacgctgctacctcccgcgaaacccagacgcttcacgttcggatccgaaagcttcgcagcccggggcaatcacgaactgccaccgcaccgtcactgacatcctggccccaccccgtcaggtgggggcccacagcccgcccccccaccggtgccccgccgcgccacgtccccgcataatagcacatggtcgacaaccccccgcctgtctccccgttcagcgagccagagaggaaacgaaccgatcgatcaggccgtcgctccgctcgccgccgcgcgacgcgacgcgacgcgacacgccggagacggacgacgagcgctttgccttccccgcgcgcgcgcgcgcgcgcacggaggcggacgctggtcggtttggtcgggtgcgaccgggaacggcgg

SEQ ID NO: 12077 - DNA, 1501 bp, Oryza sativa
ggtaatatcatattagtataagacatatgcattaaagtgtagtagaaaaatactccctccattccaaattgatctacatatttcataggtacactaagaccaagaaaagctaataactctctcatactacatttactctagcaacaaactcaatgcatgcaccatccccactatttcctatccaatagcaaatcaagatattgcatgtgggttatagatacttgtgtgcatggatgcatgcatcaatgtccatttactccaatgcacaaataacgaatagacttaataaatgaacacaaatatgtagatcatttaggaataatcttaaaatatatatatatagatcaatttggaatggagggagtaataagagtgtcattaccatgaggtattatttttatgtttccaaggatatcatataagcaacaaaatatttaattgatgactgaaaataacttatatagctcgataggttagattacttgtgatggaaatagcccatacccaagtccaaattctagatttaacacgagcgctcgtatttatgactaattattctttcgctagacgttcgtggtgacttcgtcaatctaaaaatgtacaattatgggcatctatgtatgtactatcttcattccaatttaagtgtagtcatgagttttcgtgttcaacgtttgactgtccgtcttatttaaaaacttatgaaataattttaaaaaagtcacaaataatatactattcatattttatcatctaataataataataataacaattatatttgttttaaataagacagaagatcaaatattatatataaacagtagaactacactctttttggacggaggtaggactgtgtttctcagaaaaacttgtacaatccttagttttaccacgttattacaaatgctgatgtgacagccttcccaatgacaatgaaacacccattaaaagtaacctaatatatgaaccaacatggttattattcccattctattttttttcttctaggtcgctcaaaattaaatgaaatcttctagacgtagagagcactaaattactagtaattaccgctagtaatcacgataatagtatggcctaggagtagtaaaatatttccttagctgagaagaagggagaagcgtcgacgaaaacgccttcttcttcttcctcctccttcgccgccgcccaccgcgccatcgcctatacatacccaccccccacccacctccttgtaagttgcaacctcccgcctcacccgccgccattgacgaccaccgcgctcgtcccatcccatgcctgcggccgtgaccgcgaggttgtgaggagaagagagtcccaagagaggaggatcgatgcggcagcggcaggccggcgagcaggaggcggagctgttcgtccagtggaggccctgcgacaagaagcggtcctagtcgcccgccgccgctcgcccactcgccggggtcgtcgatctgagagggacaggggaagaggaaga

SEQ ID NO: 12078 - DNA, 822 bp, Oryza sativa
gggactaaagatcccgggggccctgacaacgtctgacatctctacaactgggactaaagatgatctataccaactgggactaaagatcacatatgaccgttgtagccaccaatcaggactaaagatccggttttaaatggatccgggattattgtggatttcggccgaccgaccaaagatggtttctccaccagtgcttgctccgtctccacccaccctttcctctttcgctctccgcctactccgcttagggcagtagcaatgcaaagccatccttctgtgtcttctgttattccctactatcgccgtgtttagatgctgtaaaaatttggctaattttcttttatgtacacagacacatattttaagtattaaacgtagactaataacaaaacaaattactgatttcgactgtaaactgtgagatgaatcttttgagcgtaattgatccgtcattagcacatgtatgttactgtagcacttatggttaatcacgatgtaattagacttaaaagattcgtctcacgatttatagttggactgtgcaattaatttttctttttgttcacatttgatgctccatacatgtgtccaaacatttgatgtgatgaaaaagttggaatctaaacacagcttatacacagtgggcgttatctgttttggcacaatgcaagttaccaaggttagcattgatatcccaggccaaggaatatgttccccaactacccctttgttctcctcgacgcatcgcctccccacccacttcatctcccaatcccccgctttttcccccagttcgtgatgatgctgctccgacggaga

SEQ ID NO: 12079 - DNA, 1501 bp, Oryza sativa
ttagtgtttgcaaagatatttctgccacaagtggcactctatgaatcattatggccatagttcatccccactctaagtagccggtgagagatttttttttagacatatagttagtaattatttgattaagatcatttgtctctgagctttaagtctccctctctggttggctatgtcaatgtgtgggctacacgatgatatttgacaataccacttgaaaacgacatgatcacatactattgctgggagaagaaaggcttacttaattaactagtggacgcacagcataaattcttgtatacgcacacttcaaaaaagaatcaaattaagttaagatgagaaaatgaaatactcaattttcacatgaattaattcagatcctgcaaaattccttaaaaaaactttggtttcgaaggaggcctatactattggatggagtaagttttttttttatataatgctcgatgaagaacgaatattgcgcactatagattaatggttgtgaattgtgattaagcatgtcaataatccaatactttttattttctagatgacatggtccaatacatattgagaaataataatttctagatgacgtggtccaatacacatcgagaaataataattatgtaagtgggtctgaattacatagtaacatggaattagtttgctttatttatccagcaaaacatgagcttgggatcatgggatgtgaaaggttgtaaactgcaaagccctctagtccctactttaataaattaatcaaaataattagtggcttactttattctcccaattctcctctgcctccaagttgcatgaaactgaaaggcagataattatagtgctttgctttaatcccaaggaaaggagaaaatctcctgccaaattaagctggtattctttttattcagaaaaaaggagtataaagttggtatatatatatatattgttcgctttagaagaatcctaaaatttgtcggttggtatacctttgaagtttgaactagctttgagcttttgccagaaataataggtaaaaacgttgtattgctgcaaattaggaggtaaaaataatctataattaaccttggcaaatttgacaatatctatgtcggtgacatggggccgggggtatcgtgactagaggcttgggtagccgcggtcacccacgtggcctgagggcccgagggtgacgtggccacccctccctctgtccccccgaggggtcgggccgctcccgtttcggccccgagggctggggcgccccgaccccctgtggttttggcgccacgtgtgtgggttagatgagcacagcggggctcacctaaccgcatttataacaggttggacgagcgcgccacaccgcatttaatgcggcgcagcgcacacttatcctgtctgtgaccggtcgcggtgtatgaccggtcacagaccggtcagatcgcgggttaggtggcaacaggcggcctgtcacacgcctcgccccgtcccgtcggaa

SEQ ID NO: 12080 - DNA, 1501 bp, Oryza sativa
agaactccccgacccgaaaatactcgaagaaatcgcacgaaaccattttttttttccgttggagcaaaatcacaaccaactcaactcctgaaataaactgaactgaactgaactaagagagcgcaggggagagggatgttgttgctattattattataccggaggagaggaagacgaggtagacggcggcgtcgaccccgccggcggcgacgacgtcaccctccgaggcggagatcgcctggcgcagccacccgacggggctcctcgtcccccgcccccgcccctcccacgggtcgagcccccgcagcaggacgctcgggtagtacaccggcgcattgcccggcctgctcgacagccacgtgaacaccagcaccagcacgacgaagatcacgaacgacgtcagcagcgacgtcacgaacgacgcggtgtccatcccgccgccgcctccctcctccggcttcgattagtggtggcgtcgggagcgattagcgggggtgattagggaggaaggggggaagcattggatgcttgctttgcttgggtttggtttgcgaggggaggggaggagtggagttgatgagttgtggaggttgccaaatgaaggaaagggagaggaggaagaagacactactagacaagcaaaggaaggggaggagacaaaggaggaaagcgtgaattactgtattgcccctatatctgattgttaattttgtttcgctgccctcgcaaaaaaaaaaaaaatttgtttcgctgcttttgctgctggaaagaagcagtagggccttcttttttgacttcacgggtggagtgaccgttttaccctttgaagccgtgtccttggcgatggagagtgatcgaggttgacaggtggtgaagatacggggagtgtttgggatgtattaaaaaatggtgttcaatttatggaaagattaaagtatttatcaagtgtattaagtgtgacaagtaagaaaaacacgcaataagttatttagataaatagtacaaactacatgtttaagtatgaactccctccatctcaaaataaaagaaactggatgaggcattttctagtagtacgaatatggatagcttattttttaatcctagattcttatattttgggatggaaaagtatagggttaagaaaatttaagtatgtatccgtttaaattaatacacatttataattataaatgatgaccgaagtgtaaactttttttttgaagcggggagaagatgaatttcactaaatatgtactactatatattacatttatgtagaaccattcgacatcgtgatattaaactttattaaaaaaaattaaaagggggagggggacgaacttcagtaaacatgtactagtagtatattacattcgtatagaacaattcaacattgtcattctcttaaattctcattggtacttattatctatttaaaaaacagaacgagctgtgatgttgacatgaactggaaagaagcgcatatggaaagaaaaaa

SEQ ID NO: 12081 - DNA, 1501 bp, Oryza sativa
tatatcaacttagctatttttagccaaaatggcaccttagccaaatttaatcagtaaagtgcagcataaatcaattaacatgctgaatttcatacttggcaatcctccatgcatcatagttttctatagccaacctttcattcagcacgacttgcccctataaattggccccgttttgttagcgaaaagaaaatttttgggtgtcacatcggatgtttgaccagatgttggaaggggttttcggacacgaatgaaaaaacaaatttcataactcgcctggaaaccacgagacaatcttttgagcctaattaagccgacattagcacatgtggtttactatagcacttatggctaatcatggactaattaggctcaaaagatccatctcgtgatttccatgcaaactgtgcaattagtttttgtttttatctatatttgatactctatgcatgtgtccaaagattcgatgtgacgtttttgggaaaaaaaaattggaaactaaacaaggccttacagagccacgcaattttctccaaataaattgtttagtctaagaaagcatgaattagtagtaattgttatctttatgttggtacatgaaacggtgaaacataaaaatattttttatcagtttttttatatataatacacggtactactacttctgcaaacaaaaggataacaaaaaaacaaaagtgagaagaaatctctggaccaaatttcctgggattcagtactacaggggcacctagaaattaaaatttagaactccccgacccgaaaatactcgaagaaatcgcacgaaaccattttttttttccgttggagcaaaatcacaaccaactcaactcctgaaataaactgaactgaactgaactaagagagcgcaggggagagggatgttgttgctattattattataccggaggagaggaagacgaggtagacggcggcgtcgaccccgccggcggcgacgacgtcaccctccgaggcggagatcgcctggcgcagccacccgacggggctcctcgtcccccgcccccgcccctcccacgggtcgagcccccgcagcaggacgctcgggtagtacaccggcgcattgcccggcctgctcgacagccacgtgaacaccagcaccagcacgacgaagatcacgaacgacgtcagcagcgacgtcacgaacgacgcggtgtccatcccgccgccgcctccctcctccggcttcgattagtggtggcgtcgggagcgattagcgggggtgattagggaggaaggggggaagcattggatgcttgctttgcttgggtttggtttgcgaggggaggggaggagtggagttgatgagttgtggaggttgccaaatgaaggaaagggagaggaggaagaagacactactagacaagcaaaggaaggggaggagacaaaggaggaaagcgtgaattactgtattgcccctatatctgattgttaattttgtttcgctgccctcgcaaaaaaaaaa

SEQ ID NO: 12082 - DNA, 1501 bp, Oryza sativa
atcactaccttctccttgccaccgctgagcccgccacggttcccctttccactgccgagcctggccgttgttggtccttcctccaccatgaagtctcctccctatgctgccaccaccgagcccagccatggcttttcttgccgccgtcgccgccatcaagccatcgaagcaagagagggagaggagaggaaatggatgagggaggggatatctaggaagtggttgaggaagtggctgatggaaaagaaaaagagatagttgagggatgggataaggacgacttgatccacacgcccttctcctatgatctttttgttggtggtaacccttagactccgctagtaaaaatggattttcatatgtggggttatttttttcaagtagtgctcttaagactctgcttgtggaaatccatttttattggtgggaccaagttttcaggtctgtttttattttacaagcgaggttttttatggccgctagtgaaaataaatcttaagggtcatgaaagatccttattttttttaagtagtagtggctgcacacgtgcatccgtagctaacccagcccacattgtttttctttctttccatctcgtctcatcagttctgtcgtcttctcgctccacatacagatctagcaaactcgaaagtgaagttaggtgagagactacggccctgtttagattatgggatattttttagtctcaaatagcccaacaaatctaaatgggtgagctatttgagggctatttggaaataacccataaaaaaactatcctatccaagaggtgctcattgaagatatttcgggtagaacccactaaaaaaggtggctttcctctctctccgcatggccttctttctgccttatccacgcgcacgcgcctcatatttcaccgccgccgccgccgcctccactcctcgtcggcgcggcggccgttgcccgcctcgccgccggcccccaccagcgccgccacctccactcctcgcaggaggtgcggccgttcacccgccgcaccgccggcccccaccagcactgccgcccccactcctcgcatgattgggaaagtgcattaaaggccaaatagctcttggatctaaacaactcaagggctattttattggggggctatttcttgtgctaaaaattagatcttcaaataactcttggctacttctccaaacagaacctatggggatgtgtttggttgctgcttgccctagagaggagttgcctagcctaaagcctacctgagaattcttagttgcttgtttgtttattactaccctgaggaccacccacgctcaggccagggccaccaaagttgctcgccagactaaggaacatgcgtgtctggctttactccattcaatctctctttgataatagttgtcacaatctaaagtggacatgttttatcttaggtataggactccaaccaaacaacaagacgaggggtgtgcctgattagttaagcgtcatcatatatttccttcca

SEQ ID NO: 12083 - DNA, 1501 bp, Oryza sativa
gttctcaaaataaaaaatttcacgctgtcagattgaatgtttagacacatatatggagtattaaatatagaaaaaaacaaattacatagattaagtgtaaattgcgatacgaatcttttaagcctaattgcaccatgatttgacaatgtggtgctacagtaaacatttgagaatgacgaattaattagcttaatctgtttcttttagaaatctaatttattttgttagtagaatacatttaatattttaaatgtgtatatgtatatccaatgtgacaacgtaccaagaacaaggcctgaattttgtgcgtgactgcgtgtgcgcagcgcgtcccaagcgttttcccttccgcctcgccgtcgtcgacgtcgccgtcacgtagcgtaggcaggcacatgcgcggcgcgtgtgagcgggcggttggacgacatgtgggcggggtgtcggcagcccaggcttcccccgccacgtggctttctctctcgcaaagcgaaaggcccaggagaagtactagtagaaccacacgaatgggccccacaacaagccaggtcctttcatatccactgggctttctttaattccttttacaattttattattattctcgtgaccaaattgcccccctgctgtgccatttagcgccccgctgcaactgcacgtgggccggtgcacccacagatacagcaccgttgccgttgcccgttgcccgttggatcctaggtttttccttcaaatctctttctgttatgactactcttttttcctttttctttttcatgccaagtatggctctttgttagcgcggcatatgccgacatggacaaatggacatgcccaagctttaaaaaaaaaaatgcatgcccaagcctatccatatatgccagtatgtacacacacccatgcttgcttgttttttatgttttctttttttctttccatatgcgcttctttccagttcatgtcaacatcacagctcgttctgttttttaaatagataataagtaccaatgagaatttaagagaatgacaatgttgaattgttctatacgaatgtaatatactactagtacatgtttactgaagttcgtccccctcccccttttaattttttttaataaagtttaatatcacgatgtcgaatggttctacataaatgtaatatatagtagtacatatttagtgaaattcatcttctccccgcttcaaaaaaaaagtttacacttcggtcatcatttataattataaatgtgtattaatttaaacggatacatacttaaattttcttaaccctatacttttccatcccaaaatataagaatctaggattaaaaaataagctatccatattcgtactactagaaaatgcctcatccagtttcttttattttgagatggagggagttcatacttaaacatgtagtttgtactatttatctaaataacttattgcgtgtttttcttacttgtcacacttaatacacttgataaatactttaatctt

SEQ ID NO: 12084 - DNA, 1501 bp, Oryza sativa
aactttggtggccctggcctgagcgtgggtggtcctcagggtagtaataaacaaacaagcaactaagaattctcaggtaggctttaggctaggcaactcctctctagggcaagcagcaaccaaacacatccccataggttctgtttggagaagtagccaagagttatttgaagatctaatttttagcacaagaaatagccccccaataaaatagcccttgagttgtttagatccaagagctatttggcctttaatgcactttcccaatcatgcgaggagtgggggcggcagtgctggtgggggccggcggtgcggcgggtgaacggccgcacctcctgcgaggagtggaggtggcggcgctggtgggggccggcggcgaggcgggcaacggccgccgcgccgacgaggagtggaggcggcggcggcggcggtgaaatatgaggcgcgtgcgcgtggataaggcagaaagaaggccatgcggagagagaggaaagccaccttttttagtgggttctacccgaaatatcttcaatgagcacctcttggataggatagtttttttatgggttatttccaaatagccctcaaatagctcacccatttagatttgttgggctatttgagactaaaaaatatcccataatctaaacagggccgtagtctctcacctaacttcactttcgagtttgctagatctgtatgtggagcgagaagacgacagaactgatgagacgagatggaaagaaagaaaaacaatgtgggctgggttagctacggatgcacgtgtgcagccactactacttaaaaaaaataaggatctttcatgacccttaagatttattttcactagcggccataaaaaacctcgcttgtaaaataaaaacagacctgaaaacttggtcccaccaataaaaatggatttccacaagcagagtcttaagagcactacttgaaaaaaataaccccacatatgaaaatccatttttactagcggagtctaagggttaccaccaacaaaaagatcataggagaagggcgtgtggatcaagtcgtccttatcccatccctcaactatctctttttcttttccatcagccacttcctcaaccacttcctagatatcccctccctcatccatttcctctcctctccctctcttgcttcgatggcttgatggcggcgacggcggcaagaaaagccatggctgggctcggtggtggcagcatagggaggagacttcatggtggaggaaggaccaacaacggccaggctcggcagtggaaaggggaaccgtggcgggctcagcggtggcaaggagaaggtagtgatggtggaggagcaggacacctgatccggtgatgacaagttcgtctatggcggtgaaggggagtgctgcctccaccatcaatccctactcgaggagagctcaaccacaacgacgaaggggagggcggtagtagtagaggaaggggagtcctagcttgtggatccagtggtggta

SEQ ID NO: 12085 - DNA, 1501 bp, Oryza sativa
aaatgtacgtgataatttcctgacaaaagaaactagtaataaataaactcgtagttatatgaagattaaatatgtttcataccatcctatgatttgcaatatgtttcataaaatcaaagtttcggaatgtttcataaaacaccggatacaagctagccaccttttttttattattacatatctaattaaaaattaaaatttaaaattggtcggtaacctcaaccaatagtactagccacttttggatacaacatcattccatattataaatcgatttgacttttttattaatcaaccttctctagctttgtataagtttataaacaaatatagcaatattatcaacataaaacaaataaactattaaaatatattcaatgttacatacttacatttaacaaaactaatttaatattataaatattgctatatttttctataaattttgttaaagtttcaagcaatttgactttaaaaagtgtaagctatttatagaattaaatttaaaaatatattgtttattcaatttattttcaagaatattcaggatataaattttattgcagaaatataccatcgatcttgcacaaccgttgagcgaaaataacgcaagggtgagcgatatcgtgcggagaaagcgcgagacggcgcagtcttgcgcagcgacggtgcgagagcgcaggatggacgagcggtctcgctcaagcagagagcgacaccgtcctaaactgcatttggttagtgactaatgacctaattaattatttaactaataataattagtgattaaataataattaattaatcactaattatggtaattaatcactaattaactattttgaaatccggtatcgctgattggttaagcgagaccgctcttccatttcatgagaccgcgcggtctcgcgctttccctgcgcgagaccgcccgcgacgtcacgcccatgtcactttcgtgcaatggttgtgcgagatcgacggtatatttttgtaaaagttttgaatcccggatatttctataaataaaataaatgaacattatattttcaaatttaattcgctgcttataatacgaagcgaagggagtactattctcccaagttcttaaactgtaatattagcatcacacaaggacgcaagtgaaaattacccatcgatctactaccaccaccaggtcgcacgatcggcaactgacgactgcgactgcctcctcttcttcttcttcgccagcaccatcgcttccaacctccgcatatattaacctccctgtctcctccacttctcccattcacattcactcgctgccaaccccaaccaccacccatggcgcctctcctcctcctcttcctcctcggcggcctctgcgccctcttctccctcgcctcctcctcgccagcgaccaagaagtgcggcgatgccaagaagcggagagaggaggagggggaggaggtggtggtggtggccaagaagaggccggaggaggagccgcggcggcctg

SEQ ID NO: 12086 - DNA, 1501 bp, Oryza sativa
gctccctcaattgtccctggcacggcgactccctcaacgaatggtgctgccctcccatcatgcggcgctcaagagtggacttcacccacaatgagcagtagtggcagtggccttctctccttcggtgtcctcccctctgtgttcttggattttatttttgatatgtggatgttgattttgttcttgaatgttgattctgtgttttttgttgttgaccgatctcaagggtgatggggggcttctcgactttttggatatgtggaacatcaaaggtgttggtttagaaagggtacctttagttccttctcatcactcggaatgcattgatatcgcgtctatcttccatgttcaccgtcgactatgcccactgggagttgttatttcgtttgaaccgttgagggaaaagaggatcaaacctttgtttttgcagctgtcgctaggacgtctccgaagatgcacggtggaaagactctgggaagtgtgttggaattaatgaatgggccttagcccactcgaagattaattctttggaaaatcacaaaagcccacctcatgagatggcatgcatgtggagtttagtaccaccttgcttattctaggagagggggacctccttaaaagggaggatgctctcctagccacttgaagcatgtgtggtggagagaagaggggaaacacacgcgcgcgctcgctcgcctggcctggcagggcagggcaggcggcgcgcgtgcacgacgtacgcgtcgaatggtccgaaaaattggctcctcacccttgcgcagatgcagcacccttgcgcagatgcagcctccttttgcagttttgttttgctgcaaattcggattcgtttttgttttggaaacgttccgaaaaatccggtacgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 12087 - DNA, 1501 bp, Oryza sativa
tgctgtgggtatctcagaattaattacaagaaagctcaaataaaacaatttagaaataatgttaaaaggatggcccacagtttaggcaatttaggtagaatttcagttatacatgacgcatgtatggttataatcaagcgtgagagaaatgtaatgggcattatttttctaagttgatgtggctcattaatgttaagctttatgataataattacactaagtaggttgtaaatgaatatgatatatggatgatggttatgatgaaagcgctataaggattcaaaggatattattttctagtggcttaatgtatgtttagtgtttggttccaactatataggatgtatagataagttgtgtatctattaataatctctgcaattaaatatacattgctgggatggaattggatcagaactgttgtctttctcatgtgattttactacatttgtgtatcttctaataagtcatgtttggattgcttggatagtctgcttatggtggattcaaaattacgcactccgtttttttaatagataacaatattggttttttacatgatcttttgaccattcgtcatattaaaaaattgtatataaatatcatttatttgttgacattttttagataatatttaattttgttgacatattttaccagaaagaaactttgagtatgatttatattttagtatatttacactagttttttcataagacgaatagtcaaacgttatttcaaaagtcaacaacatcaacaacatcatctattaaagagagaaggtaggtggtatttggaattctccaaaaatatgaatattcacattcaccgaaatgatcaaatccctgccccaaaaacatccattaaatccctaaaatggattcaaatgtcaatttttgacttcagatttccttaaaatctttctcttttgcccaatttgatttccaagaaaacttatccaaattttcaattcttctctcttacccccattgggcatgcaagggcaaataatatactggcagcagtctgcaggaattcgagcagagcacgatgaagctaaccgccttcaaaaccgccgagagacctcgtttgcccggttttcgtaagttgagggacgggtcgtacccggttttgcggtcaatggacgaaaatcggactgggcgacaaatagagggacccaaagtgaacttattccttccacagttcaagggttcaaaactgggtcagggctgagtgaaatgcataaggagcaagcagtattgatatgggcctagagttcatctagttggggccgcggtgggctttgtgctgggcctaaggccaacaccaggttttatttttaccctagtcgatcgatcttcttccgccgcctgcgtacgcccatctcctccaccccacgcgcgagcagcggcgccggcgtcctcctgctgaggccggcttccaccgccggtgaggtgatcacccgcaaccgcacctagcaggcaaagaggaaggcatccaa

SEQ ID NO: 12088 - DNA, 1501 bp, Oryza sativa
gttgggccgtctgcccaacctctctcccgcgccaccctccttgtcgggccggcccgttccttctcccctcccccgaagtcctacctccctccctcctctctctgggtcatcgacaggtagggcccacctgtcagccccttcttccacctccaaccgacggcagtgccaccacccacgccgccggtttccccgcttcccgcgcccactccgcccgtgccgcacgcccacatcgccgcccacgtcccgccgtttcccgccctcgcgcgcgcccgagaatggtcggattcattttgaatccctcctctctctctctctccacccccacgtcgccggccaaatcggccacccccccggccgtttcctcccctccctcgcccataaaacgctcccccgaacctcctctcgcgcttccctcctttgtcgcgccctcctgtgcttcctatcgccgccgcgctgtcgcaccgagctccgccgcctgccgccgccctccggtcgcgcgccaccgctgctagagccgccgccgcgcgaagccgtcgccaccgctagcttcaccgtcgcgggggctattccggccgcccctcgcttgccgcgcgccaccgccgcaccgctcttcccacgcgccgccgcctaccgccgcctccaaccgccgctagccgtcgctagtgccgtcgccgcgccgctccgttgccgccgttggcctcgcgagatcgaggcccatctcgtccatcccgcgcgccccaccatccgccgcttgccgccgccggccgccgtcgtcttcacccacgccggccgaatccccggtgagaactccctccccttctcttcctctcgcgcgcgccgccgctcctcgtgtgcgcgtcgccatgatgcgtcgtcgctcgcatcgccggccgccgtcgtcttctcgccggccgccgccgtcggtggccgcttgcgccgccgcatcacctaaccggccggccggtttgaagccgagccgggccgaccgggcgcctcgccgcttcccacccccttgtgacgctgcccggtggggcccacccgccgttgccacctcctcccccctgagccgccgcccggggggccccgcctgccagccacccccttctccctctcttagtgccgctgaccagtggggcccgcatgtcggcgccgccccaccccttgctgacgtcagccctgggaggaattattgcgcaataaattgattaagagtttttcttttatagtaaaaacacagagaatcttctaaaaatcataactaattcatccgagctccgtttaagtccattcaagtcttagtaaattcataaaaatgtatagaatccattaaaaatggttttgttctctgtttcagtagtcttatagcatgttttgcttgtgtgctttgtttgtcgcgtagatttcggccgtttcgtcgattcgcggtttctcgaagacgttgctgtggttccatcagtgcgagagcaaggcaagtcatacattacaattgatcatattgtac

SEQ ID NO: 12089 - DNA, 1501 bp, Oryza sativa
gcgacggctcgccttcctcttcgctcgcgtgtttcgtgccttcgtaaacacctgcgaaaagtttcgaccaagcagccggtcttttcgtcacctcggtacgtgttcaatatgttgcgcatatttgatatgttcatgttattctgcgtagtttacatgtgtagatctaatgatgcgttcatgctagttttcatctgtaatgtcatgatttatttatagaataaattaaatcattatatgcccataatctcaacaaagtgattgatgaagctacattctactagcttttcggagttcggaccaatgttttcttctcactgcctgcaagattattgcctttctaattgtgccggcaggatgtctggtggagcaaggaaaaatatataaggagaaagagcccttctagttttcagttcatttctaaataactaaccaaactttatttcgggattggtgggatgggagtatggagttggctccccttttggccgccatgaagagcattagggctatcgcctattgggaatttggaattaacatattcttatgagttactttctccgtttcacaatatatgtcattctagcattttccacattcatgttgacgtcaatgaatctagatagatatatatatgtctagattcattagcatcaatatgaatgtgggaaatgatataatgacttacattgtgaaactgttggtactaacaaattagtctacagctataagagcaagtacaatagtatagccaactactagctccaattcatctatagccaatctaatagctcattcatacaatagttacatactacactattaatacctggtcccacctgtcattcacacactgtgtcttggagtccgtgctacagctggctacaaatctgtagcccgctgcccttctctctcctcgtttatcttcttaaaatatatttacaactggcttatagcctgctattgacctgctgtaaggcagcacacatcattcatgtcttatttggttaatccctcccacaaatggattgagggagatttggagggaattgatttcatatctattatgatgtgtaattattccccttcaattccccccatcttcttcaattccctacaaaacgaatatgtaaatgagatatgtgcttaccgatgtgtaagtggggtccgaaattaccggaattttggaaatcgcaatccctgccacaagagcatcagcttgtgacgtacacggctcagtcacgtacgtggaccgtgctcaaagcgctagctggccaagcacaaacacagctacgtcggttggcaggtatgccatccatacgaggaagcggttaactacgacttgatctactcctttcatctaattcaagacgcgcacacatttttaaaattttactcctaaatatttgaccaataatattttatcaccttatatatgtgggtttgccctcattatctgtgttagttaatttgcaaagttagaaagatggacaaactggtaaga

SEQ ID NO: 12090 - DNA, 1501 bp, Oryza sativa
cggtggatttgggtggtatccgggaaaggctagtaccgtccccggtcaattaaggaccgagccatgaagttaagcatgaaacgaccccgtacgaccacacttcttgaatggggatagacctagcggaataaatagccgagcggaggcaatatccatgcatagtggtttctcatgtgtaaggcaggggctctacaatggtgtcgccattgttaggactgtcgtgtgttgagtggaacctaattataacttaattcatgggtgtaaatcttcccttcccgggtgcgccagaactcctctcactgctagaaactgtgtacgcctagagtgcatgaggatgcaaaagttcatggagcgggtactgccaatgcgaggttatcgaaaagctttgccgtgacgtgtctcatgtgttaagacaaggctcatgtgttgggcagtcacggagtgtgggtaaagtgtacatccactgcagtgtgagtaaaccaaatctattcgaatagccgtgctcgcggttattgagcaccgggacatgtattactcttggttagtctttaaattcttaatttgtgtgggatgggttattgcatgatgaatttttatgttgttggagccacttcctgagatgggggaaggtgggcatcctcagaaaaccataacgactcaacggcggaaagctatccttgggatcacaatggatggtggacagaaccgtcgttgttttaatacaaacactggtactaaagtttgatcagtcaatgctaggtcttaggcttgtgaaaagaattacaaaatttgctttgcgcaaaaaaaaccatagccatcctttgaaataccctatcatatgcattgttgatgtggtggcttgctgagtacggttggtactcacccttgcaaatataaaattaatcagaagcgggagatgaagctccggaggatccctatgcctactaccaggagggagatgaagacgatggtgctcagtaggtcttagtacggtcgttgcctgtggcaatggcatgccgctgccttaattccgctgccttatctatttctgcttttggatgtattccggaccactcggtccgataatttaagacaatgcctgcgggcttatgatgtaataattagcactagactctcatgtatgtgcatctggtatttcagctatgaactcgtgtgtaccagactacttgatccagggaaatggtactgtttacacgaatgattcctgttataaaaacgggggtccacagagctggtatcagagccatacgactgtaggaaagaccaaaaaggcgccccacccctttcctaagatggccaagggagaaattcctatttagcaacactttcaaaaataaaaatgctatgtttacaaaactttatacgattttacaccttactcttaactattttcttcacaaaaccagtttttactctcaactgactttgggtttttcttaaacttagatggcagatcaggattcacccgctacctgggagt

SEQ ID NO: 12091 - DNA, 1501 bp, Oryza sativa
attttatcctatgccttaaaagatggaaatgaaaccccactgtgaccaaatagtttcataacaccattcaataattaaattatatgaatataaaatcacgaaaatgaaattatgcatttgagacatttgtttcatatttttagattatgtagcactataggaaaccacaagatgaaactcccactgaaaatggacatagtcagatttaatttacattgctgccaaataaggccatgtctgtttccgcttaaaattattgtaatctatattattgagctagattactataagctagattataataaaccgatatagaataagttgttaactgtttgtttctctgaattattagttgtttgttagttgttagccacccaataatctaaaaaagcacctttagagtggattatcagattatagaaatcgtgcttatagattataataatctatcataataagctatttgtttgtttcaatttacttctaacaatccagattataataatcataaactgaatcaaacaggacctaaatctcttcaaatgacacgacatctttacaaatgagagacgtctaaaattgttcaattgcatggaaggcacatacacatatcccactatagatataaatcacgcccctctaaaaaatggaagccatatatactatttcttttattcttacactaaactatggtcgtaattttaaaatatgaataaaatcttatcataaatgacaaaatatctatgacagggagtattaggcaccagcattcaaatatttcccttctatatgacgaaacaaatttaaccgcatgtagaaagtaaaaaacattcgcaatatggcctcttgcattcaatttagattcaccactcctcaggttctcattcaatttcaaggagatcatggggtactctgacaggcatcccacgccgaattaaaaacccaccacatttatcttgtttcaccatatttcccagccacacccaccaccccctacacaaacaacgcaaacacctcactgacagctgggaccaccaccacgtgggggcccacactccagtgacgcatgaagccaaaccactcggtgccccgaaaccgccaggcaccgcagccagcccgggtcgctgtcgtcactccctgcccccggatcccaccaccggtttcgtgccccggttgctcacatcacaccacgcttgcttcgcttccccttgttccaactcgcgtactacccctcccacccccgtaattacgctcacattgcaggggtggaagagtaatttcaggggccgcaattaattaagtcaacacgaaccgcagcctcccagcccacgctaccttggctacaggacgaccccactttccccaaactgcccctcccctccccaccccgcaccatcgcctccaaaaccaccaccacctcaccctccttcctcttcactctcacgagacagcttcccacgcagcgcagcgcaaccgcagcaatggccgattcgccaaaccc

SEQ ID NO: 12092 - DNA, 1501 bp, Oryza sativa
accaatagaatcctaatgacgattaaaaggagggatgtcaagatatgccggcccagtctttcggaggtgctcataggggtagggtgtgcgtgtgtgcattcataggggtgagtgtgcgcacgttgtgagcgcctatatttgtactgtgtttctaaaaaaaaaggagggatgtcaggcaggccgtaaagcaaacaagtaaggcggttgctgggatttctagaaagtaaaaaaaaataaaccccattgataatcatattcgatttttaaaatctcaatggcaataaaaaggagaagcagcgggcggggtgtataagagtatagttgcagagccgccgacggttaatgagacttctagaaaataaaaaatgaattccaacgatagttatgttcgatttttagaatcacaatgacaataaagagtaggcggcggacgggctatagaggggcataatggcatcgtttgatgggacttctaaaaattataaaaaataaaactacaagtctaatttttaaaggttcggaacttccaaaaagtaaaaaaaacccaatgataattatattcgatttaaaatctcaatgacaataaagaagggaggcagcggacgagccgtagaggagtacaatggcaaagccgctgacagtttggcgggacttctagaaagtaaaaaatgaacccaaacgataattatgttcgatttttaaaatctcaatgacaataaagagaagaaacaatggatgggccgtagaggagtataatggcaacgtttgacggaacatctagaaattataaatacgaaactcaacgtgacaataaactctaaaaactataaaatctaatttttaaaggttccaagaagaataaatagaaataatagtagattgagcaagcaaataaagaaggagatgacataaggggtagcaactggtgtgacttttaaaaactttataattagaaacacgagggtgataaggtttggtctttcaaagtcttaagacagtgagatagctatttaataaattttaagtaaaatcatactaaaaaaatatatgattttgtttgggtgctagccacgcaattgcgccgaccacccagctagttacagtttatggtatatacataattttctcatctacggagtatctccgactgagtaatctcatatccatctgcaaacttattttgaaagttccaaatggagctaaacatttgtatttaccgttcaaatcctcaaaaaaatccccactttttcgttgtcccacgcaatttaaacgtgcaggccgtcgtcctgtccgcggggagcttgttcaagcggacatccctccacgtcctcacctctctccctattccaggaaaacaaaaccaacccccttctgtagcgtactaaactcctggaggagtatacagtatactcctactcctattcactgcctggtgggcccccacactgctactggccccactcccgccgcaggctcgccgcaaacccaacaccccaccaca

SEQ ID NO: 12093 - DNA, 1501 bp, Oryza sativa
ggggcctcgcggtaccccgatagaggagctcacacttcgacatctaggatttaaaatttgtctcaaaacacaactacttgtgttatttaaatttttcaaaaaatacagctacttctctacctatctcctcatctcaaccaagcataatctttctcatatattttctcatctgaacccatcacagtcattttccacacacccagccttaatctcttattaaaaagggcacaagtacattttgaaatagagggagtataaattagtatcctaaaaatagaaagttttagcaattcaaatctagtctctactactccctccgtcccataaaaaacgaatctagcatcagatatgatatattctagtactacgaatctagattcgtaatgctaagatgtgtcatatccggtactagccatagccatctttctggttcccaccttatcccacatataaaaatattctgaaaaaccattaaaaaaaagagagaaaccgctcaaaaatccgcgatctaaaatagcatatgaaaaaaggttaaatgagagaaaaataccggataggagaaaatgttgaaccgctttaataaaaaaaaatcaagagagaaaattgaaccaccttcacctctgatccaaataggagagaaaatatggaagaagagaataaggccgtgtttagttacaaagttttttttcaaactttcaacttttccatcacatcaaaactttccttcacacataaactttcaacttttccgtcacatcgttccaatatcaaccaaacttctaacacaccgtgtgaactaaacacagcctaagttaaaccatttacggataccgtctctttgccagtggcatgccactaacggaaaaaaaaaagaaaaaaatttacaaaagctacctcatttagagatactaaattttgaaatgaaagaaatattgaaaggatatatcatctagaatattacatgggattaattaaaattcgaaatatataataaaataaattcagaaataaaaataagataaaattgagtgtttaagtaggaatataatttagaaaaaactaaaattcagaatggaaataaggaatattaaaaaatagtccgcgtagaacgcaacacgatattaattaaagttataaataaaaataaattctaaaaatagataaaaatgagttatcaagtagaaatacaatatagaaataataaaaaaggaatataaaaaacaatacatctagaacacaacagtggcaaatgccaaaaaagaatggggtagcggataagctatacatggttagtgtcgtggcggttgatgaaaaatctaaaaactataaataaaatccttcaatgatgagcaggtttgatttttagaatccaatgacgattaagagaaaggcaacggacaggccgtgaagcactaaggttatggcgattgacgggacttataaaaagtaaaaataactaggttcagttttaaattccaataacaataaagagtaagagcgg

SEQ ID NO: 12094 - DNA, 1501 bp, Oryza sativa
tatttccattctgaattttagttttttctaaattatattcctacttaaacactcaattttatcttatttttatttctgaatttattttattatatatttcgaattttaattaatcccatgtaatattctagatgatatatcctttcaatatttctttcatttcaaaatttagtatctctaaatgaggtagcttttgtaaatttttttcttttttttttccgttagtggcatgccactggcaaagagacggtatccgtaaatggtttaacttaggctgtgtttagttcacacggtgtgttagaagtttggttgatattggaacgatgtgacggaaaagttgaaagtttatgtgtgaaggaaagttttgatgtgatggaaaagttgaaagtttgaaaaaaaactttgtaactaaacacggccttattctcttcttccatattttctctcctatttggatcagaggtgaaggtggttcaattttctctcttgatttttttttattaaagcggttcaacattttctcctatccggtatttttctctcatttaaccttttttcatatgctattttagatcgcggatttttgagcggtttctctcttttttttaatggtttttcagaatatttttatatgtgggataaggtgggaaccagaaagatggctatggctagtaccggatatgacacatcttagcattacgaatctagattcgtagtactagaatatatcatatctgatgctagattcgttttttatgggacggagggagtagtagagactagatttgaattgctaaaactttctatttttaggatactaatttatactccctctatttcaaaatgtacttgtgccctttttaataagagattaaggctgggtgtgtggaaaatgactgtgatgggttcagatgagaaaatatatgagaaagattatgcttggttgagatgaggagataggtagagaagtagctgtattttttgaaaaatttaaataacacaagtagttgtgttttgagacaaattttaaatcctagatgtcgaagtgtgagctcctctatcggggtaccgcgaggccccctctttgttagttcgaccaggggcagcgagtgagattcgagattcctgtggtggatgagagaaagagaggggggcggggccctcgaagacagagacaaaagggatttatacaggttcgggccgctgagaagcgtaacaccctactcatgtgcttagctgactatatgtggaatacatatgcttaagcgcgtgagcccccaagcgccagttagacaaagagttgatcccccctccctaagtaggcttggaccttcttttatatctcaaggagttaccacatgggcccgccgagcctattcagggaggataatcacattaaatgtatttcttattgcttgtcttggaagtctgttgcacaccttgctgcgacgtagggcctgtcaaatccatccggctgacagtgtcaacacgcatgtcattc

SEQ ID NO: 12095 - DNA, 1501 bp, Oryza sativa
atatttgcaaatgaaaaataatttgtgaataaaacttttttatacatctacaagcaaaagctaaaagatataatatgatgaaaggccctaaaattaactctaaattttaggtttaaaatttaaattttgactgataggtataagtataaaaaaaaggatgaggctgacttatccgagatctgcattttcttcataaatggttgtattccaagaggacatgtacaatggaggctactactattagtggtctcaagttactacataggctaaggccactaatatacacacaattctttaatggagactactgctaagtgctaaatgttttttcatttcagtccttattaacttttttattatcacatcgataatacttttatattttagaccttataacaacaaaaaagaacacatatatatatatatactctaacctcctaacggtcccacagttagcctctcacattcattttccacccccacccccttaccaccactgtcgctattctcgcctttccctcttctccttctccgacggaggcgctccccttctcctttgctgtcggtgctcctcttctccttctctgtgccttgtcgacgaggcgtggcccgcccagctcatggtggtgatgagatctttgacgtcgagcttcgtgtggcaaagggcgacaggatcggtggcgctcgagcttgagctttccagcggggatctggcatcatgctcgctggatctggccgagctcgagaaccagagagatccacagatctggcgtcatgctcgccggatctggccgagccaccgccgttgtcagcgtcttcccggaggtggcgtcgatttgttcggagccgccgttgggctccctctcctccctccctggcggcacgggccacaacgaggcatgggctggcggcgatgacctccagcccgtcaactcgtcaatggcctctagttccccttttctcctctgtaactttctggatcacacaaatcgttctctctctcctagaaccacagttcaaccactgtttcatctgcccccctgcgagatcacttcaaaccttcagtgagttacgaggcaccatattgtacatttgtacatggccttatgaagttatccagtcactacacttgcacaagaaccttatcagctatcagcgccaccagaaaacgaaaaggacacgtgtactacggactgccagacgaaacacgccaaggaagaaaaaaaaatgggcgtccagcatctgctcaagctgaggatggcgtcgccccacccgcacccgcaccccggcgcgccgctcgccgcgcgcccgctctccgcgctcgccttcttcttcctcgcccggccctcctccaccgccgccgcgcctcctcctcggcacgtcaccctctcgtgctcgcggccgcactgcaaccacaaccagtgggccgccagccggtgccgcgggacggcgggccggcggcggctgcaggtcgtcgtggcgatgtcctcgtcggcgccgc

SEQ ID NO: 12096 - DNA, 1501 bp, Oryza sativa
gagagggagcccaacggcggctccgaacaaatcgacgccacctccgggaagacgctgacaacggcggtggctcggccagatccggcgagcatgacgccagatctgtggatctctctggttctcgagctcggccagatccagcgagcatgatgccagatccccgctggaaagctcaagctcgagcgccaccgatcctgtcgccctttgccacacgaagctcgacgtcaaagatctcatcaccaccatgagctgggcgggccacgcctcgtcgacaaggcacagagaaggagaagaggagcaccgacagcaaaggagaaggggagcgcctccgtcggagaaggagaagagggaaaggcgagaatagcgacagtggtggtaagggggtgggggtggaaaatgaatgtgagaggctaactgtgggaccgttaggaggttagagtatatatatatatatgtgttcttttttgttgttataaggtctaaaatataaaagtattatcgatgtgataataaaaaagttaataaggactgaaatgaaaaaacatttagcacttagcagtagtctccattaaagaattgtgtgtatattagtggccttagcctatgtagtaacttgagaccactaatagtagtagcctccattgtacatgtcctcttggaatacaaccatttatgaagaaaatgcagatctcggataagtcagcctcatccttttttttatacttatacctatcagtcaaaatttaaattttaaacctaaaatttagagttaattttagggcctttcatcatattatatcttttagcttttgcttgtagatgtataaaaaagttttattcacaaattatttttcatttgcaaatatgccgtttcactttttcctccaatatgccaaaccatggtgctgatacctgctgcgttccaattgaaaggcagccactttgttcttgtgacaacttctaaaactaaaacctgtagatatctctgcctttttctcttactgagcatctgaaatacccttttccagaaatgcagaaaatgctgcaacttcgttgctctccttaaagacaggattttagtcttagcacctgcaagttatggatttagctcatctattggcaatctatatcagttttgagtgtatggcacttgctggtgacgaaatctcttttccagcttgtaggcataagccgtataatcctctcaaagaaaatcataaacgaatggtacgtttcatgaaaaataacaagagatggaaaaaaaaagtatgcaaggccaacaaatgttctatgcagcacaactgtccaaattctgaagaaaatgtgagcccctaatgcactggccagaaccaggttaaaatgaagtttcgtattcaggaaatatgaactgtccacacgaggtattttttctcaaaaatatgtttctaaatggaaatgccaacttgtcagtaacaaatatgagcaatacagcactacacagatcaaggatatctgaatgcat

SEQ ID NO: 12097 - DNA, 1501 bp, Oryza sativa; identical to SEQ ID NO: 9421

SEQ ID NO: 12098 - DNA, 1501 bp, Oryza sativa; identical to SEQ ID NO: 9420

SEQ ID NO: 12099 - DNA, 1501 bp, Oryza sativa
agcaattagggtcaaacgttatgttcgatttgaaaaagtagggtcaaatcggtacttagtttatgaaacagggtcaaataagcaattgcccctttttttcctctattcatatgtttctttaagcccacggttcaaaagaaccctaaaccttatattgctatgcaccaaaatttattaacgcaagttcctagtaaagagcaaatctccataacaaaaacatatattagaaaaatctgattacctatctttttatttctcgtatttatacaatttcggcatcaaaccaatatcatattttaactcttttgcctattaatgtactgcctctttttcaaataatttacactaagcatattcatttttaaattttgtctcttaaaatattttacatgctgaaaaggtaccacattatcaaattgtatggcgtcttaaatgtaaatgtaaaacatggagctctcattcattgtaatatggccctggccaattgagcccaatcaagatagttcggcccatcctagcttttagtccatcacgacacggggctggaccatggcccatatcccatggcatggttggactgcaggctgcagagcccacctcctcctgcattgcaacctcgcccaagttggaccaactttgccagcagatgaaccgtcgttatcgcctcgcacggtggacagtggacactgtacagtgtggtccagttcgttccctgcagatccatggccgcgccggcgagtcggcgtgcacccgcgaccagaagaaaagctgccggcgcacgccccgcgtgccggatcagcggccaactttttactcctctgaacaaaagccccacgcaaaatagacttccttccatcccatggcctcaaggttgtgcccgcccacaaaatcccgcgtcgattatattctccatggagacgacttgttagttgtcggccacgcaaaagtttttcgctaacatgagttttttagttgagattaacgacaaatggttccgcgtcaccgggtcagaggcttatggcaggataagcctgggattgggacaagatcacgtgcgcacagaaaccatttgcctttggatctcgtcccatccatacaaaaatggcaacacccagcatccatgcttagcacgccaacgactagttgaaagatcgcaattcgcacatgaccaaatcataaattaatggaagcgccaaaatagaggagtatatactggatagtcataatagtagaagagtcatagtccggtcaacttcggcgtctcccggctcccgcccgcggctgcgcgtcaccacttcgcatcactcgctgcctcgcacgagtcgcaccgtcgcaagccgcggtatcgtggcagcgaccaacccgtcgcgccgcgcgctataaaaatccttccatgccacagagcttcttgacatcaccatcgatcagtcacatccttcgcctttccagcatggcacgcatgcctcctcctctcgctgtcgcttgcacggctctcctgctc

SEQ ID NO: 12100 - DNA, 1501 bp, Oryza sativa
attatttttttcttttttctaaagaaactttaaccatgtagagcaattagggtcaaacgttatgttcgatttgaaaaagtagggtcaaatcggtacttagtttatgaaacagggtcaaataagcaattgcccctttttttcctctattcatatgtttctttaagcccacggttcaaaagaaccctaaaccttatattgctatgcaccaaaatttattaacgcaagttcctagtaaagagcaaatctccataacaaaaacatatattagaaaaatctgattacctatctttttatttctcgtatttatacaatttcggcatcaaaccaatatcatattttaactcttttgcctattaatgtactgcctctttttcaaataatttacactaagcatattcatttttaaattttgtctcttaaaatattttacatgctgaaaaggtaccacattatcaaattgtatggcgtcttaaatgtaaatgtaaaacatggagctctcattcattgtaatatggccctggccaattgagcccaatcaagatagttcggcccatcctagcttttagtccatcacgacacggggctggaccatggcccatatcccatggcatggttggactgcaggctgcagagcccacctcctcctgcattgcaacctcgcccaagttggaccaactttgccagcagatgaaccgtcgttatcgcctcgcacggtggacagtggacactgtacagtgtggtccagttcgttccctgcagatccatggccgcgccggcgagtcggcgtgcacccgcgaccagaagaaaagctgccggcgcacgccccgcgtgccggatcagcggccaactttttactcctctgaacaaaagccccacgcaaaatagacttccttccatcccatggcctcaaggttgtgcccgcccacaaaatcccgcgtcgattatattctccatggagacgacttgttagttgtcggccacgcaaaagtttttcgctaacatgagttttttagttgagattaacgacaaatggttccgcgtcaccgggtcagaggcttatggcaggataagcctgggattgggacaagatcacgtgcgcacagaaaccatttgcctttggatctcgtcccatccatacaaaaatggcaacacccagcatccatgcttagcacgccaacgactagttgaaagatcgcaattcgcacatgaccaaatcataaattaatggaagcgccaaaatagaggagtatatactggatagtcataatagtagaagagtcatagtccggtcaacttcggcgtctcccggctcccgcccgcggctgcgcgtcaccacttcgcatcactcgctgcctcgcacgagtcgcaccgtcgcaagccgcggtatcgtggcagcgaccaacccgtcgcgccgcgcgctataaaaatccttccatgccacagagcttcttgacatcaccatcgatcagtcacatccttcgcctttccagcatggcacgca

SEQ ID NO: 12101 - DNA, 1501 bp, Oryza sativa
ccctcgtcggccactccacctggttgaatgcccactggagctactacgcccccgtcctctcgtgcgttgacctcctccacagaagtctcgtttacttcagcacttggtccctcgccatcatccatgttcgtctgcacacctggatcctttgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacgaacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacacacttctagattagtacaactaaaaccctaaaaatataatgcatttattcaaacaaatttttaaagaatacacactatttaactcaatagtcacatataggatctatgaatattacctgaaatcggtgtctgaatccggcagggcttcgccccttcttctcttctcctcccctctcttctttttttttcactggaattgaggagagaagaatgacggctgggggatgggcagcaggccttttataggcaacgaggcctgccgcccggccagagggcggcaaggggccgcctgcaaaatagccggccccgactggctttttttgcattcgggccccttgccgccgggttttcctaaaaaaaaaccctccctctgtcaccgcccgttcctcccccgtttgccacgtcagcttgtcgccctagaggtgggcggtaggggctatttctgcaattttttggtcgatatattatttctgtaaatattaaaaaaaataatctaaaaccgaaaaaaattctcgtcaaatctatctcggcccaaaattgcgggcacctcacctaccaggacaggaccccggcccacgccacaggtggcggccgccgccgcgcgccgcagccgcctcctcggcttcccacggatcggacgggtcgcagactcgcggcgcacactggcacccgatttgttggtttcttacccctcctacaaggcggccggacgcccacagatcggatcgggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaacca

SEQ ID NO: 12102 - DNA, 1501 bp, Oryza sativa
agagcgcgaacttgcgggagaagcggaagatggaggcgacttgcgtggggagcgcgaagcgggcgcggctaagggacatcatgcccgtggccgcggcgccgaggcctttggtcagggacgttgcaccgcaggtgaacagaaaccccggcgcggtggcgcgcggaaccggcatggggcggcaggtggtgtacagcgacagcttgtctgtgatgatgttgccgccggtgctgacgcgcgtgatagtgtactccgggaacccggtgcaggtgtcgttgaggcagcccggggacgccgcaccggagcagccggtggcacaggcggcgctcttcgcgaggcggcaaggcttggacccgcacggcacgcgcgcatacgacgacgactcgtacccggactcgcagtccacccagagcatggcgcccgcgaggtcaaccacggccttcacgggcacactcggcgtccgctgccagaacatcgtcacgtactgctgcgttgcgccgtccttgtccaccggcagcagcacggcgctcgggctactgcctgaagccgcgcggcacggcgagagcgggacgaagagcagtagcactagcactggcgcggtggaagcgagaacgagacgaggaggtaggcatgccatgctgggaaaaccaaggatgtgcagtgacggtagtgaaggatcgaatggtttttatggagcgcgcgcccacgcgcggccaggagggtaggtcgccgcgcagacgcaggcgcaggggcgagaccgcgccaggtcgcgaagtggacctccggaatataactcttctaccacttgctagtgctgctcctgtattttaaggtttgggcaagtgcgatctttgaacaaattaacatgttttttatgggtgagatgagatccaaagggaatggatcctatattactgtgctctttgtgatcctgtgatcatgtccctgtcctgagcccctgacgcggtgacgacttaccgtttgtcgctaatctgatataatggagtaaaactctggttagaatctcggagaaaacctatgacgcttgtgttgctgacaactcacaagtcattttatagagaatcaccctcatgcgaaaatatatatcgatctccgttcaagcccctatatttatagataggttgatttttataggtgggcttttaagatgttcgctttaaaaattataccacatgagaaaataacgatgaaatacaaaaggcattggccacaaaaggagcagctaagtctccttctcacttctccctcattcctgttgcctcctttccggtgaagagaaaataacaatcaaatataaaaggcattgtccacagaaaaggcggctaagtctttctctcacttctcccggcctctttcctgttgcctccctttcttcaggcgacctctccgtctttcctatgcccctctcccttcctagcgacggctgcttcaagcggttgaggcgaaggcgtcgggattcgattggttgatagaagcggccaca

SEQ ID NO: 12103 - DNA, 1501 bp, Oryza sativa
ccgctgcaggtgccgttgaggcaggccggggatggcgcgccgaagcagctgttgaagcagccgccggtcttggtgaggcggcacggcttggacccgcacgggacacgcgcgtaggacgacgacacgtacccggtatcgcagtccacccagagcgtggcgcccgcgaggtccagcacggccttcacgggcacctgcggcgtccgctgccggaacaccgtcgcgtactgctgcgtcgcgtcgtccttgctcaccggcagcaccacggctctcggccggcctcctgccgccgagcggcacggcgagaccaagacgaagagcaggaggaggagagcgccggaagcgagaggaggaggaaagcgtgccattcttctgagaggaaggatgcgatattccgatggggtgtgaaccattgcagcggcgaggaaggatatttatagggcgcaccctcgcgcgcggtttggtatttcggctctcgcaccaatcaccatcccagaatacaacggcgatggatggcggtggtagcctggtagggcagactgtatagtcgcgggccgagcgagagtacgactgtacgagacgccgaagtggaaacggaactctgctgttatagcaaggaaaatgctggtagtatttgacggtctgggcatgtgcgaattgcgacctttgttctcgaccaattgcgggccaccatgcaggcaggcaaaccatctgcacagccttttgcaggggtggccattgttgtatgggtgatgagatgatggtatccaactcatccaactaatctaaactggaccagtgctgatcagctggagcgaggggagctgaaatgggagaagactgcacaagcagcgacggttgattacatttgctgacaaagtaaggtcaagtgcttgagattacctatacattttacgataaattttctcttaaaagtttgatagatataattataatacaattataatgtaattacactgtaacttacatacagcttgtatgtaactttcaaaagtctctccgtaacatgctatttccgtcaaacggaggtcgtggaacgaaccctcacacatatgtgcacacagcgactttttttcttcatttgaatagatctaacgatttaaaattatgtgaaagttacatgcttacattatagttgcatgcaagttacagtgtaattacattacaattatactgtaattatatatattaaatttttagaagaaaatttatcgataaatatatagcaaaattaaattacattacgattgtactataattacatcagtcaatattttagaagaaaatttatcgataatatatagcaaaattgattccaaattgttgtttcagtcaaacgccacctctcactatcaaggatatggtaaagaacaagtagatccaagtcaaatgcctacgctggttgactagttgtaatggatgaacaatttattccaacaacttcacacgattgcacaaagaaatgcaaagcatcttttttttt

SEQ ID NO: 12104 - DNA, 1501 bp, Oryza sativa
tattaaatttattcatcatgccatattagagcgccgtcttcgtctgagtggtaaaattacgtcttatgtggaacaaacgcacaataacatggtcttaatttgtattaaaaaaatcattgcaatgaacccacgcctatctttttcaaattagactccaaattctcattcaatgagttttccccattcaatgaaaagacaagtataaacgtgtttcatggatatagacaagatctcgatggcgcttccaagcgtgtcatgcttaatattggacaaaacttgtttttcagaatccgaagttcatggttttagttgtacaatatcgaaattgtacggttcactttaagaacatcaaaaaatacctcagctactcatttctaacatttggtcaaaactaccatgaaatttacttaccatatcgttacgccgtcttcttcacctgaagcatctaggcccccggtgttaattttggtaattaatgacaagcattaattgtggactaaccgttgtgtttgagcttatttatttgagttaggttcacttatttgtgtgcacatggatgatcattgatggattaaaattgacggtgcaaagcaaaaggaagagaagacggtaaactagtgttttctttttaaattgatcgaggcgttgggcgatcaaaattgtgctagtttatttatagttttgccgtactactaagagggggaatgacctagcaaagagatgattttaattgtcacattaggtcattgcattttcacttgtactcacattttcacaacacacttgttatatttttgtcactgctctggactgccagggtcggtttgaccgccggacagatgccggtttgaccggcctgtgtcaccggtctgaccgccatgtcaggaccggtctaaccgccgcaccaaagacggtctgaccggccggctatatggctgggatggcatgctctgggatggccgatcccgagccgccggagccgtattcggtcagaccgagctggtggcggtctgaccgagccgaggccagtctgaccggccaccccatgtcggtctgaccggccgggggcagtggggcccaatgacagccctacaacgggctagaaaactagccgttgtagagtagcacggtctgaccggccacatacctccggtcagaccggtagagcactgagttaggggatttcgcccccaacggctagttttggttggtgggagtataaatactccccctccagcagcaaggggactctcttaacacccaattcaattgcatacatcccttgcacctctctcacacacctttgagcttagtgttcatccattgtagtggttgaggttgttctagccaagagtcaagtgcatttgcttccattgtagagctagtgtggcacttgattgatcatctccatgccgggtcattgcttgttactcttggaggttgccgcctcctagacggcttgtggaggagttgcccggtgacctctccgagaagattgtgg

SEQ ID NO: 12105 - DNA, 1501 bp, Oryza sativa
tgctaacagaacatgcacgtcatctagatcaaccaacttatttctgtcacagatactacacgacttataagttataactaaagaaacactatgcataaactaaatcaatatggcagaaaatatgttttataatcaatcttttaacacacaagaacaagatctgctccacttatcactaaagaacccttatgtataaactaagccaatatggcatacagtaagtcaactagtaaccaatctttaacctatagacacaacaaaagatttcacgattacgatcacataaataaacgccactccatcgatttactgttcccgaacagatctactaacaaactcaccccgaaaacccaacacaagaactagatctaaacagcacgcaactgaaagcacgaacagatggagagaggagaacgacatggagaagaatgctgatggatggatggatccatacccttgtacttgccgcagtaggccgacatggttgcgggcggagcgaacgagggaggaggctacgacgaatagggagatcgaggagaggaaggaggcggcggctgtggggaatgaggcgagaagggagggggaggggggtggccttttgaaggggggcgatgatgagttgatgacccgatccgatctgtgggcgtccggccgccttgtaggaggggtaagaaaccaacaaatcgggtgccagtgtgcgccgcgagtctgcgacccgtccgatccgtgggaagccgaggaggcggctgcggcgcgcggcggcggccgccacctgtggcgtgggccggggtcctgtcctggtaggtgaggtgcccgcaattttgggccgagatagatttgacgagaatttttttcggttttagattattttttttaatatttacagaaataatatatcgaccaaaaaattgcagaaatagcccctaccgcccacctctagggcgacaagctgacgtggcaaacgggggaggaacgggcggtgacagagggagggtttttttttaggaaaacccggcggcaaggggcccgaatgcaaaaaaagccagtcggggccggctattttgcaggcggccccttgccgccctctggccgggcggcaggcctcgttgcctataaaaggcctgctgcccatcccccagccgtcattcttctctcctcaattccagtgaaaaaaaaagaagagaggggaggagaagagaagaaggggcgaagccctgccggattcagacaccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 12106 - DNA, 1501 bp, Oryza sativa
cacttaatctgctggtttgactagacaatcaatagtagtcaatgaaaacaaactctttgtgattggatagtggccagggcatatagaatagagggcccacatgtcagtcaccgcaagagagagtgaggatgatcaccacagtttcgtgaaagaagatcagaatcagatcagccatggtggtataaccgtccttcctgaaaccatgcaacgcatgagaccggagaaaaataacaaacttgagagatgtcaggttgttagggttgggaattcaggtcagatattcagaattcagcaactgcatttgtcagtcaaacactgaggcatatgaacctgatctcgaaaagaggaaggaaaaaaaggcttctctttttttttttcaagttgaggtcctgttatcctccaataagtgtaacaacagataaatgcatatgtttttaatttagtttccaactttataatattcaaatcgctcatttttaccctaaaatagttattgccacaaaccatctaccaattcaggcacaaaagaggaaggaaggaagaaaaaaggaaaaaaaaaagatctcctcctgagctgttcgttgtcgccgccggtgtgaaccgaccttgtgtttgtttgtgcatgctaaagctaggtcatataatcttatcatgccactcctacacacggtgcattgagattcgtgcgggggtgggatcggacggtggggagtggtccaagaggagagaaaagaagaagcaaacgcgtcgctttcagctgtgggggcgtcgtcttctcccttctctcgcgtctcgcgtctcgacctcctttcccattcgctaatccttcctcctcctcctcctccgcagtagcagcagccgcctccagaaattccccaatccccaaaccctaaataaatcacccccacccccacctcctcccccgtacacgaatccaacccaatccgatacgatacgattcaatccctcccaggagacgctgctctttctggatgtcgattccgtaggggggagtctctctggtgttcctcctcatcaaggtgaggtttgtttttttgttattattattgctgttcgatcgaatcgttggtagatgaggagggaggcggaggggattctggcgatggtttgtttgttgttttgtgtgatgattcctttagtctggggcataggaaaatgttttggttgttttccttccaccccgtggggattgggtgcgattctttcccggtgtttcaatctgagttgtgactggattcgtctcaaagtttgggtttttcttttttgtttgcctgttttcttcgtgctcccgcaacttgatgctggagtctccttaaaggtgggactttggggggttttttttccgactctgctgagggagaagaattcgtaggaagaaactggtggaatttgtttctttgttctttattactaggttgcagttctgtgaaaggaaggtgtctctgatcgttctttttatgtactagttatctaaacaaaa

SEQ ID NO: 12107 - DNA, 1501 bp, Oryza sativa
  unsure (1)..(1501): unsure at all n locations
aatcaggatgaaatcaagcaagaagcgatcgattcggcgtgtgctggatcggtttccgttgcttctaccaaagtttttttctcgacgtcctctgcctcgttttctttgccgatgatgtcggccggcggcggaggctgtcgccggagaagacgacgtctccggcagcgaagggagagcaaaatatgtcacaaatctgggccgttcgctctctaacggacggctatcgatcgcagccatttacagatcttacggcccaatttgagccgcaaaacgagcgagtcatccagtcaccgcctaggcccagtaaccaatggtagcgatcctagtttgggccgaattggttcgccatcagatattgggctaaatttccattcaagttacattaggcccaattatgacaagaacctcttgggctatgaatccggcctaggcccatagtccggtcggcccacaactgccttgtgctcggcccagtttgaggaacaattggtagatccaaatctggatgggctgtattgggcctcatctcaactaaagtaaaactagggcccaattataaaagcaaggcccacacgctccccttgtcttgttgcctctctctcttattcttctcttcgaccgtttcttcgccgacaagaagaagaaggctccccgcggctgcggcggcggcggcgaccagcccttccccttctcctgcttcgacagttcgccgccatggccactcggtttctgcctctggtgcgccgcggccttgccggcgtcctgaatcaatcgcccgcgcccgcgtccacccgaggtgattcccccaaacttttttttgctttagctccctcttttggttcggcatggataaatctagtcgatattggtgatgactctcgcggatgtgtgttttacttggagaggccggtggttggaggctcgaatccggggttgctgctgccactacagtcaaattttgtttacactgcgtctgcgcccttttcccttgtgtttgggggtatgagaagattgaaatatggaaacaaggggattcccttgttttgggattgattttggtaaaattaaggtgatatggttgaagaactgaagaaaaaacttggtggcaactatagtagtaataataaagataagattatagagtcaattgtgtctgtttgttgctagttgtcagttcctgccagattggcaaatatctaaagcatttaccattcaaatcattacgtatgacaagaatttacttacatctttgcaataggaattaattaaacagtcaactaatgaaaatctgttattgcaggattcttgtttcctgcacctgtgactgctggcataagatctctgcaaactatcatggaagcaagcaataatgcttcagatgaccgtaaccaggacatagaggattccaaaaccgacaccgtgccagctacggtcccttcatcggattccggcttcaaagttagagatacatnnnnnnnnnnnnnnnnnnnnngacacgacc

SEQ ID NO: 12108 - DNA, 1501 bp, Oryza sativa
gtaatgctagctgttggattgcaatcgttgatcgatcacataagcgattgtgaatttgcaattgtcaatctatgaaataatcagataagctgtaatctattctacatttttttcagagatggagcaggataaggcctgcttcgatcaacttctgttataaaaaagacactgaatattcggctgtatactgcatctgaatctcctttttgcttttaagcattaatagtgagcttgtgctgaatttaccgacggcgatggagacacgagagaaacgatggtttggtgaggaatgtgtattgtttaaccgagtaaatctggtgctgaaatgaaaattctcagaatgttcttcggtattgagtattgacctttgatcgattcggcagagtttgctttgtccacttcatcggttagttcaaccatccatttcctgatactaatgttcacaactcacaaccatatatcagtttgttcaggttaaatttcagcagcgtgtaaaatggcatccagcccattatcattggatgtaaaatgacattatcttttttgcttaatattgctactccaatttagcaactagttgcagtggccagtgagccatggacagatggtcgttgttgtcaatagagcacgtcatgttcaggttaggcaaccacaattggctggaaaggttgtgtttttgtcaaagttcgttcgcttcagccttcacgtacgcatcatcatgcatgacttcgagctttcagtggtgctgcccagctaagagatgccaatatcatcacatctcattttctccttccatcgcagatatttttaataacatagaagtacaagttaccatctatagaaaaacagcatagaaaaatagaaaataataaaacaagagtagagaaaaaaaatatttttttgaaaaatgaaaggagagaagtactctcacagtctcactggtctcctggctagcagagtgggtaagcccagcccaacaagcatcccactagatcatcacggcctctttcggttgggcctagatttaggccaatccacgcctccgaacaagtagcccaaaaacccccactagatcatcaaggcctcatatagttgggccggaatttaggcccatataactaaacctaaggcccatcaaatctccaacccttcacactctcctctcatccacgtaaaccaccctctccctccctcgccgccggtagccgccaccaccgccgccgccgcgaacttccaatagatcgccggctcgccatggctctacgccgagccgcctccctcctcctccggccacggctccgagctcccgttccgatccccacacccaaaaccccaaaccctctcctcctcccgccccgccgccacttctcccagctcccgccgcctccagtccccgcctccgcggccgccgccgccgcggccgttgcggaggaggcggaggaggccttcgaggcggcgaaggggaccaaggacctgctcgccgccttctcccgcctcgagg

SEQ ID NO: 12109 - DNA, 1501 bp, Oryza sativa
cttgacttgaacggcagcaggaacaccactccacaggcatcctcgacagcacggacgaagcctactactcggagaaaccaccatctgacgcatactcaaactctggggttggggaaaaatagagcaagactgagtactacccactgtactcagcaagtcataccggaaccggggtatgctgcaggatattgccaaaggatagctagagaggttcttttgcataaagcgagcatttataaacaggtgtttaaagcggtaaaacaattgtactaattaatcaatattaaccatccactgttcaacgctacaccacattgcaacaggcccaaccaataacctgaactaatcagttccatcagactacactagggtgagactaatcacggtgaatctggttgaccgcccataaccgtgggcatggctatttgaatagttttactctgatcagaggtgtacaactgtacccacaagacacagccccacgacatgtttccgtgcaccgacatggcaccacgacataccggatagaggccgtgacaggatccttcgcataaccccctctaaccaagcacaccacacctcaggtttcacccccactcatcgcaaggcagcgggtagtcccctctcgtgcctaggtgaatccggaagccgcatagaccgtcgcaggacccatccaaactccatcacgcccacccttgcctggatgcgtcagctagaggaaagctacactacaagcccagccgttgcccacgctggcttgtggtaagtacgataagttcttccagggcatcccgcgaaccggtccttaattgccatgggcgcgaccatcaaaaccatgcacccatagcccaccatgtgattgattttagttaaccaacaccgaagcggtggcactagtccagcattaacattagaacctacagtctatacattagtttgtattccccattgtgtgctagttgaactaagcatggctaagcaatccctagtccaatctctaatcatgtttatatcccaagttatcaaaggagcatggtaccaaaaatagcatggctgtaacagaaggtaaacatcccatagtattattgcaaaacaatgcagtatttgaaggaaaacaatagaccatttgcaatataggatcaatatgttcaagtgacaagcatgacttgccttgctctgctcctggaggaacctcggcgactatttcaaagtacaccggagcatcgggagagccggaatctaagcgacatacaaggcaaacaatacaaacaggctataagactactgaaacagagaacaaaaccattattaatggattctacacatttttcttgatttactgagacttgaatgggcttaaacggagctcggatggattagatatgaattttagaagattcacagtgattttactataaacagaaaaatccttaattgaattattgcacaataaataaatcccggggagagagagaggtggcgccgacatgcgggccccaca

SEQ ID NO: 12110 - DNA, 1501 bp, Oryza sativa
gatccggtggccgacgtcggccccagtgacgtgcgctgggtgctgcgcctctccgccacgcccgcctcgccgatgcttccgcttctccgccattgccgcaccgtgtgggccgactgctggcccgcccccgcgcgcggctacatgcctttgcctccgcctccgctgccgactacacaagcgcgccaccggcgcccgagcgagccccgcctctcccactggccgctcgcgctacctccttctctgctccgccgacggccgcccgagcaacctccgcctccgctgccgctactagcgcccgagcgtcgtcctcgtcgtcgtcctccactcctccgtcgccattctcaatgccgtcgtgctggtgagctagtgaggggcggcgtggcagcaggatcccgacgctgccgcgatgttatggatcccggcgttgccgtgatgcctgcccccgtgctctcgcccaccgctgctctaccagccgcagccactcgcgcgtgtgtgtcgtgctagtgtgttgcttgctactggcgctcgcggcaccgtcggtagcggcggtggcgcggcatgactacaacgaaggatttggggatttttgtgctgtccatggcactactgttgcggaggggcttgtttgtaaaattggtgcttgtgtggcgtgccacgtcggcagtcagagccggtaaagtggggtttggacctcaataagtcacttaaacaagatggtggacatatatgtgcaatttacaatattataaacctaagtgacacccgcgctcaactttaagtatcggctatgtattttactctttatgaaacaatagatcaattcctactgagtatatattaatacgtttaaacaaataagaacagagttcagtgaaatcctactagttttatattattaataagttgaaataaaaacagagttcggaggagtcaaggaactgaaaagcagaaaagaaaaaaaaaacaaaaattgatgctacaaggattctagctgttctataatccaagatgaatgtcccaccatggataaccatggcgaattcattcttgcactgatttctgcattatgctccatgaatagtataattatctccatacagaattggacaggaagggagtagtattttactatttctaaatgatgcaatgacaaatatttccaggttgttcaaatatttttgttgcatcagtaatacttatgtaacatcataaatttaaaaattgttaacagagctgttcggaaataagtgctcaaggcagtgatctttttgtcatttgtgaccttagagattgggttgattttgatacatcttcctggtaggccacaattttgtcactacaaattataatcattttttatatttatagtcttataaaagaagcattttgattttgctctcaaatggtagaggcaggtaataaatggcaacgcaaggtaaacagtgcaacactctagaagatttgctattcgatgacataggagacccattgcctattaagc

SEQ ID NO: 12111 - DNA, 436 bp, Oryza sativa
ttttttaaaatttaaattgaggacactggcacaaaaacgtcccacgcaaccaatcaaccaattttccgcgcgctgtcacgctcacacagttgagcgcccgcgccgagttccgacacccaacccagggcctcccgctgtttcccgccaaatttggcacgccgccgctgttgcctctccctctccgtttctcttccatttcctctccatttttagcttcccccgatcgtctcgtctccacccatccttcctcccccgccgcgccttcgccaccaccgcacatcatcgctcgcttcccggcggaacgcgccccgttccgccgccggcgccgcaggagaagacgactacgacgacgacgagcggtgttgtgtgaagagaaggtgatcctgaccgccgccgtacgccgccattgccgccggggccgcggcaccgcccctga

SEQ ID NO: 12112 - DNA, 263 bp, Oryza sativa
gttatggccggtcaaccagattcgccgggattagtctccccctagtgtagtctgatggaactgattagttcaggttattggttgggcctgttacaatgtggtgtagcgttgaacagtggatggttaatattgattaattagtacaattgttttaccgctttcaactactgtttataaatgctcgctttatgcaaaagaacctctctagctatcctttggcaatatcctgcagcataccccggttccggtatgacttgctgagt

SEQ ID NO: 12113 - DNA, 1501 bp, Oryza sativa
gtgagatccttctcatattgtcgcggtcggccgtcgttaccggtcaccacgcaccagtcctctcctctctaacccctcctttatcttcctcagatcgaggccgagcccatccgccccatcctgagcgacgcccgtcgccggagctctgtcacatcgtcttcctgaggagccccgccgccaccgttccttgccgtcggccgccccttcgccgtcgtgcatctcggtgagcactcccctccctctcccttttcctccccttcgtcggccgcctcccgggcgtcctcgcgacgcgctgccgccgccgcgctccgcgctccgtgcccgcgccgttgccggtggtgccgggcagccggttgccgcctcccccttgccgcgccgcgccgctgctcgcgcgtgcgccgctttcgcccgcgggagctgtcgccggccgtcgccgcgggtggccgcgccgccgcgcgccgtcgtttggccagccggctttgtgccgtgctgtgccccagccgcgccgcccctggccgcccgatcggcttgggccgatccggaccgtcggttcccgtggaccggtggtggaccgcctcggtggtcccggtccacggtggaccggcgcccttgtgccgctgaccggtggggcccgcttgccggcgccgcccatctcctttgctgacgtcagcacagccttttcctttgagaaaataaataataattgcgcaataattcgtgaataattatagaaattcatttaaatggctcaaaacttctaaaattcatatctaattcattcgaactccgaattgagccgttcaacttgcaaaattcatctaaaattgagctctacatgtttgtttactttttatgtactgttttcttggtctttattagagtttttcctcgttttgcgtgccagcgtgtagttcccgtcgtttcggaagatcgcattcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagctatgcttaattaccactagctcagttgatgggataattacagtattagacctttttagtatcagagtgagctgcgtgctcgagacatctggccatgcttcgtggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagctgacgcatccaggcaagggtgggcgtga

SEQ ID NO: 12114 - DNA, 1501 bp, Oryza sativa
taagttcgaccaagggcaaacttgtctttaatgagtatttctctctccaattcctccaaaaataataaaataagaccgcgagtgtccaacagctaattacaagttttttatggtgcccgatagaatattcgtgttcttgcggtgtctaccagctaattgcacgttttttggatgccctgtagcaaatttttctgttatgtttgggtattactccctccatcccaaaatataaaaagttttaaggttggacatggttattaagaaagtaggtagaagtgaatgttgaagggttgtgattggatgagtagtggaggtaggtgagaaaagtgaatggcggagggttgtgattggttgggaagagaatgttggtggagaagttgttatattttgggacaaattctgagggctaaaagttgttatattttgggagttaggacggagggagtatttgttatcccattttctatttgattgagcttattccatactcgcatattgtatcaatgattgcaatgggccatcataagattgattttgcattctgaaaggaggaaataaatgaaataaaagtagtttttcaaaactggatataataaagtatcgagatgtagcaaatggagttgcctgccaactagcactgcttaaaaatgtttatttccctatattgtagtttgactatagagacataaattaaccatgaagattgttcattacacacctcgtatatttgtacatagaacataaaaaactacatagtccttcgaaaagaagggtatggtggtggagcttgtgaatatctactccacctcctttatgttataggttttatgaatttcccctagtagttcttcaatatcatatgaaagttattctacatattgttatcttattatttggccttctaaaatacaaatttaacatggaagggtccaagattcacatgtacatgtacacaagctaatgttacaattataactgtgtgaacatgcgaagggtgcctttatgaagaaaatcacattcatttatttcacaatactagggaatgtatgattagtgtttatccatataaagcacgggtgtttagatagtacttccaaactgtggcagggacggaacaaataccccatcaggtcaaaagctgactgactaggtgtaaggacaagcctaatagggttcaatcctagactaggcactgttgtccatcaattttatgagtacagctacgtctagtggtaaagcgaatggtcatgcttagcggactttgggcaactccataattttgaagcgtgtagaggacatgcacacaatcatggggtcaattgcttgacatttgaagtttttatgtattttagtgaaaatattagcaaaattagcactacatttcaaaagaactgcacaacatggtggcactacttccaaaaccatgtgattgatgatgtattcaaactggaaatataaataaatttatgcaagttccaatggaatctatgttatacattca

SEQ ID NO: 12115 - DNA, 1501 bp, Oryza sativa
gaaccaaaaaaaaatcacatgaaagactagggtttttgcaacgcgggggcttttatccgcgagaagcacccgaaccgccgccgccgcccctcctcctctcttcccccttccgccctctcagccctcgccgacgacgaggaggagaaggcggcggccgcacgcacgccgcgcgagaggggcaagcaaagctcggtggtggtggtggggggggggggggcggagccgcgtcgcgcccccggcgcctcggcgccatccgccccgccgcgggcgggctcaggcggaggaggaggaggaggaggcgaaaccctagcgcggggggagacgaggtacgcgtcgatgcctctctgtttcgattctcgcgtctcgtgatggcgggtctcattcgcggagcggggaggggaatcgaaaccctaggtgcggcgttcttgccatttttcgatagctgtgcggttcaatgaattccgaaaccctaggtgtcgcgattggtgccatttcggctcgatatatggtcttcgtgcgggggtatgggggattcaaggtgtgatcttgcgggatgtattgggctcaagatcgcctttttaggagaagagtagggtcgaatcgcggatctgcgtgaataggaaagaacgtcagctagacgggtggacgacgtcagccaggctatggggggttcgcagctagccaggctgcgggtcagaatgaatcgatgattgtttgccatgctcgaataggtttattgggggtcatgtttttgcaagatcttgaatccccactttgtgtatgtgtaagactgtaattaggtttcgtgtaaagagcctgactggatgggcaattttaggagatgtatgatgcattttgtgggtgatgagtatcactggggatagggcttcgttagcctgcaaacataatataaatcaataatcgatttaaatctttctgtttaaccaggcgaccacccttgattggtgtatcaggaccaatacgtacatagacattggaattgatctaaagtgatttatgcttttgaatgaggtttgcatcttagggaagtaacgagggttgctgattaaattttacttgtctagttctatgctttagaaactttagacagcataatcccgataatgttataaaccataatctgtattagttccctgcattcatagttcgacaacgtgtactactagacgtattcttggctttttgccattttctctggtagtggggtattaatgggtctagtgacttgtaaagcatgattatcatcctattgctctttctatttcgaacttacagattggaatgagcataaagccatatgttagtactttagaattaatcattacttgtactgtatcttattatcctgtcctttgtccttagtaaatttataaacacttactgtatctttttcgttcagtgctgctcaggccactttcaatagataaagaagtaatatcttcatcagtcctttctcaatatagttgagagcgagtttaca

SEQ ID NO: 12116 - DNA, 1501 bp, Oryza sativa
atgcgcacagtttgtattatagggcctgctttggagattacctatttcttttcactggtaaaaatctttccacctgtaatttgacggtcactaaaacctacaatcatgtgttttatacttttattaccccttaaaatagtactgtatttgggtatagtaatcaatactaccgtatgatccactgcatcaatgaaaataggtgcaggtgccgtcacaagtaccggccaggttgtagacgacgacatagctagagacgtactgtagcagaaacgctggctggagcgaaggaaatcaggctagatttatagccaactgtaacacggattctaatacgttgtgtgtatgagatgtgggactatatattaatgcttaaaaataactattatatgaatgagctattagattgaccaaagataatttagagctagcagttggttataatattaagcttgctctaaccgtgcagagaagggggagataaaaagagattaatcttggctgaggaggaggtgagagagaggttacgcaggccgcagctcctccacctggccgaccaaccgctgatgcggaggcgccgaccgatcgaggtggttggacgcgaggtggaagtcggggatcaaggcagcagctaggaaccaccatactcccctccatacacatgcattatcagcatatacagtactccctccttataaaatctgacacccatttcattctttggtttttttaaaattctaaatcctatttatagttattgtgtgctaaattaaattgttgatcggaaataaaaagttattctaatacttattggttgtatattcattgattttgccacatggtattggtaattaagttaattgctttttggtattgattgaaaaataaataggtcttagattttgataaggagggagtatatgatttgtgtatcgataccaatacaccctcacaagcgatttgaattaatatcgattaacatgcaacaccgtttcttgtgtcatgcacatgcatcaaggataatttgagcctatgatattgcttgcatgcatgcatggatgacaatctatctatctatctatctatctatctatctatctatcatctatttatctatctatctatctttatatactaaaagtccattaaacttcctacaaacgctctcaagttgccacgtggcgctctaataaattagagaaaatcctagaaattctaagaaaaaagcaaaacatctacccttgattttcacttaaattagtgggtccaatattatacaccgttagataaaattgatcttaaaacaaaccaaataatatgggtcccacctctcctttttctcccgcgtgcataggtataggtcacgtacgtacatgcatgtggacctgttgttcgtacgcctccctccatttttttcctttttttcttcttttttccatttatacaatctgatatatatttgtttaaataataataatttagaaaaaaagaaaataccatcata

SEQ ID NO: 12117 - DNA, 1501 bp, Oryza sativa
cccacaaggcccatttaaaagttagtctgccttttaggacagcttgcccctattctggtagcacactgtccttgtaccattactctggcagatcggatagatcaaagcctacacaaggaaggtgcccacatagcgcataattgaagttatattgccaatgactccatcagctaaaaaaagctccatctattacagtttgctaactgtttcaggaatatttatatttccgaaaatgtggtgttagggatgcaatatggctggtcaaataatgcacatctaacacatctaccacgcaaggtgggttggaataactataaatttcaaactagcaaagacgtgtaaaatgatcatgtggaaatacatttgctcattctaaatgggatactgggattcttggacacgctgtccaacaaagggaacagcccactcaagtttgttaagcaatgagcatgccatcttaaggacaattactcagatgtgcaagtgcaataaccaatcaatatcagtatagcatgctgcatcctaatttgagattttgctgcctgaacttagcccaaggtaaatttgacttcacaacggagataaactgtaagcaactaattgctataaatacaagatagataatgcgagcttggaccaggcaccagctagaaggaacacaccagcttagaagggaatcacggtggtgaccacactaaggtaccaaacgcatccacctaaagacctcatttggaatgcatgaatattacaaggaaaaatgcgatatatatctgtatactacttaaaattttagtagtggtggtggtcgttctgccacaccacccttaccactaatatttgggtctcacaatctatactttgcaccaccacaaccgacctaacaaatgggtcccatttattagcccctactctccaatgatttttttccgtttcagtgctggctctcccaaaatttcaaaatcacctacttgttcactaaggaaaataataaaactactacttattagactaaatatgtgctcaatcgatttaataagttagaaactcaattctttttccgttgcaacgcacaggctcttggctagtatacatgtaacgcatgctaccatcgacaatcagacgaagaggatcaaaagaatatacagatcgccatgggctgatccaacttgggacttttgtggggggaacaaacaaagtgttaactgtattaaggttaaggctctgaaattaagagcttcttccagatctacagaagagaagctagggttaacacaagcaagcaagcaaattcgagggtgtgtgagatgaatcagaaaaagatgatgtggatgctcaccaggacgcaggaagaggacgcgacctgctccgcgagatgggagatcggcgcaggccgcagggagcggagacgagacggggaagattttcgacgcacaatgatcttggacgctaagattatttcccctctctctctctctatctatctctctgaaagaaagaaaga

SEQ ID NO: 12118 - DNA, 1501 bp, Oryza sativa
gggcctccttgctgcgacgttcctccttgtcgtgttcaactgcctgagcagcttccagatatactccatgccggttttcgacagctttgaggctgcctacacgggccggaccaaccggccttgctcggtctgggtgagatcaggcttcagggtgttctacggcttcctctcgctgttcatcagcgtcgcgctgccgttcctctccagcctcgccggcctgcttggggggctgacattgccggtcaccttcgcctacccgtgcttcatgtggatctgcatcaagaagcctgagaggttcagctcaggatggtacctgaactgggggcttgggctgcttggcactgcattcagcctggctctctgtgtgggtggtgtctggagcatcatcagcagtgggatgaagttcaagttcttcaagcccccaagctagattgaccagcaatttccagtatcaaacttgcaaaatcagtacaaattctggtgtgtttgtgatattttcagacaatggaaaagcatatcccagctggcctccgcattgtgggtgtgcttgtcatatggttatatgaatgatatatgatgatgatatatatggtttatcttacatgccttggcaagaacagaattatgtattttctattttgaacacaagaaaaacaacaatggaatttcaccgaaacaattataaatgatccaagattctttgcacgattcctagcaagaatcaagttatcactactaaggctctaggacaattcaaatggttttgggctgattattaactcttttatgctctgcttagctactaagaaccagttaggaacataataatttcattggagtgttttttttttgaaatgttttctcaaaagacaatgggcactatctagcaggaacttatttaatcagagtcaatgttgcgatcaaatgaaattattgcatccaaaataggggtaataatatcaattttaccatttttagttttttttaaccagacaaaaaagatacggtaacgtcacgaaaataaattatcaagatgactatgataaaatagcttcggatagcatgaggcagcaccaatgttttgttccaaaatatagcaactttaagctctcaggatttgttccaaaatataacaacttctccaccaacattctcttctcaaccaatcacaactctctaccatttacttttcccacatacctccactacttatccagtcacagccctccaccatttacttctacctatttttttaataaccatgtccaactctaaaacttcttatattctaggacgaagggagtataattttgcatgccattgacaaatatgagtattgtgacatttaaagcctatctttgtatggtaaggctgaggttaagagcatctgagttggtgacatacggaattttactttctttttattctcgtgtgcctacttatctattggacaggagcacaaatactaacagttgaattttttttttgttattataccaga

SEQ ID NO: 12119 - DNA, 1501 bp, Oryza sativa
aattcataacactagcaattgaagaacatttccttcggacaatggtatacaaggaaggatacttatctttaaaaggcaaattaactaaccatttatcttcccaaaatcttatttgttccccattattcagaatccaagaacccatattcaagaaagtctccttaactttcattagaccggaccaaaaatgaaatcaccatgtttcctatcaacttgggttatagacttattataaagatattttctcttcaacaagtcttgccaaactccttcctcatttattaacttaaataaccatttactcaacaagcatttgttttgaatttccagatgctttcttttttttgaaacacataatagtacataagcatgtgctcctatgagcatttcagaatactagaccggtctagcctatcactgaaagaataattaattataaatatgagcacatgtgctaagtctaaaaattgaacatactccctccgttctaaaaaaactcaacctagatagggatgtgatatctcctaatacaacgaatttgaattcactatactagaaggggtcctagattgtttttttaggacggaggaagtaggtcggtaggatcaaccataagggaccttaccatctaagctaacctcaattcgccaggcaagcaattagacattctgacgatatgtactaacctctgttgtacgagtaaagaatttccttctcactgataatatgaggttttcagatgaggtgaatcccacccaaccaatcagatccatggtgggaccaattcggttcatagatcatgtagtgtcccaagactctcctttcctttccatgcagtaaggccttgtttaattcgcgaaaagaaaatttttaggtgtcgcattggacgtttgaccggatatcgaaaggggttttcagacatgaatagaaaaactaatttcataactcgcctagaaaccgcgagatgaatttattaagcctaattaatccatcattagcacatgtgggttattgtagcacttatgactaatcatggactaattaggctcaaaagatttgtctcgcgatttccatacaaactgtgcaattagtttttcattttatctatactagaaaaaaaatccccgtgcattgaaatgggtgaagtctattttaatcttattattgtcatatggtttagctaagataaaattcactgtgggagttcgcttggatatatatttttttagaaaatcatgagctgtagttaggagtccgatcgtctcaagttagcatgcaagtttttttaaacagattccttatatgattccttctgtattaccaaaagtgaacgatcttaaaaaccgactcaaatattaatatgtatttccaaaagtaaacaaacttaaaaattgactcatacacgaatgacatactaaaataccggcaaaaacatctttaatttttgtaatagtagagatagagaagagatatagattaaaaccaaaacataaaattaaaa

SEQ ID NO: 12120 - DNA, 294 bp, Oryza sativa
atgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataag

SEQ ID NO: 12121 - DNA, 1501 bp, Oryza sativa
ttatcaaattaaaaaatagtgtgagccatatatatgccttcaccctttgcattttctatgatatagagataaaatatattactctacgaactttaaattaggtcagtgtcatctgcgtggagggctccatgcatgttttaacttttgaaaactataagttggttttatgattaatttagttctttatattcttgacaattaaatcaataatttaaatctatatattgatgttttattataaattaaaaaatagtgtgagccataccatcaccctttgcattttctatgatataaagctaaaatatattactctacaaactttaaattagtgaacccgttattttatactgttaaattaggtctattgaaaaaacaacccccccccccccaaaaaaaaaacaaaatctcccatgtaagaaaaagcaaagtaacatatatacacatgtaaaaatatatagctaaaaatatacatacatactatgatcagagaaaatcaatggtttctaaactatgattttccatgatataaaaaatattacccaaccaatatacgcagttaaactagatcaaagatgtaatatgaattcaatggtctgtaagtgttcatctattaaatatatatcaatttcaataattctgatgtattcctttaattaaatgaactattattgacctatagtagttagtgctaactgataaatacataatggcacataataattaatgtcataataatttttcaaataattatggtgtacaatatcacctgacaaataatttgaatctacatatgtaaaaatgaaaaatgaaaacaacagaatttagttatatttttttcaagtagatcttatctaattttaatatgtgagatattacgattttcaaatattttttttgaatttttcaaaactatttgattggtatttgaaaagtgagaagcacacatgatacatagacatgataaactttattaaaaatacttctagcgagtgatatggctatactacaaccccttaatccatcatgagaactatggtcatatatgtaggttttttgtttgtcatatagttttggcaacaagtaaacaatccagtaacacccataatatattttcttatacttcaggaattccgatgtgtcgggcatagttgatggatgtatgtcatacactctactaacatgataacctcactcactttcaaataagaatattgtatatgtattattgaaatttgagtaatattgatttacactataaacaaattgtgtctactatataccacaaaacaactcaaactttaaaaaggattattgtaatcacctccgtcttctctttttccattctcaaaagggtgccaagcatagataataaagcttgctatactaccatgatatagcaaaggcatacatttggatgagttaagccaccatgggtacttaacgatgcaatcctttatgagggtactaatagtgaattagccgttaaaactgttctccacga

SEQ ID NO: 12122 - DNA, 1501 bp, Oryza sativa; identical to SEQ ID NO: 7261

SEQ ID NO: 12123 - DNA, 508 bp, Oryza sativa
tagtactaggccggtgcccctatttgttttctcggaaatcttcatctcatagttatatgggacaaaaggcaaaataaattatggcatatgtcttgacatgtccaaatttaaatactaattccaaacaaaaggtgatagtaattgctatttaaattttaaaatacttctggaggcagacgacagaaaaaaattgcctaccaaccatccaggacataacagtttgtatcatcttcaataactagcttgtccaactctttcatacatccctccagatttgggtatatatatacatctttcttcactacaatacatatgggctctcgtcgttgcaactaggagcaattagcaggcgagcaacaatcaacaagacaatgggagaggtagatatataagagaatctagtttcttcaagttgtcttgcattgtgatgtgatgggagtaggaagcatcagaaaagaagtggaccgaacaagaaaaataattcgaaggttttcattacatccatagt

SEQ ID NO: 12124 - DNA, 435 bp, Oryza sativa
cacatgctagccgactgggattatccattatctcgtgaggtcaatataataggaccgcacgggataactaattatcccgtacggtctacttaacacgaccgcacgggataatcaattatcacgtgcggtccgcccgtccgaacgcaaaaatatggattttcgtagatacctgggtgtagacgggcaggtcctctgcacggaaaaaatgtattttgaccgcacggaaaagtctattatgtactagtgtaagtggcttggtctctaaacaaacaatacagagtacagatcatcaatataactattgtgaattaaaataacataatcatctgtataggcttcacctataaataggcgtgtctcactctccaatcgtatgcacaaccacagccctcttcctttagttgatcctcgagtaaatctgattggaaaacaagc

SEQ ID NO: 12125 - DNA, 1166 bp, Oryza sativa
ggggaagggggcggaaggaagggagagaagggcacgacggagaagaggagacgtgcgcaattgtggacaaggaggagacgcgtaggattgtggataaggaaaagacgcacgcgagtagatataggcggccggctcggtttggtataggtgctggttttttaaaagaaccggtacctataatataatatagatgtcggtgttttatttaacggcacctataatatattatatatatgtgtcagttcttttaaaaaaaccggcacatatagtattggtactggttttaactaatgaaccgacacctataaaggtatttgttctttttttttcaacgtgcggaggtggaaaaaagtctataggtgccggttttaaatgaactagcacctataaggccagtccctatgagggtttttttagcagtgtttctattatgtccactatatttagttccaaggtgacttgattatatagtacatacaatttcaagtcacataaaagtttcaaaactttatggtcactgtttttacctcttcacatgggtgattaaggaatgctacaaaaagtctatatgtagaaagcataattaacatgtaattaccaccaccatctatgaacatagcggggtctatgcctagatgaacttaatgcatcgaggcattatatatttcctctcccctttatatatatagcacctcacttcgagtaccccagttcactatgcatcaaaaacatttcacatcttatgaatagatataataggaaactatagtaagtggaaagtaaggatggtggaataaaagcaggagataggaaattgatagagatcaagctcagtgtatgtctcagtttgatatgactagggggcatctgggaaaatttggccatccaagcttatagcttcagttgcttgctttgttcatgcagtggacgacacgatatttccagaattggcattcaaggtgtacatacttatgtttttctaagaatttgtgcaatgaaagatgtccggctagctgcatgttaagttcataagaccacaagatcaggacgaggcttggttatgagaaggcttttgattccttgttgatgatggtgtgatggctagtctagaacgaaacaaatgtgttaaaaaaaagaaataggtaagcggggaataatcttattta

SEQ ID NO: 12126 - DNA, 1501 bp, Oryza sativa
ctcgatggcttatcctatcggagcaattatgttgttttggatgttttagaccttttaccatgaccatatgctatcatatgtcttagttaatctagtattagtatctcgatttagccctatcggctggttccggctttagggttctcgctggtatcggctaaatcgccttactatattagattgattaaggaattcaccatcttgaaaagtgattaattgcttgattgtttagactttagacttctttacctactttgtgatgcatcatcccaagtcttgtttagaaccctaaaaactaacctggaattaatcataattagggatagtatcggagtttcagccgatcttaccagatatgcatatttctttatttgtttcatgtatattcgccatctatatagacagatcgcttcataggaatatatcaagtctaggtcatatcggctgaattggtctctacttgatcatatattgctatagattgatttggctatataggtttgtactagagtattagctggtacgctatctttatttatctttcttctactctaaatactgttccatcagctattttcataataatgtcttaaatttcattatcaaacttaataagcagtattatagccgatgaggcatgtttagggtcttttattctttgatctatccaatctatagctgatttggtctaactccatcggctgagaccaccgacgatacgctgtcggcctatcggccgattagctatcggctaactctgcttctgtaagcatttttagtattcttcacattcatatagatattatgaatctagacatatatatgtatagattcattaacatcgatatgaatgtgagcaatgctagaaagtcatataacacgaaacgcatggagtattaagtaacattaggtgctagtagcattttcactgccgattatgcacccggagattctaaagcgggcagcaaatagagtgttgtaacctgctctgcctattgtgtagtagcccattacgtggtagcagagtaattgaattattttttctgctaaatttttaacaaacatctatctaactatagcgggcaagtaatacatgctggtaaggcagaagatatggctttaatataccagtacgttcacctcatgggcagctcaaatatttcagaaatcggaacttgcagtctacagaagacagtgcacactcgatccacatgggcagctagtacgtaccacagctaatgcaaacaaagaatatatatggagcacaataaatatagttattaatgatccaattagttaaataatcactgaatcatgcagtgtagcttgctcgtgagatgcttggctgcgcctataaataggcgcctcactcccaacatctgcataaaagagagcaacaaattagcagtagcctttgaacccattttgatttagcttgttgatcctcgagtaaatctcaatgaaaaccagataggaaacatggaaggtgtgaagagtttga

SEQ ID NO: 12127 - DNA, 1501 bp, Oryza sativa
tataataatccagaacgagattaattaaaattcggaataaaaataaaaataaatccaaaattagcaaaagaaaataaaagaagagttcaagtaggaatataatttaaaattagctggaattaggaattaaaaataagcaatattaaaagaagaatccatataagaacccaatacgagattaattaaaatttagaataaaaaataaaataataaccaaaattagaaaaaataaaagagagttcaagtaggaatacaattaaaataaaatccaaaattagaaaaggaaaggagagtccaagtaggaatacaatttaaaaatagctgaaattcgaaattaaaaataaggaatattaaagagaagagtccatataagaacccaatacgaaattaattaaaattcggaataaaaataaaataaaatccaaaattagaaaaggaaaggagagtccacgtaggaatataatttaaaaatacctgaaattcggaattaaaaataaggaatattaaagagaagagtccatataagaacccaatatgagattaattaaaattcgaattaaaataaaataaatccaaagttagcaaaagaaaataaaagaagagttaaagtaggaatacaattgaaaattagataaaattcggaataaaaaataagcaatattgaaagaagaatccatataagaacccaatacaagaataattaaaatttcgaattaaaaaaataaaataatatccaaaattagaaaaattaaaagagaatttaagtaggaatacaattttcaaacaactgaaattgaaaataaaaataaaaacattaaaggaacacaatacggtattaactatttttttaaaaaaaaataaattctgaaattagaaaaagaaaaataagatttcaattagaaatacaatttataaataactaaaatttgtgataaaaataaagactattgaaagaaaagaccatctacaacacatgacgagataaattaagtaacagcctagaaaggagtagagtggtggcggttgatacgacatataaaaattattaataaaacaccaaatataatcctaatgacgattaaaaggagggacatcagacaggccgtgaagcaaacaagtaaggcggttgccgggacttctagaaagtataaaaaataaaccccattgataatcatattcgatttttaaaatgttaatgacaataaaaaggagaagcagcgggcggggtgtataagagtatagttgctgagccgccgacgattgacgggacttctagaaaataaaaaatgaattccaacgatagttatgtttgatttttagaatcacaacgacaataaagagtaggcggcggacgggctgtaaaggggcatagtggcatcgtttgatgggacttctaaaaattataaaaataataaaactacaagtctaattttttaaggttcggaacttccaaaaagtaaaaaagaaacaatgataatcatgttctattttaaaatctcaa

SEQ ID NO: 12128 - DNA, 1501 bp, Oryza sativa
ataaaagaacaaatgggactagccaggtacgtagttctacgacgtataataacggcagtggaaaaaaagcaagcagacatgcgcatgcatttcgattgctcattcaacgttcagagaagcattcatcactagggagaaaatctaacgagagtcgaaatgtgttgtctttcgcacgcatcgtgcgagacttgattgatacgcatttgtactgatccatcgatccaggcatgatatcggtgagaaattttgtagacagaatcaatcacagagctgatatcaacgtcgtcgtctccgccgcgagctgtttcattggcattcttgacacgcaaattggtgccaatagaatattgttggaagatcttgtgccgtctttcgttgaaaaagcagatccaatcgaaagcttttgaaattttgggttcttcctcttccaacttgcaaataatgtcggtctccatatagcttagctaggtggtactaattaattgtattatcttgattaatacgcctatataaaaacacatgtaatatttcaactttcagatagctacggaccagaagatccagaaatggaatcatgcatagagttagccctataactttgttgtattaattatctccatattttaatagatgatgccgtttgttttaaaataatatttaatcattagttttattttataaaatagtgtaatgtatccatggtatctacttaaaaaacggagggggggggggtgttattagtttgtttttatatttacaattgtaatgtaccgcctacagcgactggtctgcatgcgtaaataatagagcgtgtcattgctttacgtcattatcaggtgcccataatctgactgcatattggtgaaagctcattcaaagttttttctgccttttgaagtcgatggctacacgacggaggtatctgatggacatatctatgacttcggggctctcgcggcatcggatctgaacgatctcatgatttacaagtaataaatggtaaattaagataatgaaaatggcatctcatgattttatttgacaacgattctcttatgccgttggaccaggccgtgcgtgtgttactgcattgtacgaatgaataaagtccattctacatccctcatgttttcgacaagttcaaatcgttccctgcactgcaatatattggatatcttaaccatccaaaactagcaacaccagattaaattaggtcccatggcggtatgagtggtcggtttggttgacgtgacgaattgattacaatcaacccgactaagacaacaagggatccacgtgggcccacatgtcaggcttctatattcttcctctaatctccctctctcctctcttctccacatgaccacatctctggtctttccacctgtcccttctcttcctcctagcggtggccagcggggaaggagcaagtggaggtaggggtgtaagtgggtcagccgcgaacccacttataggtcaaataagcaggttcgcggtttaa

SEQ ID NO: 12129 - DNA, 1501 bp, Oryza sativa
atattgaaagaagaatccatataagaacccaatacaagaataattaaaatttcgaattaaaaaaataaaataatatccaaaattagaaaaattaaaagagaatttaagtaggaatacaattttcaaacaactgaaattgaaaataaaaataaaaacattaaaggaacacaatacggtattaactattttttttaaaaaaaataaattctgaaattagaaaaagaaaaataagatttcaattagaaatacaatttataaataactaaaatttgtgataaaaataaagactattgaaagaaaagaccatctacaacacatgacgagataaattaagtaacagcctagaaaggagtagagtggtggcggttgatacgacatataaaaattattaataaaacaccaaatataatcctaatgacgattaaaaggagggacatcagacaggccgtgaagcaaacaagtaaggcggttgccgggacttctagaaagtataaaaaataaaccccattgataatcatattcgatttttaaaatgttaatgacaataaaaaggagaagcagcgggcggggtgtataagagtatagttgctgagccgccgacgattgacgggacttctagaaaataaaaaatgaattccaacgatagttatgtttgatttttagaatcacaacgacaataaagagtaggcggcggacgggctgtaaaggggcatagtggcatcgtttgatgggacttctaaaaattataaaaataataaaactacaagtctaattttttaaggttcggaacttccaaaaagtaaaaaagaaacaatgataatcatgttctattttaaaatctcaatgacaataaagaacggaggctgcgggtgagctgtagaggagtacaatggcaaagccgctgacggtttggcgggacttctagaaagtaaaaataaacccaaatgataattatctttgatttttaaaatttcaatgacaataaaaagaagaaacagtggacgggcggtagaggagtataatgacaacgtttgacgagacatctacaaattataaaaacgaaacccaatgtgacaataaactctaaaaactataaaattcaatttttaaaggttccaagaagaataaatagaaatagtggtagatcgagcaaacaaataaagaagaagatgacataaggggtagcaactgatgtgacttttaaaaactatataattagaaacacgaggatgataaggtttggtctttcaaagtcttaagacaatgagatagctatttaataaattttaagtaaaatcatattaaaaaatatatgattttatttggatgctagccgcgcaattgcgcgggccacccagctagttttattaaaagaataagattaacatattacatcccatagtactgagtctactgctactgacttgagccgaagacctataaaatgtatgggtacacaacagtttagcctcgtccgacaaccaacgcaagcgaaaacagc

SEQ ID NO: 12130 - DNA, 1501 bp, Oryza sativa
tgttctgcccctttgctgctcaaatctgggaggaaatcaagggtaagtgcgctgtcaaactaggaagaaatgggttctcaaccatgaggcaatggatctttgatttcctgaaacggggatccagccatgcaaacacccttttggctgtcaccttttggcacatctgggaagcaaggaacaatacaaagaacaacaatggcacagtgcacccccaacgtgttgtcatcaaaattttgtcttatgtcgacatgattctaaagcacaatacgaagacggtggatggccagcggggtggaaacactcaagccatacctagatggcagccaccgccggccagcgtatggatgatcaattctgatgctgcgattttcagctcgtccaggaccatgggggtcggggctttgattcgtgataatacagggaaatgcctggttgcttgctcggagatgatcagcgatgtggtgctacctgagcttgcagaagcgctggcaattaggcgggcactgggtctagcaaaggaagagggcctggaacacattgtcatggcatctgattgtctcactgtaatcagacgcatccaaacttcaggaagggatcgctcaggggtgggatgcgtgattgaagatatcaagaagttggcgtccacctttgttttatgctcttttatgcatgttaaccggttgtccaatttggcggctcattctctagctcggaatgccgagctgtctacctgtactgtgtaccgttctgtaataccggattatatccgggacatactttgtgatgatgttgcttaatcaatgaatggcatgccgcctttgtctcaaaaaaaaaaacaagcttgtgacttgtgagttgtgaggcttgtctttccgaggagagttgtacagtagtcggtcagtggtagactggcagtaggagtagtagtggtgcaggtgcagggccatgatgatactccactgtacatgtctgcatcgataccctgcgccgggcggccaatgattgcagctgggtgcagcgatagattattggagaggggggcgtccttgtcctgacgacacatgcccttgccttgcgtcatctcgcgtatggctcagaaagcctgcagaacatgtcagagctaggagtagctagctgctggcgtaccagtgctcgtatggtatggatcgtttttctaaaaaaattctgaaaagctacgccagttgcgagccttttggttaaggaaaaactgttataaaacatgtgccgacgtctgcgcaggagtaaaataaaacagtgcagcgtgtgatcatcagtactgagtactggtagtacatagaggtaatgtaggattaataaggatttgcatcgctcatgggctcgtttgctccgagattaacctgctggtgaaatggcacctcgacacacatcaacccctcccctctcatcagtcatcataaaccagcaaagaaaagcactctcaggagcatcgaatcagatcgatcggaggagtactacaact

SEQ ID NO: 12131 - DNA, 1501 bp, Oryza sativa
cggcggctacctcatccccaagggcgcgacggtgaacttcatggtggccgagatcgggagggacgagcgggagtgggcgaagccaatggagttcatcccggagcggttcctccccggcggcgacggcgagggggtggacgtgacgggcagcaaggggatccgcatgatgccgttcggcgtcgggcggaggatctgcgcggggctcagcttcgccatgcaccacctggagtacttcgtggccaacatggtgagggagttcgagtggaaggaggtggccggcgacgaggtggagttcgccgagaagcgggagttcaccaccgtcatggccaagccgctccgcgcgcgcctcgtgcccaggaggacgacctagaataataatgctacgtatatgccgttacgtacggatgcatgcacgtacgtcgctggacactatcttaatcgtgtcgaacagtcgaagcgctcatactttttttttttttgcttcttagccatggtgatgctggcatcgtgaattccgctacgttcgtatgtactactcatgcataaacccctttgttttggttatcgaataaaatcagacaagctgctgctgtagcttgatcgcaagttcgcaactccactgttcgttcgtcgctggagtctggacgaggaaaacattaggccagaaatttgcggcccaaaacatagtgaaagcccagacgagcaaaacggtctgcaaatccgggcaggcggcccaaacgcggtcggcgagaattcgtcccgtttcgaaggccgcgcgcgcctccatccgcctcgatcccgcgatccggcccgacaaactttcacgatttcagcccaggcccgaccaaacgcgtggtcacaactcaaaagccgtgcactcccctcgattcgatcgacgggtgcgccgcatgtgtgtggcacgtgaacaatctcttgggcaacgctagtatttctactagtagtacagtgcccctacgtcaaaaaagttgtgcattgtcacaataacgccaacagtgagatctatgttgaccgtgacacgccaagagtactcgtacgcacgatagtgcatatgatacgtacgagtattgtactatgcctgttggaaagattagcccagggctaattttaagagccaatgtttagtcataaattggtaggctaaatattagtctagggtggcatgtttggatccatgagttaattcaaggctaaaaggtggagagagagagagtagaaagagaggggagagaaggagagagagagctggtttttatagtcctcacacaaaattagctccattagcatctcttggaggggctaatgttttgaggggggctaattcattttagatcaaaattagcccacatgtttaaattcttacattagcccatgaaaccaaacaagaccctagtcgtattgtatacggtgctaagacctaaagagatgtttgggagagagggaccctctctaaaaaaatataagtccctgcccatggaaccaa

SEQ ID NO: 12132 - DNA, 1501 bp, Oryza sativa
attacagttagttattagctgccatttgatttgaagcgtgcacgtatataaatagctgcatctttgttgatggagtttgtttaattagaggcgcggctgcaacccgacgacgggcacacgacgggcgctggtgacatgccgtttccggcgcgtgtgggagagggagagggagagggagaggaattaaccgctcacatgtagagttcacgtgggttccactcaccatgtaagtcaaaaccggtaactatactatcgaaggatcaaagttaaattaacacgatactgtaagttgaggaatgaactatacatgtatttcggttcagggatgaatttcagactcaacgacaaattgaaggacctaaaatgaacttatttatatttgtcttggctttggtttgggttggacaaactacagagtcgtgagaaacagcccaatcctcaagtccataacaagagagagtggattttaaacttatttctatttgtcttggctatggtttgatgtttgtttcaaacatgaacaaaattaaaaaataataataaaaattactaacatgtgatatatcactctacaaacatgcaagttaaaacttaacttctacaagttgcaaaaaaattaattaaactaccattacttaatgtatattcacattcaaatttattttttttacaacatgtagaacttaaattttatattgtatgtttgtgagatgatctatcccatattaatctatcttgttaaacttttttaaaaaaatttataactatttaagtgacatgtaaataatgatagtacatctcctcgagaatttagaattgttttcccataacgacgattcagccatgcaaactttgcaccgtgtgtgtagcagcgtaggggtgataatgtgcttaactttttaccgtagaaaattccagtgctgaatctatagcaggttaaattttgatatcttgttaccaaaaaataaaggaaaaaatacaaattacacccctaaacaattgtgacggtatgaattatcccccttaactataaaaccgtgcatttgtcacctcaaactatagaaactggacaaattacccctttgacttaatccggaggggttttgctcctatgtggcagacacgtggcgccaacgtggcaatataatcagaaaaaaagtaataaaaaactatgggcccacttgtcatatagtactcctattcaacccatctctctcttttctctctctaacactggagacgcggcgggcgtggctgggagggcgggcggcggccggagggcactgcgacggtgttgccgggagagatggagctgcgcctccgccggcgaacggcaacgcggaaggccgccaccgccgtttctccctttcccctctactttcctgcaatgcagtgacggtggtggtctgggcggggaaggccgtggcggggagggccaccaccttcgcgcggagcgctctctgctactgggagcagtagccgtcgtggcggtgaggaagaa

SEQ ID NO: 12133 - DNA, 1501 bp, Oryza sativa
tataaccttgattgatagtatatttgtcttgtgttggaaatgttattgtgtttctttataaatttgatcaaacctaaaaactttgactaaagccgtgtttagttccaaaataattcttcaaactttcaacttttccatcacatcaaaactttcctacacacacaaattttcaacttttccgtcacatcgttccaatttcaaccaaacttttaattttggtgtgaactaaacacagcctaagaaaaaaaaacttatattatgaaattgagggagtatgtgccagtgtgttgcaacgggaacaagagataaaaaaacttgtaatttagtttcttttatatcggatttggaaataaaaatgaaattcggttttgtttatgctggtttttcacgggcttttctggagctgtttttctagggaaagagtagaacgactgtgcttttaaagtagttaagaaatgaagtcaggctgtttgaaccaataagcggtagaaacacggaaaaattagcataaaattatttataggtaaatattgtatatttatattgttctcagtttaaaagtcactgctgggaaataaatttcaatgagaagtccccaaattcaactgtaaaattgcgttttagattttatttatttatttttatagtcgcacatttttttagtttgctaatacatggaaatcgtcaaatgaattgggcaagtctgatggaatgcaggggaaatataatcagattagagtaggtagcagattatcaaatgtttgcaagttctttcgattttggcccgaaggtaaccagtacgtactagaggagtacaaatgtagaatacggttgtttgacttggagatacttcagcattatggagtagaatactgctcctactatagctggtcagagggcagcgaagactgagttgtcagtgagaaaagggaagcgaatatatgcgttcagttcagactttcagagacgctctttgaaatcctgggcgccatgatccaatcaattattagcactcttcggtacagcggaataaagttgtgttttaagttcataatgctgtatttattcttgatcatggactatacttaccagatttattgtttagtacatctaaactcttattactgaaccctgctgtcaatagtagtagcagtacagaatcaagttgaacatagaatatatacatagtctcttggaattcaaactctggtcgaaatctaaatcaatcatcaacaatatgaacagaaacaggaggcactcggtgaactttacacgaacaaacgaaagaataaaaaccaaaatctctttggaatcgtaaaatggacgatccattttcataatcacctcaccctcccaaatcgctgccattttttttttgcaccacaatgtgatcgaaattcctccattagcacacacaaaccccaccttttgatgctccaaatcttttccaaatcataccactactactttttttctcctttttttgattcttttttttttg

SEQ ID NO: 12134 - DNA, 1501 bp, Oryza sativa
atctaggctctctttctctcccgtttttccacactgttcagagtttacaaactccttgaagaaatgaagaccttaactcctacctgtagtgcatgccgctatgtattatgtgtatatatgtacaatgcagtcagattctacatgtattatatatttgcatcattacatctgcatgtctcctgtcagtgactcagtgataaaacacgtacacgtacacataatgcagagagatggagccttgtcagtgagagatcttcatatgctcgttgctagctagctgtgtactccaagcaaaatacatgaaaaaaatgaataattcatggccctagggcaagcaaggcaacacacaacacacgagagcaggcacaccaaattccaaatcttgggccgcgcatttaactcaaccactcccccagtgactgccccccgaccctctcgtcatttctagggtttcatggcgtctcgtgctctctcatccgtcgatcgaggccgcgatggacggctaggattgcatcccgggtctctccacggcggcgaccacagctgtaggtccaacccctctgccgccgtgttctttgtcaccattcattccgctctttatggttttttaatgccgtctcttttttccatgtggtcttgcctgttgcgatggccctgtatatttcccacacaaaaattttacaccatgtcatttcaaatgtttaaaatccgcataaagtatttaatgtaggctaaaaaataactaattgcacagactgcgattaatttgtgagacgaatcttttaagcctaattgttccatgatttgacaatatggtgctacaataaacatttactaataacggattaattaggcttaataaattcgtctcgcggtttactaacagattttgtaattagtttttttttgttagtgcccaagtaccccatgcaacaccccatataatacccaatatgacacgtcaaaattttacacccctaatctaaacaccccccatgtaaatgtatagctgtccatgccccagccactgacaggtgggctccacgggtgctacagctgcatcatggtccacttgtcagtgactatgcaggtgcatggctcgtttcaatagatgcactggggatgcatggtcgtcagagtattttcttttgaataatttgggtgacttcaaaaaaaaattatttatggtgatgtgtgcagctgtaatcatttcacatatcatgaccactccatggaccatgtcactggcccttgctccttgtgtctatacatacccgtgctctttgcccatagcttcttgcaagggaagaatatcagaggatgagaactagatagatagagagagagaggaggggaaaggaaaatagatagtatgaagctatttgcttctgagtggaatgttgtctggttcaaggtctcatgcaccttgcggttttgaggatgatttgtgcaaggtttttcattcctctcatccgtgggatctcggaccaggcttcattcc

SEQ ID NO: 12135 - DNA, 1501 bp, Oryza sativa
taaagttgaggatttaaatggggcaaatccgcaaatgcacatgtaccttttccagatcaattaccttaagctatatgccatatcctttctgtagtatatccttgctgttctcgtgtaagtcgaatttctaacgtgtttttccttttcaattgacttccctgatttagtcacggttcaatccagtcttgctgctcattattctacgaatctcccgtatgtacttatggtacactgtttgctgctaaattaacatatgaactgctatgctgtatctgtttgctgctaaaataacatctggacttatatgctgtgtggaagtgattcatcttccttatcaaaaaggaaaataaaatgtgtatgtctgtgatgtgctctccacggtcggcaagcagatatttaacctcctagttctgttcgttgttattttcagtacatgatgtttcctgagtatcaacaatatttttcctcttattttttcccctgaggtgggactatcaaccatattttacccgttgctaatggctcaagtggttggtggttacttgtcaagggcacaaaacatggtacttgactactcctaattctcaagtaacaggtttgttcagatactgcatcgctgcttttctgtttactctgcaaattgcgatcctcttattacaacttgtgtagcaactcttgtgctgtgcaaaggcaacactacgtactgcgctagtacatggtccaatcagggcccaagcccttgaggcccatcttagcccatgtggtttgagctttgccatgtgctccctgagacagtaattagagttaagttagcaccctagtgggcctttttcttaattgtccatgagctttggcatccattatcgaaatgatatgaacataagaggatttgaataggtgggaaggaggttaaacatcttcccactacttgatcattggccctattctttccttggtgcatttgtaaagtccaaatataaattttgatgtactaacaactatgctttccaactgtcaactgttaggcgctgactttttgtagtttaagactggagatcagattcggcgtatggtcgcatggtctcgtgggacatttcatatcctcgcaaagctagcttaaatgttccatcatggggtcatctgtcaacgcattttgcatgttgattttgatatttcatatcttcgcaaagcttatcggacgtagctaaaatttaaattttaaaacttaaatttaaaattgattttgatgctttttatcgtagtttattttcaacattagcttttaagtcgctaaaatatatatatgtagaagttatatataaaattagtttatatttgctaatcagcgttacgccttataataagtggtatgtgaaaggcaaaactatcacactgggactgaggtgctctcctctaatatcaactctgttaagtttcgaattccgtgaaccaaaattcttttgtcagcttccaccaaaaaatgtcctcttatttcttctct

SEQ ID NO: 12136 - DNA, 1501 bp, Oryza sativa
catcgcctcattggtgtagttacgtaccctttgcatgtttctagttacacactcagtaatccgtttttaacgaaaaggccggatttcacacccaatcgattgaactatttttattaatgccacacaatgtctgaaaatgacacccattgattgtgttgttagtagcactgtggactaaaataagatataaacagtcatgtcccgtgagtacgtaccatccgcttaattgccgtgaatagtggttaaatgtatacaaaactctatcatgtttgcacaggatatgattaatcaaccaaccacattttcttgttaggttatataggggcatgtcattgactaattaagatgtgttaaagtaatcaccaaaacagcatttgatatagtaggtgtggcggtatattaatcctttttgtcttcattaaaatttgatggattttatacaaaaccaaatttgacaactagataggtagaacatacatgtacatgcttgcatgtcggtgcaaacaaaaaaaaacaaacaaacaaaggcgtgcagatgaggaggtatcatccatcctagggtgacaaaccggtaaagagaaaaagggcatccttcctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaagagaggaaaaaaaaaacctgtaaagttgcggcgattccagggaccttttccagtgcagcacggctgaaacaaataaaaagataggaaaataattaaaaaaaagggttccctccaacgtcgggatgagctctgtgtgtcgtgttctgtggtgtcagtgtcgcacaaagctgcaatgctaacttagttatatatgcatgcatggctgctgtgtgcaccaagaatttaccaaaagaagcctcaccaacgtgtatttcaaattaccctttaaaggccctgccgcagggatacctgggactttttaatatcccaaatgtttaaaaaaaactctaattaactactttattatgtaaaaaaaatatcaaagttaaagctgattgcaatagttcaactggaacatatacctagctattgtgataaaaaaattctagagtagattatattacaacatgttgtatataaatttgcgaattaattaggaaaacaaagcacctgatggattacctgaacaattctttttagccaggggtgtgaccatttctttaagaaaattaaataatgtgagctctgtcaaccaatgaaagggtttaataaggcaaaccttgtctggcatgactaatcaaaccagttaaacagggagatgcgtccaaatggccccttgctatatatgtgaacca

SEQ ID NO: 12137 - DNA, 1501 bp, Oryza sativa
gtagccgagttaggaggaggagctcaccgccgtgccgagagtgggtgcacgcacgccgcgccccgccggccggcttgttcggccggccgccgctccgcgcgacgcggcacggcgaaggcgctcgcctcgctccgtccgtccccacgagcagaggcttcagcgggccgtgtgcttcgtcacgggcccaacagcaagaagctcagctggagaagcagcccgtgtagatgggcccgtccggttaccgttgattggcctcagtggtgaaggagcccgtgtagatggatcttcggcgtgggggaaaaaggccgaaatgtcacgggaaccaactacgggaggccgtgggccgcatccattaggataagcgggctagatctatccatgcgactagcgggcatcaattcgctgcggaaaatgtctaatttttcttaggttggatctaattcgtcttttaaccataaaatcagatataataacccctctaactattaagagagttgaaaaagatttctaagatagtattgcgggaagaggagagagatatggggaggagggaggaaggagaaaggaaggagggtaagcgagaatgacatgtgagttccacttgatatcctaacatccttgttggcttggtgtttttgaccgtggttaatttgccacgttagctaatgccattctaaatactccctccgtatctaaatataagagattttagtcggatataatatatcctggtataatgattcgttatattaggatgtgttattttcaaccaatatcccttatatttatagagacagatggagtagtgtcttataagtttttttttccggttttaacggttagtagagttgttgtatccagcagctttacgatcgagaaatacggcctatatttaagggagttacaatagacattttccattcggcaagtcagaggttgacacgacgacgacgcgagtcacacgacgcgacagccttcaccgacgcacatggccgtccagctcgggcgcatcacggggcacgccgcacgcggcccactccgtaccggccgcgccatggattccacgcggtggccgcactccgtcccgtgcgggcgtgcggcccatgctgccatggcatccaatccgatgcaatccaaccgacatctccgcggccgcatcgcccgctcccgtcaccgacgcaacccacggtccaaagtccacagacttcaccgccgctgttaccgcgatcccgggctcctccccacagctgtcgtcgcgtcaacccattatccttcaccgccacactcgctgacaggtgggtccacgtcgccgacccgcaccacatggcccacgaggcagtcaccctacgatgtgtggcagtgaccctatgcaggcggtgccttatatttagcgcacaggaaacccatgagaaatccaaggtcatcaccaccttcttcctcctcttcatttgccatctttagtaccacctcgccttcccaatccaatctcgccgcccattaa

SEQ ID NO: 12138 - DNA, 1501 bp, Oryza sativa
aaccctctattcaaattcgttgtattaggagaaaaagttatattttcttttaagttattttttgttttgggaccgagggagtagagctagagctacgaagggcagcaaggtgaacgagcgcgcgccctgcaacctccacgttctcccataatttaaacaggaggcatcaatcccacagctccattctttttaaccttttatggcagacacatcaccccacacttcaaccgtttttatacggatccccagccacagccaagccagcctgaccccaaaactaattttgtatgcttgccaaaggatcagccatactcactatagctaggcaaccccccccccccccctgctggctctaactccgaggcatccaagcctaaaactacagtggtagggtatctcacgtactaggagcacaattttaattacaggactagtgctactgggagtagtatacagtagcatagtgtgtataaaagtgtggtttaagtagcaagaatttgtgcaagtgataattaatcaagtgtcactttgtagcacatgctctcttagctagcactcgaagttgtcatgatagggcgatctacacaagatccttctactagttgattttgtgctggcaatttaagttgatcaagatcataccgaattttatcttttgatctacctaaatttttgcaggcattttttttatttacatgcatgcatgcatatgacaacataccgtgacatctagcttggatgctacctagttattttaatgagtttacctcggttataatttgataattacttgctttaaattttataccctatatatcaagccttccttgtgctatactaatctttggcatgtgagggctatctccccatgcttatactaatcgtggcatagcaatttatattaatatttgaaagatcgagatcgatccttatgggatctaaaactaaaaagtttacaataaattaagcattggatcctagagtataaccagagctgcacatgtaatttaaatcgttgcatctgcctctaatccttcttttctctaaaaataaataaagtagacaaagagcatcacacttatttagaaagaatgctggtataagaatagcaagaatgtaacatataatatgtcgcgagtatacactgtaaaacttcggtaacaacagtttgggaaaggaagaaaaaaaaactcaggtaatacataatggacagtttaggtaattagaaaaaacaaaacaaaacatataaaagaaggagagaaaagagaaaaaaaagagaaatgggaaaaattccggcatacaccagcaccagctctcttgctttttcactgccacttcacttgatgagcacatctttaatttttcaccttcgatttttttttcaccgcgcccttgcaacatgccacagtagatcgagcagtagtacacatagccaaacaaatttttaccgaggtgtaataatttgtaacaaccacaaccaccgcaacattttgcatatata

SEQ ID NO: 12139 - DNA, 1501 bp, Oryza sativa
ttggcgatggcactcggtgaccggagttggagaagatgacggcgatctccctcgtctgtgcatgattcttaaaatttcttgagggattttggccatgatggtgaggcgatgactttggcacgatggcttggcttgagatggaccatgtcggttggaacagcgacgacttcatggcggcgacgcctggtgcgagttccggagctctcgtgggcaaggtcgcgtttccgttgctgcagtggataaaacgagatggggtcaaaaggagatttgctcggcatgatgtgggaagtttggaacgggaaagatttggcgatggagacaactcgtcggcaacagcgagcgtcatcttcttcgcgatcgacgacgagaatgtgggcgacggagaggcatagggctctctctcgtccgagtagttcggctccagaagaatgtagaagagaaggcgacacgtatgaggaataaaagggaggagctcagcgttgccacgtcccggccacgcgtgacgcgtcgagcaccgccggtgtctctctttcctgctctcgctctctctctctctcggctcccagggcggtggagatgatgcacagagctgacatgtgggtccccactgacccgtagacgctaccgtggatgccacgttagcggatggagcggatcggagcctgtttggacctatatgataccgaagacaagttcgaggactcaaaaatacattttaagagtttaaggacctagatgacacacccgcacaagtttagagaccgctggtgcacttcactcctatacttatatatgtccgatcgaattcccaatccaagacaattttgagtcgtgctgatctgcatggcttcataaatgaatccccgatgtgcacaaatcacaaatggttaccgtacgtaagatggtaaccttagctagctctccaatttcgtggcgtgcacatgtctaactctaggttctagctatatgtcactctttttcgagccgcgctcgggtggttacttggattgtatttagttcccttcgaacttttaaaaatttcgtcatattaaatatttaaatatatgtataaagcattaaatatagaaaaaaaccaattacacagtttgcatgtaaattgcgagacgaatctttttagcctaattataccataatttgataatatggtgctacagtaaatatttgctaatgatggattaattaggcttaatagatttgtcccgcaatttataggcgaaatctgtaatttgttttgttattagtatacatttaatacttcgaatgtgtgtccgtatacttaaaaaaaattattatgaaaggaactaaacacggccttggtcgcttatctaccatgaccaacttgttatattctcattaataaacaacagctgatgtgatgcatccaacagtaagtagatcagaacctgatcttttgcttgctcatctcccccaacatataggtgtagtcaaagctaaattaatcaacaattaattaaaccgg

SEQ ID NO: 12140 - DNA, 1501 bp, Oryza sativa
tttgatgaaataaatttactattataaatattactatatttgtctataaacttagttaaactttgattttgaccaaagtcaaaatgtcttataaccggaaacggagggaatagtattttaataatgtaagcgtaatgcttagattattaagtatcattatttcggcatatatgctgcgggacagtagaggtgggccgctgatggtgacagttccgtatgagtatttctccacgttagtatatattcctttgacactttcctagggtgggtactcctccgtatttgatctcagttggatggccatgatgggctgtagtaaggaactcgacaatcaggaatggtctctcgaaacatcagaagggcactgttaggggtattggttacatgactgtatactagcaagtgtaaactaaagataagtgtatattagaagtataggaatgatttcttttcttattcttcttccacacagcctagatttatttagtgagataatctgggttcttcttactttgtgtcactctacccagtataaatgaattaaccactgcttagactttgatgtatataagtaatatataaattattagtatagttctctcttataaatattcccttgggattaaataaatacaataccttggaatactttcgggtgaaatgctataatggtacatccatgcgcttgcgaattatttttgtaactataaatataccaggactatttctgcgccattgctgggaatttatatttccagtaatgtcgttaagaaataccaaccgttggaccgacagcttgtagccggtctgaccggtccaacggggggggggggggggggtggaccaaaggcgatcaagaaattcaacggtaccacaagagcttccattttgatcaaatacattaacaagggacattatattgctcctgtaacagagccaaagtaaaggtgaatgcctgcaaacttgaccgctactcgaaagagaaggttgcaatgtctttgtgctcaaaagttgaaagagaagaaagccgaagaattgagagatagaaggttcaacgagttgcggccgccgccaagacaagagtggaggcctaaaccaattgaagttgagaagccggtgattactcaagatgaagatgaggacaacttggatacaagtgattcaccggttattacgacgtcgggttctcctctcgccgcgcttctcctccgccgcagcttgtggaacagccacgagctcggcaatggcatcgtagctgctgctgctgcagtgaggcagtgtggtcgtggactgtgggggtgagctaagctgcagtgcgtgcagcgaggttgcaccccactttttattacggaaaagtttgccgcgagtggcagcaaagagatgttgcggtggaaaagcggcagcggcatcttgcaagaatctgacatactatacaaattctctcttatatttgtgcttctgaatcataatcaatactatgatttgccgccaagggagagca

SEQ ID NO: 12141 - DNA, 1501 bp, Oryza sativa
atggtttcttcctcaccatgaggaacatgctcggccacggcagtaactggtgcaaacaggcagacccaccaattcacttatagtacaaataaacaggtaacacgtcaggttaccagcttaattgtagtacaagtgggttaacgggcctgtccgtttgcacccttagcggtaagcgatgccttcacccacctcctcattggagcttgtttgtcactgctaggcatcaggttcgcgctttctcaatcttggtcaacaacatgcgaactcgtgcagatatcacaaacacacgtcacgaaacggtctacttctgccaatcccttcgaaacgtgtatattcctataaaaccggtgataaaatggtatatttctaaacctttttttcgtttgtgaaatgaagcagttaccatacattttgcctctcgcagtaaaagctgcctgaactgtcagttcagtgtttgatcatttcatataggagaaggattcatacgcaggggcagagctatagtagaggggtgcccaggaacctgatcaagaaaacattttagctacacaccacctgtttccaccatgtgtgtatcccctaatacaaacttagacactggcatcagcttaaactcgacctaaagtaaagtaaattaaacaagtggcacccttcttcatttcgttctatatccgctcctgtttatacggagtcggagtcacagaccaacgaagatcttgtcttgattctatcctggagctctatcgtattgtcatgataaaaaaaaaaaagcttcaattccggttgtgagtgtgagggagtgaattgtgtgcatgtgaaatcgccgaataaatcaattgcctgaatttcctttttcacggaatacagtacaatgtatccttgaaaatgaacttcggtgtcaagagaaatgtaaaacgaagtgacgtaacattaaattggatttcggcattgcaaaattcgatttcagcagatgataagaaggaaatatatatagttcttctgcagggagtgatagctgaagcctgacctatatctctttgactaccattgattaagttgcgaacgttccaattctttttccattttattcgacggttccacttgcaatcttcttattttgtcgcttgctctatccacgggctcttatttattcggcgcgaggggcccccttcacaccggtgcttgggagcggcaagaacagcgccgcccctccccactggcttctttcatggtggatccggtggcggcaacttttctcgcggcagatccttcaacggcggcttctcccgcggcggatcctttcaatgatgataatgttgttgttctcctttcatttttgtttttagatgttgttgttgttgttgtatcgattttatgacttgtgatctgtaatggcgatgatgctgattgttggaagttcgttggattgatttcgaagggcaaggcttagggatgacgcagggtggatgcgctcagtgaaccgatgcaacgagcctccttt

SEQ ID NO: 12142 - DNA, 1501 bp, Oryza sativa
tgcggcggaggagaagcgcggcgagaggagaacccgacgtcgtaataaccggtgaatcacttgtatccaagttgtcctcatcttcatcttgagtaatcaccggcttctcaacttcaattggtttaggcctccactcttgtcttggcggcggccgcaactcgttgaaccttctatctctcaattcttcggctttcttctctttcaacttttgagcacaaagacattgcaaccttctctttcgagtagcggtcaagtttgcaggcattcacctttactttggctctgttacaggagcaatataatgtcccttgttaatgtatttgatcaaaatggaagctcttgtggtaccgttgaatttcttgatcgcctttggtccaccccccccccccccccccgttggaccggtcagaccggctacaagctgtcggtccaacggttggtatttcttaacgacattactggaaatataaattcccagcaatggcgcagaaatagtcctggtatatttatagttacaaaaataattcgcaagcgcatggatgtaccattatagcatttcacccgaaagtattccaaggtattgtatttatttaatcccaagggaatatttataagagagaactatactaataatttatatattacttatatacatcaaagtctaagcagtggttaattcatttatactgggtagagtgacacaaagtaagaagaacccagattatctcactaaataaatctaggctgtgtggaagaagaataagaaaagaaatcattcctatacttctaatatacacttatctttagtttacacttgctagtatacagtcatgtaaccaatacccctaacagtgcccttctgatgtttcgagagaccattcctgattgtcgagttccttactacagcccatcatggccatccaactgagatcaaatacggaggagtacccaccctaggaaagtgtcaaaggaatatatactaacgtggagaaatactcatacggaactgtcaccatcagcggcccacctctactgtcccgcagcatatatgccgaaataatgatacttaataatctaagcattacgcttacattattaaaatactattccctccgtttccggttataagacattttgactttggtcaaaatcaaagtttaactaagtttatagacaaatatagtaatatttataatagtaaatttatttcatcaaatcaataattgaatatattttcataataaatttgtcttgggttgaaaatattgctactttttttctacaaacttagtcaaacttaaagcagtttaaatttgaccaaagtcaaaacgtcttataacctgaaacggagggagtactctatatcctgtagaatgacatagagtaatcattcgcacgaacattattaaacccacaccattgcacctctctagtaagctagtcacacaactatatcgggacaaatataaaataaagccggtactttgataaagtaaagtac

SEQ ID NO: 12143 - DNA, 1501 bp, Oryza sativa
ttatccggccaaccttaaaacgactggctttcccgaacagagggagtatcttcatataagattttttttttgagatttatcaaaatccacgtcatttctatacaatcgtagatgccaacgcaaatatgctggtaagtatgagacagtagttgtatacgtcaaaatcggagaagcatcaaccaatgtttcttccattaatttcagctatcaaatctcaaaaataacaataaaacggagtgtacataggtacattacattcacataatcaaattcaatccctttgtgtcaaaattgtttccgggagaaaatcaaatcctctccggccaaagctactatatatacgatcgatcgaaactcctcctcacacgacggcgacgtggtcgtagacgacgacggcctgcgcggtgtcaaactcgaagtcgaaccccgacggcgcggtggcgccgaagccgcggtcctcccatgccgccgccgccgccaccgccatggcgccggcggacgacgacgtcaccgcctcgaacctgaagccggccgccacctgcttgcctgctgcagcgccgccgtccccgcggccgccgtgatccgccgtggtctgcggcggcttgtagtacatgcgcgccgtgtgcgggcagtgggagtggaacctcgccgcgacgcgcacccccatgtccagcatctccacgtaccgcgacatctcctgatacgatttccggctcactctgatcttgaattgattttcttcttctccgagcagctgcgaggaggcaaggccgcaggggcggcggggaaagatggatttcgaaggggaatcgggcgatggctgggttatatatggttggaagatcgttcggagagcttgacatgacggaggtggtggtgtacgtgtttggcgtgtgcttcgtgcatggtgtggttgactggttgctggcttttcttggcgttggtgggggaagaagaagaagaagaaggcgagactcagtttaaacgtgcaccttgtgtctctctcggtcagcgcgacgatggaggcggttgccggttgggtagtggtggttacgcttgagattgaacgagctcagggtgtgggtgggatttgttggaggccaacacatatattagcagattatcgaatccgttcctttcaaaaaaacagtagaggtgcgagaagatgtatgtagtttcgagtcgacagtaatagagatgtgagaacatgtaaaacacccgtgcactttcctttaccctcgacaatatcacacaagcaaaaatggacagagataaagggtgtaactctctctctattagatctattgtcgttcgttgagtataagcaacctcaaaccctaccccaatataaatataggagataaatcttatttcttgcctgattcggattgaccaacaagaaatttatcttttaaaaaaaaacttttctccaagggatttgttttataataggattaactcaacaaagtcttaaaacgacacccacatattcaacaatagc

SEQ ID NO: 12144 - DNA, 1501 bp, Oryza sativa
atcatcctctcttcctctggaaaagtcccgcacggttaacttattttgggacagaggaagcacacaagattaccattccttcttggtttccgctccaaccaaaaccaagaaagcatttgaaacgaattttaccattgcagtagacaacacataaattaagagtaagtttatagtagttactagtagtagtaaatggtacagttacttaagtgcaggagacaattacaacatgcggacaacgaaggtactacctctgtttcataacctctgtttcataatgtaagactttctagcattacctgtattcatatagatgtcaataaatctaaacatatatgtgtgcttagattcattagcatatatataaatgtggacaatgctagaaagtcttacattatgaaacggaggaagtatcatttttattatgctaaagtaaaattaggacgagacacaagttctcttaaagagagagacagaaaattattcaaaggatggggagtcagcccttaaattaatcagaaaactgccgtgatggtctcctcaccgcagctagacttgtgacatctcgatttgtgcttgatcaatccaatattctcatggtcaacattggcatgggtaaactctacaccagtcaggacagaaacattctggccactcaatccatcgccaaagtcaccagtgtgaaagaaccttgcaatgcagaacttggcagaccccaggttgacaagctgagggtcccgtatctgcttccatccttggatgagtgactcatcaagttcgttccagcagtggcgtatctgtggttgcaggtactcgtccatggcagagaggtcagcaacagcaaagtggccatcgttgggagtgaagccaaaccagagcttgagctcgtggacatactcaaacttgccttggaagggtagcatccacttgcccacttcaatccaagtgtgtttcacagtgtcaaagcaataagtaccaaccccgtcgatggatatgcagatctcagagccacctttaaccaaaccatatgagatgatctttagaaagtcaacgccacatttgacgacgtatggcggcggtggtgggaggagttggcagtcccaggactttgataagtagctggaacagaacatgcggtacaccaaagcctcgaacaaatagtcagcctcctgtggtttcgcaattctatccatgataaaaagagtaccgccaccgccgccatcaaggtcatccagatctatctcagcgccggggatgtagagggcaatgggttccaacttgggcttgtggagatttggcatcaccaccagacgggatgtgtctgcctccagaaggaggccacgccccgactggtccaaagagaaagccctgcgctccaaagcagggaacatgtgtatccgttcgcctggtgctcccaagttgaagattgggctgggaagacaaatcttctccatccttttcttcaatccgtttccgttcccattcagtgtcagtgcagcag

SEQ ID NO: 12145 - DNA, 993 bp, Oryza sativa
ttgatcttaaccctcttttcattgatcaaaagctaatttattatcctatttctcatcgcctttgtttgttattcttctcttgtttgtttggcttttgtgaagccatcccttccttccgtctttaaaggcatcgctgccgggcggctgttagctgaatcgatcgcaaggaaagacaaaggaggagagttcagtcgacttgggatcgagtagaatcgccggcttctgctgctattgcggtactcttccttccttgaatgtcgtttacttctccaggtgcatagcatagcttttttttttttttttggggggggacggagaccgacgagattaattgttgtttctgttttgaagctgaccattatatccaatcccaatccaatcgacgatgggcctctctcgtcggtttctgaacctgatcgtggacaaccgcatccctggagccaaatcgctgcgctgcatcgacctcaccctcgcgcgctacaagttgttcaacactacaacacctgctgcactgacactgaatgggaacggaaacggattgaagaaaaggatggagaagatttgtcttcccagcccaatcttcaacttgggagcaccaggcgaacggatacacatgttccctgctttggagcgcagggctttctctttggaccagtcggggcgtggcctccttctggaggcagacacatcccgtctggtggtgatgccaaatctccacaagcccaagttggaacccattgccctctacatccccggcgctgagatagatctggatgaccttgatggcggcggtggcggtactctttttatcatggatagaattgcgaaaccacaggaggctgactatttgttcgaggctttggtgtaccgcatgttctgttccagctacttatcaaagtcctgggactgccaactcctcccaccaccgccgccatacgtcgtcaaatgtggcgttgactttctaaagatcatctcatatggtttggttaaagg

SEQ ID NO: 12146 - DNA, 421 bp, Oryza sativa
gtgcagtagcgagaagtctgttggcactatgtcggtaaagaatgcttcatttatatcttttgaggatattgagaaaagtatttctgactggaagattcctaaggttaatattaaggaaatatatcatgtaggtactttttcgttacttagtgactactatattaaaacaattgaaatattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaagg

SEQ ID NO: 12147 - DNA, 1501 bp, Oryza sativa
gtatctcaagataccaaaaattttactgtaaaatttagatacctcaagatactttctcatctcaaggaccgtaaaattgatcgaagctcatgttcatgatgtggagcatggaggcagtactagtagcactgccactgaagaatcaaggccacttcatattgtcattgacagcaaccctgcacctgatcaagctgtccaaaaagttggaaacgatgggtttcagggtggtgatgaaaggcctcatccaataatgcagaatggcatgcacaatggccctatgcctgaacatcatatcagatgcagatgaactcatgaacactggatgatatatacttatgtacagtacccctttgaaattgcaaaaacagagagcatttcggccttgtttgggatgcagctaggaactgatttttgcagggcctgaatagctgtatctgaattttttttgcagtccaaatagggcattaatttggtttggtatgtactagttatgtagatattttaattagtgaatgcatttattatctgaaattgctctgtaccggagcttttgttgcgccatctcatccttcactgcggcgacgtggacaacggtgcggctcgtcggggcgcggcgtgaggatggccgtggtcgtggtttcctcgccgacgccctggccgccgcttcctcgccgtctctggcgatgaaccctgctgccgccgcctcgtcctcctccttcgagtctctacccttcctctcttgtttttcccacgattcttctgacaaaagctggtttctttcgatgaggttatcggagccaaacgaggctacgcgaaccagctcaagtcatgggagccccaccccttcctctcttccacgtatgcactccgcctacgtggctctacattgccacacgcctcgtcttgcattgtaaatgatcttaggctgtgtttagatccaaagtttgaatccaaatttcagtctttttccatcacatcaacatgtcatacacacacaatttttcaatcacatcatcttcaattttaaccaaaatccaaacattggatccaactaaacacagccttagtgagacagagaactggaccgacagtgaactttgaaacttgtcagtgtcagatagattcaccaatgcagatacaagttgatatcaattcagatggttttactagggccctgtttagtaggggtgaaaacggtacggaatatttccggattccggactggttttcgaaaacggaatcagccggtcggaattttttcggaatttttcgaaaacggaatcgaaaataataatagcagttttcgacggtactcggaatcggtcggaaactttccgaaaactttctcggaatttccgacattacaaagtccataaaacctcctgtgtccaaccggccagcccaacacactagtactagcagtagtcactagcccagcccaacactgcaacacactagtaactagtgtactactccactgtctagccggccactaactagc

SEQ ID NO: 12148 - DNA, 1260 bp, Oryza sativa
gaccacggaatgaggaattttggggatagggttgaggggcattttgaccagtttgagctataaaatactccctctgtttccaaatatttggtatagttgacatttttagtatatgtttgaccattcgtcttattcaaaaatttttgtcaaatatataaaactatatgtatacgtataagtatatttaacaatgaaccaaatgatacgaaaagaattaataattacttaaattttttaataatacaaacggtcaaacatatttaaaaaaagtcaacggcgtcaaaaatttagaaactgatgaaatattttattattattattttttaagtgaaatcctaacggtgtacaccctccgtcccataaaaaaccaacttctgtagataaacctggacaagcatgtgtccaagtacatctcagaagttatctttttttttgggacggagggagtagggagatataggtcaaacggtagcttcgattttaaaaagtagggtgaaatagtcaaagttaaaaaaataagtatgaaatagtcaaaattaaaaaagtaagtcagattagtagttaagatctagaacatgatcaaataagcaattgtccctaaaatttttagctacgtatctcaatatattgtgatagaattataacgtatagttatataaataactagctgggtggcccgcgcaattgcgcggctagcacccaaacaaaatcatatatttttagtatgattttacttaaatattattaaatagataccttgttgtcttaagattttgaaagaccaaaccttatcacccccgtatttctaattaaatagtttttaaaaatcacaccagttactatcccttacttttgtcatatcttacttttgtcatatccttctttatttgtttgctcaatctatcccgggcgggggagtgatgtgggctgaagagaagggagagggagggggaggagaagaggacttgggaggacttgggaggaagaagggaggactttggaccacatttgacctaaagagagggagaggattatttttgcgttttttattttaataaatatggaattggtttttgttgttttaaaataatttcttatgctcttatacatgtttgattatgtcttctagtatttaacagtaacttttacccgtagggaagtatgggcattttgctattgagttaataaattaaaacccgttagataattacgagaagaagctagcttgatttagggctgaaaaattctttccgtcgaaga

SEQ ID NO: 12149 - DNA, 1113 bp, Oryza sativa
gattcttattcctgattctggtgttcccgataacagcagaacttatgcctttctcatttcgatttatctttatgatgggggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagt

SEQ ID NO: 12150 - DNA, 1501 bp, Oryza sativa
tatatttatagtcgtatatccatttatccaactatattagtacttcttttgttttgtttcacattataagtcgttttgatttttttccctattcaaacttcttaagtttcactatatttatagaaaaaaaattaacaatatctatacaacattaaattagtttcattaaaactaatatttaacatatttcaataacatgtttattttatgttaaaaatattgctatattttttttggcaaaattggttctatagcatcgaaagattgcgattttggttttatagcatcagaaatcaccgattcactttattagcaccgaaagttcgctccattagtgcatatagcatttctgtcatacttgaggctaacttctgttaaactgacgacgacggtgccccttcgtctcgggtgtctcggtcaggctgagacaaatcagttcatgcccccttcatcttctccacagaaatcacaagccatgatgcctctcattctaaatttctatcccaagcggcaacaagatgcgcagcttcaggccccctcgactgctgcttgctgagcagggagcatatcaggagttcaggactagagaaatactagtactagttactcttacgatctacacatgcacataaaaaaaattgattcaattgggttgtgatcggagtcaatctagccagaggtcttcttgttgttgtcgttggcccagatgaccagaccacatacacatcattcgagcgtgtctgttctataccactgccgccggcggattgctcgatgacagatttaaggggacggcgatattccaggcagctacacgggaaatttaaggtgtgataatgtgattggtggctgttaggggcgggaccgtgtggaatagctcaaggagtcgacggcggcgttggctgctccagcacgagggcatggcagcgacggcggggccgccggcggtcgagtggaagattgacggaagcagacaggcatccctgtgcagtaacggaagcccgatggaaatgctatatacactaacggagcaaacttttagtgctcccaaagtgaacttgtgactttcaatgctataaaaccaaaatcgcaatctttcgatgctatagaaccaattttcccttttttttataacacgatcaaactaactttaaaaagttgaaaaaaaaatcaaaacgactaatatgaaagagggagtaattttgattcttgaaattattaataaaataaaatggttttgtccttaatacttcaaacaaatgtatgtgcaaattatataataaaaaaagatgagttatgaattagttttaacacggcgaaacaccacaaatatggcggtggaatcgttcgttcttgacttcacctaccaagatttgcccgaaagttagaaattctcatattaattgagaaaattacaataaaatgtaagtcgtcaaatcatggtaagacgaaattataactaagtattgatagcaatgccatatacaaagtacagttgtat

SEQ ID NO: 12151 - DNA, 1501 bp, Oryza sativa
gacctcttccccctactgcaaagaaaaatggctctttcttttcctccaattagcagccatgtggaagaaagaagtgttggaaatccccctcaaaatccaattcttaccacattttctttgccaccaaattttctcctggacgtctaattccttttcgaactcatatctttcctctattcagattcaaacaactccctctcatattcaaacaactcctctcatatgatctatgatctctgtcaatttctgttctaattattcaaacaactcctcttatatgatcctatttatttaccccgatacagcaaatgaacatgaaacatcctcctaaaataggaaaagagtgaataaaaacacagtagcaccaaatgtgcacacatgaattatctaccattagtccataactagtagaaatatttaacagaagttagagtacaccattagtccataactagtagaaatatttaacagtagttagagtacagaagcaacaactagttgagtacactcacatcaagtgaaataatgcgatataagactagataatatgtatcaagtgaaatcacgctatagcatctagtttcagtgcaccacaagataaaagcagagactcttgccaatggcttaaatttgccacaataaagcctccgacgttgttgaagaagtatacattaccgtcacaagatgagatgtaaagagccttggggatttcaaattgatcaacgagaccaagcttttcccatgtttcacgcttcatgaatgcatcgcagcagatatgcgggtaccgtctctccagttgagtttttacattgaagcactgcccgtctctccagttgattagtgagttgcatcagtctgttgatagtacctttctcaaccaagtggactgaagcatgactatgcatagataatagcctattggaaatttttcggcagattttgcatagtagaaaagcttccttgagaaattgagggtgcaaattggccatgagcaggtattgttggacgtgcagaaggcataacttgcacggatggtgatgttgcttaagcagcagaggtaggaatttgcctagaagtagcgcttgctagagtaactgatgggttagcttgcacaaatgacaagattgcctgggcaggagtaggaagttggccagcaccagaagcagagcttgcttgagggactggtggttgccgcagtagtaagccatgggacgagtagcatttcttcaaagccatgggacgagtagcatttcttcacagaaacttagttttttccattctgactctgtaaaagccactttgatattggcagctggaatggagcttagtgaatgacccaatccaagcagaccagttgttgatagaaaacacgaggcctgggagatctgcttaactccagtgcaggtccaaaactcgccttcggatgtatgagcgtgccagttgatttgatcctgcaatcaacaagaaacaaagacaaagaaaccgtgattaaatccataaa

SEQ ID NO: 12152 - DNA, 1501 bp, Oryza sativa
cttcattgaagtttatttttcagcctttgtttttagatcattaaaaacacatataaaaaagttttattcacaaattatttttcgtttataaatatgccggggctgtaaattttttggtactacatgtaaaaaatatgatagctctccagggtaccttattaaaaattatattatctatactccctccattttaagttatttgttcattctagttttgtagtcctaagtcaaactttggtctttgactatcaatatttctaaaaatctaaaaactaatatagttaacacaataaggtttatgtttccagatttaacttgaataatattttcataatatataattcacatgtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaa

SEQ ID NO: 12153 - DNA, 1501 bp, Oryza sativa
tatgtcggttccccctcccaaaccgcctcttctccatctataaagcccaagccgagcctccccatctcattctctctcggcatctctcttacaccgccgctgcgccattgttgccgcctcgcagctgccgacctcacatccttcgccgtcgcgcgtgctggtgaagcctgcgtgcgcgcgaggagccgaagaggactccgggcaccctccttcttccccttccccggtccgaggccggagagcccgcccgcgccgtcggccatctcccaacgcccgtcctgatgcggtagccttccgttccacttcctcgctctctctcgccacctccagctcgcgtggtaggtcagctagactctcgaacacgcgtagacgaagccccaagccccgccgccgccacccggcatggcctcgccgccattgccacccgctcccggaggccgccgccgtcgctagccctcctcggtgctccttcgccccacccggcgccggaaacggattccccgacccccatagatactcccaccgctttgaatcgagctctcgttgccccgtcgcatttcccctcttatcttgccgccggccgccgctgccgcaatccgccgattccggccatcccccggcgaatcagagcctatggctcgctttctcttgtccctcccgccactctggtgtactccccctcccttgaacccccgcgaatcgctccggcgaacgccgttgccgtccgccgtcggatgccggcgccccctttttcctcctcctgccggcccgcgtggctgccacgtaggcgccacatcggagccacatcggccgcgaccgggtcagcacgaccagcctgccgcctccccctccctcgaccggtgcgcgcggtccacggagagccctatggctgcgcgtgggcccgccgcctctcggtccatccgacacactacccgtgcgccatcttcaccaaaccctagtgccgcccccgcgtgaacccattcctccgtggacccagccgccgataggtgggcccgtcccgggaccccgcatggtggaccgcggtccacccggtcggtctcctccccctcctgcgccccattaggccgccctcctcgcggccgtgccggcccattaggctcgcccgagctgcgcaagtccctcgagccgcgccaatgccacccgagacaagtctgattcacatctctcgtccatttccttttccaaaggatttaataaatccttttcctttagacagaaaatacaaataatcttaggaaatccatatctcctcaaccgctcgcccgattgaccccgttccacttccagtaattccataaaattgagatctgtctaatggcactataatttagtctaaataggatcttttattggtcttttgtttaggttctgattgtttacgtatagttgcggttaccggattttcgtcaatcgtggttttctcgaagattcgtgaagcttcgtgaagaccttgagcaaggcaagtcaccctttgatcaat

SEQ ID NO: 12154 - DNA, 1501 bp, Oryza sativa
ccaaaacagttgtcatagtaaagtactaatggtctcatcaatgatttctcatccaaatttctctatattctaccctcaaccactccccaacttttacctatgcaccatttgacgaagggcaccatagtttttcttttgaaaccttaatactccctccatccacaaaagtttgacatatttcatatttaagttttttttcaaataagttgttcttatttgtagtctttatacattcaagacttaaatgatgagataaattaaatgtttgattaaaacttaaggagtcatctaaatactcactggttgcatgcttgcattcactccttgattttgtaacatcgaagatgatttaattttttcttggtttttgtgacaaaaataatatgtgcaacttttgtggatgaagtgagtatatgctaaataatctagaattataatatttggggacagaggtagtaataacgactaagagcaagtataataagaggctgtaagtcggctaaatgctgaggtggaggagagaagagaagagagagagtagaagcgggctgtaaacttacagccgacttggacacaataaccaaaaaattgtgagaaagacaagtgggtcatgtattaattataaatagctaactattatatgtgtgggttaagagaaggctgaaaaaaaactttatagccaataagtcggcatcgcaggcatatgagtgtacctttcttaattaatgcatgcttggaccagcaataaatccttggatttttttaagatactatttaaagcgtattcacatatttaattaatatttatagatatcacgattaatttaatcgagaaatcgagagatagagttatgctctcacgatttcagtgacctcatcaatattgtctttttaatatactaaattgacttattaggtgttgtcacagtttacttgacggagatattcattacagttgagcaacttaaagtttgtcaacactatcactatgcatattcatttgtgcgtatctaccattagaacaaccaaaatctaaactctagaaattattatgcaatgggataaagtgggtatattttaaagcttactaatatgcaagcatatcaaatcctcatctaccatgtcattttcacattatttcaaaatatttctatccatcgtttatagtataatattaacaaaaattcatatgaaatattgccatatagggcatcatctaagatggtgtttggaaagtagagactagacagcttttgcccctcccatagagactaaaatttttgtgagtttaatccctccttttcaaacaccgcataatatataaaattatagagaagtatagaaccataagcatgcaaacacaagttacacaatataaagccttcgttactgcactttgttgccaattattgtagctcaccaaactacccattgtccaacgcttcgtcgaacaccatgcccgcctccgccgccgccgccacacgccctgccgcagagggcg

SEQ ID NO: 12155 - DNA, 1501 bp, Oryza sativa
gagtgttttggagatggcttaaagattaggtttgtttgagcactttggataccttgtgggctgtcacttgggcttattactcttggagatcttctcctagacggttaggtgtcgcctgtgagcttccaaagatcttgtggatgtcccggaaaagtttgtgaaggttttcctcacctccgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgaacacctcaacggagagtaggatccgtgtgatccgaacttcgggaaaaaatcgcctttgtctctcttgtgcatgatctgtgtttgaatctgctggtatcttgtgatttacatcttgtgctaccttgtgcctgattgtctctagctaggacctgttttacatccccgatttcaattttctctgttgcccggaagttcctggcccaagaactccggaagttccgggctgctcatcactgccaggaagttccggtgttcttcaccaggaggttccgggccctggcccaagaactccggaagttccgggctgctcatcactgccaggaagttccggtgttcttcaccaggaggttccgggccctgttaaattaaccgctgcgattgttgagaaaatttcaggaaagcctattcaccccccccccccctctaggctacatctctgcgcattcagtgtgcatccactgcaagggccgccgccacagctgcaagggttgttgccgtaatggttctcgctgaagtgcattgtgacttgtcgccgcaaccgccaaccttgttgtcacggcaaggagacgttggatctggcgctgccaaggtcgaggggaagccaccgcgtcgcgtgccgtcgctactgccgcaccatcttcgtcgctgccttgcgccacccgttcttcgcgcctgaattgagaggtcatcgaagcccaccactgttgtcctcgctcgccgctatatttccggcggcgagctccagcagcagcgaggtggaggagagggtgtgggtggtgttagaagtataatatgttagttagagataagagtcaaaaacaaattatagagataagatatatcctaaagataagatagagtactagagatagaatcatagagataaatctatttttatttgtattgtactccaagtctctatcctatatgtactcctatatatacctcatgagagggtcaatgtaatagatcaggaaatatcagaatacaacaattagatttttctatagatggcggctgctagggttcgttgtcgcccctgagtcgcctgtgcgtgggcgacgcgatgggaaagttaggttttgtattttgagt

SEQ ID NO: 12156 - DNA, 1501 bp, Oryza sativa
aatatctccgtcaagtaaactgtgacaacacctaataagtcaatttagtatattaaaaagacaatattgatgaggtcactgaaatcgtgagagcataactctatctctcgatttctcgattaaattaatcgtgatatctataaatattaattaaatatgtgaatacgctttaaatagtatcttaaaaaaatccaaggatttattgctggtccaagcatgcattaattaagaaaggtacactcatatgcctgcgatgccgacttattggctataaagttttttttcagccttctcttaacccacacatataatagttagctatttataattaatacatgacccacttgtctttctcacaattttttggttattgtgtccaagtcggctgtaagtttacagcccgcttctactctctctcttctcttctctcctccacctcagcatttagccgacttacagcctcttattatacttgctcttagtcgttattactacctctgtccccaaatattataattctagattatttagcatatactcacttcatccacaaaagttgcacatattatttttgtcacaaaaaccaagaaaaaattaaatcatcttcgatgttacaaaatcaaggagtgaatgcaagcatgcaaccagtgagtatttagatgactccttaagttttaatcaaacatttaatttatctcatcatttaagtcttgaatgtataaagactacaaataagaacaacttatttgaaaaaaaacttaaatatgaaatatgtcaaacttttgtggatggagggagtattaaggtttcaaaagaaaaactatggtgcccttcgtcaaatggtgcataggtaaaagttggggagtggttgagggtagaatatagagaaatttggatgagaaatcattgatgagaccattagtactttactatgacaactgttttggggcaaatttgaatactaaaaatacaattattatgagatggacgtagtactctatataagtacaactacaaacgaacatgaaggttgaactccgagttccaaattaacttgatactaccttctacaccctttgttccatagaaaataaatcatagctataaatctggatatgtgtgtcaggttcatagctatagttgaactttttctcagagggagggagtatgctgagtacaactataaatcttcaactcatttgatgtgttgtagtagataatctgcagtggacaacatactactcactatatctcaaaacataagaaactagtactggatgtgaaatttcatagtattaagattcgaagtactacaatgtacaatgtgtcacatttattactagattcttataatttgggatggagatagtacctccgtcattttgggacgaatggagtagttattaagatcggaccgaatcagtggtccaatcggaaaaaagacaaaaccaaagcctcagccgattcggtctagctaaaagatcggccatgcaatcagatc

SEQ ID NO: 12157 - DNA, 756 bp, Oryza sativa
tcgaataagccaacaagcaaacagccaatcagccaaaaaaagccaatgcaatgcacagtcaaatcgacacgacatcaagtatcggtaattttatcgatatcgataagaaaaaagataatcttaattatcgatcgtacaccattgtagcacatacagagtactataggagtatttacgcaaacctgcggctggcggctataaagtgacagcattgatgcatcacttttcaagacaggaagtacatgggcagtactatgaatcgatctgcttaaaataactactactccaggctagtaccactcataggagtacgataaaataaaacaagaagggttaatggactccagagtaggaaactggtcagccaaatcttacgtaggtacccagcatgtagtggagactggatgcatttcaaactaatggccttttttagatcacacctaaaattttacaccttgttatacatcgaaagtttaaacaccttacagacaataattaattgctacatcgaaagtttaaacacctaaagtattaaatataggctaaaaaataattaattgcacagattacgactactttacgagataaatcttttaagcctaattgctacatgatttgacaatgtggtgctacagtaaatatgtgctaatgatggattagttaggattaataaatttgtcttgcgatttacagacgaatacagtaattagttttttattagtacccaaacacccgatgcgaacaccccatgcgaca

SEQ ID NO: 12158 - DNA, 1501 bp, Oryza sativa
gaatccgaatcccgcctcctcctcctcctcctcctccccccgcgccgatcttgccccgctccctcgccgcagctgcgggcttgccctagcccgccgcatcgccgacgtactacgcccgctcggctccaggctccagatccggcctccagggcgtgcccgctgctggacggcgctctcccgcgtccgtggctacctcctcctccgggtttgcgttgccgtcgccgaagcgatccgttggtatctctctctctctctctatctatctctgcttggttagttatttgttttgcaaaagcgattcgtttggaatctccatctgcttggttagttattgttcggaatggtgtctttgtcggtaattggtaccttaaaaaagagagtggtgtggttgctttggattggaaaaaccaaggagagttctttacactataaggtgagaggcgaattaccgagcagggataattcggattgtgctgctttgaattggaatgccgaagaggctctatgtgctataacagtacggctcaaatttctgagcagggagaattcagctatttaggttctgtgtcatgtacttttgcttgttagtgtgtgggggcggaacctcacacatttctttgtagtgtataaacctaagaacttagaaagttcgagctttggtgaagtccttcatgttaatacatgtcgaatgtgaggatgggggcgtctggggggtactatgctcaaatctgaaaaatgtgttatatacactatcgcatgagaccaatgaaccacacagatagtagacatctgtacaaaagggtacactttcattacagaagatcatgtgtacaacatgtctacataaaactagcctcaaaagatcctccaaagtgagggtctcaagcaaaattggccccatctccttttaaggactaaatatgatgcattgcctaaaagcccccaatttggatgtaaggtttattgacgattaaaagtatgagttctaataagtagctgttagttaagttatgcttttaattttgaccaaagtttgatgatctggattcggatgaaaagtctccagctttagtatatttctttgcagtacttctgtatacccaactgtcaagatattcatttctcaaaacttgggaagatatagtgtttcatagggtcatcgatatacgaattgagcgcaacaaagctaatatgagcttgttttatttcttatcaaattgtttggtgtaaccaagtgctcagcagtttggcatcatgggtacctgaagatccaactatgttttggcccttctaattcataggagttaggactaaccattaacatttttttatttagtagatttgcagggatatatgtttctaatgtgcaattttctactagtacctaggttatgtgtcctgctaaaatgattgttgttgcaggtggattgtgtgtagctctgtaacaaaggatcttggtccataggagtgaaccagaaggtacaaaacttcttggctatta

SEQ ID NO: 12159 - DNA, 1501 bp, Oryza sativa
acattgaagagcatagacagctctcgcacctttttcagcaacctagaagagcacctcttatatgtggaccaccagaatatggatggcttcattggtcattggatggacagtgatttccattagaggcatggcagcggaaaacataattacattgaagaaaagcatttggctaaatttagattttcttgtgtgaacattagggcccaaggaagtcctctttatagccaagttgggtgaacttataattatgaattgaagttaaattaatatgtaaggggtgagtaggatatggtctaactaatgacaaatataaaatttggacaactttgtacctaccgagaatattctttaccccttaccatgaataagttcttaaaataaacacatattaaacaacaaatatatcatgcaatatatctgactatctaagtgcttccttggaagggtgttggcggttattaaatgccgactctataccgccaacatctgcataaagtctagataataaaacatccaacatagtgataggtattaaatctcacatcttccacaagtgttggtgtatatttgtatgcaggtgttaaaccccgaagatgggaggaaatctagactaaagtaaggagaaacatgtatccatataaggatgggttgtaaacttcatcgaaatatcaaagacttagcccaaaactccgagaaatagatagagtaggaccaagggaggagatccgccgaaggccaggccaggagggcccagcccagggttcgtgtcacaccctgaaaatcctaaatatataaattgttgtttaattggaatttttagaaataattttaaaagcctagaagagaagatctaattttaattaataaattccaatataaaatggggccagataaaatttcattaaatactttgcttaattctataattcctagattattctgggatttatttgagctaaggaagtatttttaataaatggaattgcatttcatgaataatttaaattgaaaaaggtttttaaaagtctcttttggctttgggccgaaagtcggcccaaaacccttctctctctcctcggcccaagtcggcccagtccgccgcagccgcacgcgtgccctcgctcgctgccaggtggggcccgcctgtcggagtcgtcgtcttcgtcgcgccgccgccgcccgaaaccctagccgagccgcaccgccgtctccttccaaattcggccgcgtctttccgtttccggtgaaatcaattgagggaaaacaatcttcgggatctcctctaccttttctcttttggaatcatcggcaaaatcgttttggaagttcgtggattcgaggtcgaatcggatcggtctctttcctccgaaccccgaggtttccttcgcgtcgccggtcgtcgtgggccttcgccgccgctctccaacccctttaaaaggatccccggtgtcgccgctacccgtcgccactctcgccttcgcttctcgtcgccgggagcgct

SEQ ID NO: 12160 - DNA, 1501 bp, Oryza sativa
cataaatagaaaaataagagaaaacgaacgacacacaccgcatgaggacagggagggtggaatgcttttttgtttaaaacaattatttatttaatgatctaaaataatgtattggatgtttaagtcgaaaccaacaatcggatgtttttttttcttataattttgtatgatttttttaacttaagaaagacccgtagtggcttagaaatatttataggatgtttaatatactttatgtctttaacattgtatgggcgtggagggaggaaaggaggtttggtagtttttcttaaaatataagtctaataacaacctatatgatatgttcgtcgatttaaggcgaaaccaatgattggatggtttgttcttaaacttttatgatctttttctaatttagaagtgtcacagagtggtttagaaacatttatgaggatggttaacaggctttaacgatgcatgggagcacggagggacttttgggatgcttttcttaagaaaaagatatatctaataacctaaaataaagtaaatcgatggtcgaatgttttatttctttttagattttctctaatttaagagtgctttatggatggttaggaatttctatatgatgtttaatggaatatttattaggagaggatagaggaagagctagctagatctagtagattgatgagctttttaggcccttaattttttttatttcaatttttatggggatgtaaaaaagagaaaaaaaaaggaaacggggtcagtaagtaagctgcagagggatcgtacgcacgttggtacgttggacggacggagattatgttttcatgcaaagataaatctaacgatagtgggtgcaccaatttaaagaaaattgacggtcaaatttttttctattttattagagtggcatatggcggctcgagagtgattataggatgccacatggtagcttaagagtgtttgtaggaagtttaatggacttttagtatataatagatagaagatagatagatagataatagatagataaggtagcgctgaattgcttggctgtgcaatttgcttgacggttgaccatgtttagtgtatctgtgtcatcataagaactcaaagtattggatcaatacttgataagattgcgtcttccaaaaatttgagaacaattcttacaatgaaaactgtctctcctgttataatcttgtgaaggttactcatgtccagccatgcagtgtctgctccttggtttagggcacattcaatagtaaagacaattatggtcacttagacaatataaaccgagtctttataacagttgagacgataaaagttctaaccagtaactaaaaaaatattctttttgttactattctttctatgtttctttctcatgcaactatgtttccatattatggaggctaagaatcattgtcgagccgttgttacccataacaatgatgttttatctctcctctttctctcttccatatgatcagcaaatattcctaat

SEQ ID NO: 12161 - DNA, 1501 bp, Oryza sativa
ccgtaagtgcactccaacaaattagttattgtagataattttgataaataaatagattttaaaattagtaaaggtgtctgatgcaattatgaacaagtgacgaaaacaaactagacgctaaaatagagatctttgtcaaaatatgaacaatgatataatgatatgatactctgaagattgttacggtcatatatctatttagcgatacattttttaatgatcaacctcactcatttcaaaagagaatattgtatatataccataaaaatttgggtagtactgatttaatactataaacaaattataactacacaaaacgtaaaaacaactattttttatgtgaagaattattttcattacatctatcttttcttgctttctctaaagggcactgaggaagtatagtaggggcatacatttggttcagttgaggtagccccagtggagaccaccattgacaatagtgctcaactttctacttactgatgcaatcgtctttgagggtgttgatagtgaattaagcattaaaagtacattatacgctggccttgagaggcacgagtatgtcgattcggaacccatgtttaaaggcaacaaaaaaataaagagttggtagctccaccttttagagaggacattcatgtctaattgttaacggtgatatcccattaaccaatagaagcatcattttaagaatattatttatagatttagaaataagtgttgacataaacatttaggtatgtagtggagacaaatgttttatgtattaataatgtattaggcttattttggtggtacagatgcagtttcatttattaaaatggcatctagcgacaatgataataagtaatagtgacaataggtgagtttacataatttggacaaaagtgatttttttaatataagaaacattcttttcgtttatattaaagtattaaagtctacaatatatttcacaacatagatttttgttattatgaggtaaaatatacaatttcttatacgcgtatggtgagatatgacttaattctcgtaacattatttatataaacataataaataagatgcctgcgcattcgcgtggactaacttcctaattcctataaacctgatcaaactaaaataaatttatatagaaaataatctaaacgatttataatatgaaacataggaactagacgtatagagctcagtctcccgtttcttgtatctatgctctccgatccttgagcgttaagctagcgttagatttcgatgagaactcgtcctcctctaccgtgccaagaacggataccagtagtaccagtacaacacctgataggaaatttccgagcacgatgtcaagcacgtgctaacccggctgctagtatttcgcaagggatttccgcgttataaataaaaacgaagtcgtgtagtgctcattgcaccacacgcagccgcactcgtctactccacaagattcctctgattgctcgcgggcagctaggctccacgaaga

SEQ ID NO: 12162 - DNA, 1501 bp, Oryza sativa
atttaaaattaatttaaaaatgggtgtttaaatacctttgatttgatatttatatggatctagtttaacttgcatatttctagagtaataaatttggttttattgtatataaaatcttatcttgaggattgtctatattttttgtcgatggttgtacgaacatacatatgtatttttttttgggttttatagcttgtttaatggtatatacgtatgttactttggtttttttttaatcgaacatccggtaaacagtttctctcgtataaaaaaggaaaataaaaggaagcgagctcatgtaatggtataaaataatgggtccattaatttaaatgaccatgttgtagagtaataaattttatttttatagtatataagattctattttaaaaaggcctcaatggttatatattgttgtacatatattttcctttagagttttaatcgtgtgcacatgatacatatcctttgttttttcataggtgaacagtatattaatgtttttttatgtttttatagtttttttatcgtattactacgttctttgttattattgtttttatatttttttaatcatatgtactatgttctttattttttctcttcgaataaacagtacctaaatgcatatcttttttttgtcttaaaacatggtggtttaagagtgcttgtacaagcaccaaatgaccatgtttgtagagtaataaattttatttttatagtatataagattctattttaaaaaggcctcaatggttatatattgttgtacatatattttcctttagagttttcctttagagttctatagtatataagattctattttaaaaaggcctcaatggttatatattgttgtacatatctttttttcattcaatgtacgtacataaatatttttggtaaacggattatctcggatatagaaagcataattttttaaaatagatctaatcggacggtgtaaaataatgtgtccaccgatttaaataaaaatcgatggtgggattgaagaatgccacataacggcctaggagcacaaagatattggcgggtaaaaaaatagttgtatgatttagatatcgttgttacttaattttgttaatataaaattttactttaaaaaggaattggtggaatacaggagggaatcgaaggaagagaaggtacgtaacttatgcatatataatatcttagtacgtaactatacatatttaacgtacgtatgacctaatgctcggtggggctggatccatttaggaggtggattttttgttaaacataaatctaatgattgtaaataatggacccatcaaatttaatgaaaatcaacggctatttgttagatatatataaccagtaacctcactctcagatccggttgttactagtacaaccaatcagatccggttgttactagtacacccaacaacagtgtatgtctttttttgtcatcttatagaatttccttttaaaatacttagctgatttacgatctgat

SEQ ID NO: 12163 - DNA, 1501 bp, Oryza sativa
agagagggaagagaggactgatgattgtggtagagaaagtgggtcactttactttttattttagagaagactgatgattgtggtagagaaagtgggtcactttactttttatttttcttatttgactgatatatgggtcccacataattttttatttgtatgataaaaaatatcactgatatgtatgtcttattttgttttataattgtcatataaaacaaaaccatcgttaaatcgttcgggaagataaaataaaccgtttcactagttggaagtgcctttatattctaagggtgtgtttagttcacgaaaagaaaattttgaggtgtcacatcggacgtttgatcggatctcggaaaaaactaatttcataactcgcatggaaaccgcgagacgaatttattaagcctaattaatccgttattagcacatgtgggttactgtaacacttatagctaatcatggactaattaggctcaaaagattcgtctcgcgatttccatgcaaaatgtacaattagtttttttctttatctatatttaatactccatgcatgtgtcaaaaattcgatgtgatgttttttgggctaatttgtttagaaattaaacaagtcctaagttctatggttgaagttaagggttgcaaatcagatacgcgtggatgggcgacgagtgtggcgatgcggtgacagcccacgccccacagcctcagcagccggtggcctgacctcaccaccaaccggcggcctatgcgcggggagcgagcgtgacgatcgatcgagaggtgatccacaacaagtgtccacaacacatcgtacgcttgccgacactactactactaaataatcaatcatgtgtacatcagtgctccgtcctacgtacgcgatcgatcgagttagtagctagtgcgagtgcgacacgtacgtgcatggacgacgcgcccgaaactaaggcgaaagctcgaaaagcatatcaatcacactccagcatgcattcatctaattaaaccgtaccatgcattaagcgtacagctagcttcaaccacaagtcatgcctagcttagcctcgtggctgctgggccaacacacaagtacacacaaccaccgtccgagatcgaccatactgattcactgctttggcttaatttggtccacacgacacgaacaacatcatcattatatattggagtttattcttttggattcgtgtaccggtgcgtgcactgcactggtctagctcgcaggctatctaccaattaaactttggcccgatgacgtacagctggatggctagctgttaggtgttcgactccggtactgtactagtgtgttaggaacaaacggttcgatcgatcgctttgtcgaccagaccaccatctggcgcctgcagcacagtcagcagcaacaagccgattaatggcaccgcccttggctatgttgctggtttgatggattttttacacatgcgtagccacaggcccacatgggcgagacaagtacgtt

SEQ ID NO: 12164 - DNA, 1501 bp, Oryza sativa
cacatatatacctgacactacatagaaacctcatacttgcccaacctagctactgcattgtgttaagtattgcatgagaaagaattgctggttcctcagtaacatactttgacaaggattctaattattgttttttttgggaaaataatgaagaagaaaacactgacttttgctatttatagcccaagctggatacttttgttatcctctcatctaccagccaatttatttttgatgtatttagcactcaccaagaacctacactcatctactttccagttactctaatacaaaattgatagggagctttattaaaatcttccattatttaagttccagatcaaatgtctataatatgtcacatactcataccccgcggcgttgctgcggaaaattaagttgcataatatgtacaaaactaaaaacaatttgatacaattttgagcctaaaagtaattgagattgcatgtttttaagagagaagaaagaagaaacaatttagaccatagatctatcatccaaaggctagaaataattagggtgatgtgggttaatgagaagagagaaatagcattaactacacttagtggagatgaactatataagtatataggataactattgtgttttgttcagattatacagtctatatcacattatatgccatagattaatttttaaaatttaatactctgctgtagtaatcatgattgtgcaatatagtattttgctacaacttgcattgttgttaaactgatcattctgtctcaatacggccaaatagtgtggcccatcgagtgttgcacgcggcaacgtcgcgtgtttttttctagtagtttacctaattgaaagaataatgtgccaaacttcaaatggatcgctcccgacataccgtcggcttgtagatgaacctttcgacttccatcgtagtatgtaggtcggccacgcacatgttctatagtagctgcatgcaaatcgttctgatgcacaattagcaaggctggctcaacggcctatgccggttgtgcgaccggctaggacctatgccattgccgccgttgccaactctcatgcggccactccttaccgcattgtcgctagggtttaggataaggtcttgagatcttctcatcttctcatttgcaacgatctatttagtccaaagtttagattagaactttgttttgttattgttgttcaatttacttcataattttacgtgcttaattatcatgttaattaatgataacactggtggagaaatcgtttgtagtcccggttcgtaaccccctttagtcccggttgtccaaccgggactacgaatccgggactaaagatagcgatctttaatcccgggtgaaataaccgggttggtaacacgaaccgggactaaagatcggtcagccacgtggccggctgatccatctttagtcccggttggtgttaccaaccgggactaaagatctatgtaccatttttttttatttgcatggccctgttt

SEQ ID NO: 12165 - DNA, 1501 bp, Oryza sativa
ctaaactgactgggagctggaatatatataatctgctaaactgactgggagctgaaatatatataatcttgatgcagaaattaattaacaactagccaactgcacctactgagtttggaataataatgtgctagtggttagccgacactatttgaaattagtttctcttggttctcaattaatcttgtgaggatgatcatcatcaatccccagatctgagggagcatgcatgtgctatgttgcttcattcaatagatgcttaatccacttctatcagaaccaagaatatgtattctagggcagggcaactactcctacacattatctctatttatcagtatatagtggatcttgaatatatatatctgagtatctgacaattaatatggcatacaagtcgctcctatattataatgtcaacgtcgtagttgccctcatgcatgcatcgatcaggtatcccactcttgtcattttttctcatctctctttttactttactatcactttgcatctcattctcttgaggttgattctgtatgtaagttgtatatataatcaacggttgttaccgtgaatgagatgtggttatccttggggttgatctccttattgggtggcatgctctccgggtcctctgcctgcagcaggtggatgccgatgccgtagttgaacagcctgaatcatcaaatgaaacattgcagtttcagactttcaattcatgcagcaatcaaatcgtcgaaatgccggccatcgccaagaacaaaatttagtgtacacattggcatggatgggcgtatatatatactccctccgggcgtatatatatactccctccgtttcaggttacaagatgttttgaccttgctaaaagtcaaataatattttttatccaagataaatttattataaaaatatatctaactattaatttaataaaactaatctagtgatgtaaatattattatatttatctataaatttagttaaatttaaagtaatttagttaaacgtattataacctgaaacggatggagtatataccatgcgccgtcgaagtcgaaggagcccgggcggcggacggagacgaagccgaggaagtcgcggtagaaggtgagcgaggtggacagcgaccggcacaccagggagacgtggttcagcgtcgacagcggcagcgccgccccgccgccgccgcacttcacgcccgccgtcgtgttcaccatcttctttcttcttgtgtcaggtcgatcgttgcctcagcctcaataatgccggccgggtcgcgatcagtggcactacacagttttgtcgtcgacggagacgacgacgatatatatactacgacgaacaggccagccggccggcggagacgccggagcccggagaggaggaagctagctcgccggcgacgaacaagctggtggccgggtgtaaggcggccgccggaggtgaagagacgagggacgtctgtatatgttccggccactctccgtgggcagtggct

SEQ ID NO: 12166 - DNA, 1501 bp, Oryza sativa
gccgccccgcccctacgccgccaggcccccacgccgccggaccgcgcccccaccgccacgagacgccgccgccgctgccacgccgccgccgcgcccccacgccgctgcgcccccacgccgccgggccggcccacggcgccggaccgcgcccccaccgccgcgaacgaacgcttaacgaacgtgaccaaacgtgaacgaacgcgaacgaacgtgaacgaacgcgaacgaaacgttaaagaaacgtgaatgaacgcgaacgaaacgtgaacgaacgtgaacgaacgtgaacaaacgtgactgaaacgtgaacgaacgtgagtgttagtgaacgaacgcgaatgaaggtgaatgaacgcgaacgaacgcttaacgaacgcgaacgaacgtgaacgaacgcgaacgaaacgttaaagaaacgtgaacgaacgcgaacgaacgtgaacgaacgcgaacgaacgtgaacgaacgcgaacgaacgtgaacgaacgcgaacgaacgtgagtgttagtgaacgaacgcgaacgaacgtgaatgaaatgcgaacgaacgtgattgaaacgttaacgaacgtgaatgcacttgaactaaaagtgtgagaacgaacgcgagcgaaacgtgtacgaacgagataattaaactattgttgaacttagcatatatatatgattatatatacttgaaaacgtgaaatacattatatgttcctttgcatttagactaatacatttttttgcatgttgcagagaagacgtcgtcgtcgtcgtccctcaagccgaagtggtagctagccctcgaaggaattcgcgcaggcaagtgatgtaaagatgtgatagttagagatataatataagattgttagatttctaatataagattattagattattagagttagcatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatatttgaaacatatttgattgttagagatttaatataagattattagagatgtaatattcgaaacttaattagacttagcatatatgattatctaccgtacaaatacacgacacttagacttagcatatttgagtgttagagatagttagagatttaatataaaattattagaggtttaatatacgaaacttaattagacttagcatatgtgagtgttagagatttaatataagattattagagatgtaatattcgaaacatatttgattgttagagatttaatataagattattagagatgtaatattcgaaacctaattagacttagcacatataagattatctaccgtacaaatacatgacacttagacttagcatatatgattatttgagttttaatacaagattagtagtgttaatatcacgcttagcaaatatt

SEQ ID NO: 12167 - DNA, 1501 bp, Oryza sativa
ggtataactacattatattttgttaggtcgtatgtgaaaatagaaatgtagaaagttaatagagtctattcaggttaaatgtataatataagttagaattaatttgtacgtagtagtaattataagttataattaattagtagttcatgtgatgtttaattttatatatacgagcaatattatatgtaagaaatgaaaaaaactaaaatattaatagttgtattcgtagttattgatattgatattaatagtattgataattattaaatgtggtacaaaaattaaagttgtaattaatttgtagtaattttaagttacaattacttactatttcatgcatttatttattttgtaagaaatggaaaaggtataaatattcgttaagtagctgtgcatatatatggtgtgcttaaacacgtgctttacattgtaggttgttacgaacgaacaaataaatgcaataattacgaagaacttcgaaattgggatttttataagagcacattggttcaaaagaagaaggcaagacaacaaggtatggtaatataatggaagacagttcgtaattaatagacagtttgtaatttatttggtattgtaattaaagtgcagttaaataaatttatgtcgctgcaaaaagttttgtactaacagatagttacaaatattttgtatttaagtaaagttgtccgttagataatttatagttaaagtagtaatataataaatgtactcatccaaatttgcagtagtagtattgtttcggatgtcatatccaagtaggtacaaaccgtccgtagcaaagaacatgatgcggctcaatgagtgtcattgtcctagataaagaacagaaagagctaacaaaaatgatttttaacttagcttccgtcaatgtttcttcggtgcaagtagtcatttgttgtattaaaattaattgatatgtataattaatttgttagttaaacatatggattatgcagtgaactaaactttgaggcagcaattgttatacgagcaagctggttaaaagggagtaggcgttatctgataaccgaaggtaattatttcgtcatcatatttatttgtacgatatggtatggttgtgttgttttgagtattacatactctgttacttaaattaattgccataaattaattgccatagttatgtttaattacgtttttttaattaattaatatgtattatttttattgtcatgtgtatattttttatgtcaaagttgtggtaaaattataaataatgaattgcattgtcatgtattcgtaagtaaataatttatgtttacgtaattatttttttataaattttttattagaagtacatgattttttttataaataatatggaaatataaataagtagttatttataaagaattttttatcaaaaaaacagtatgcgtgtaaactaattttggtcgcgaataggacacgtttattctattagacttccttacggactagtccgtgttgtctgcaa

SEQ ID NO: 12168 - DNA, 1501 bp, Oryza sativa
acagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgggatcagccaggcccgggtggccgtttgaaagctgttggccgggtgccaatcttgatcaattcaaaagactgaatcattgcacatactccgaccggacgagacgcactgtctcatccatgtcatttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatcccctcccccagttgctgaagaagatgaagcggatcctgctgacgaggagttcttccaggagcaagccggctacgatgagttttagggtttcggcctagttcccaagtcgtgtctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacacacatactcacattaaatgaaatataggaaagttaatactttttgttggtcttggtgaaaaagttatataataatgaatatggaatgtagggagtctcataagtacacctaatttctttatctatttaatacctgaaattatgaaattttaccctgttattcatatattaatttaaagcagcaagacattgaattcatcgacataagttggaagtcgaatatatgcgcacaaattccaaattccaatgaaccaaagtgatgaaactacttattcccattttatctctcctcacagtggcagagctagaaagatttttgagcctgagcaagcttcacttctagtaattgttatataaatttcatcatcaattcattcaataacatataaatttaatggagtttttgtcggtgagcatgcgcagccgcttggctggctccgcccttgcctccgtatgtctataaaaattgagaaaatccattttttaataacacaattcgaatgcatctgtctataaatgctgtgcaattcaaatgtattctgggagtatttttttcttctataagaaaataatgtattaagttttaatgcaggtgtatactatggtgcagttcaaatgaattttggtagtagcatttttttatggtgagaaataatgcattacattttgaatgtgtcagggttccgggttaggcataccctttacccttcgatatacgttacatattggta

SEQ ID NO: 12169 - DNA, 1501 bp, Oryza sativa; identical to SEQ ID NO: 8178

SEQ ID NO: 12170 - DNA, 1501 bp, Oryza sativa
aagccggtggtgaagtcgtggacgcccaacagcggcggcttaataggccagccgtgtaggcggaggcaccactcagcggcgacggaggcaagccggcggtgaagtcgtagacgcccaacagcggcggcataataggccagccatgcagacgggaacaccagtcggcggcgacggaggcaggccggtggtgaagtcgttgttgcaatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagtaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattgcaacggtagacccgattgaagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaactttaaccaatacggtatcggtttcctaaatctactttacaatcttatcaaaccaggactttaggccgttccataatatacagggaaacgtaatacccaagtcatgatctgttacatattccatagatataagttatcccctatagccagtcggataactatgccatgtaggtatggggtacccataatctccacacatagagtaattgcataagcaaacattatacccacaccaaagtttttcccagataagctagccgtctattcagtataacatgaacataatgtaaagtaggtactcatatctttttgctccatccacattattgtgcgttgttcttccatcactcaa

SEQ ID NO: 12171 - DNA, 1501 bp, Oryza sativa
atttcataataatttttatttgtgctctgaaaattccactaaatttaatttacgcattttaggcttttaggatatttacaaaaatcctctaagccttatttgacttttaactttgcacattttaattgttggaggctttcacacggattttaattattctaggcataatctagaggatgtattttagagtcattttgggacgtgacaattgatttcatatttctcttgtggagcctatccttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttgagtgtcggctacgactccattggttatcattctaagtgtagcggtaatcttttgcaatggtgatagacccaaagcactagcatcatttccttttttgggctaccacatcattaactatatgcgcaagaaaagaggacgactcattccaaacctacgcaacaaaatgtgaattaatataagtggagaacaaaacaatatcaaccaaaatatgtaaattaattgcaagccttctccagaataagactaggtcatatgtaggatgctccaataagtagttgtggtgcaacctatcatggccggctcgacgattacgacgaataacttgacgatcaggaacaaaatcacctcgccatggagcattcgactgctcatattcatcttgcgcgactattgttgcagcaacgatgatttcatcactggatgaagatgattcatccaatagaacatgtctcaaaatgaagatcattgagtgatggaagaacaacgcacaataatgtggatggagcaaaaagatatgagtacctactttacattatgttcatgttatactgaatagacggctagcttatctgggaaaaactttggtgtgggtataatgtttgcttatgcaattactctatgtgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaagtttctatcttgtaaccctgccccccaacctatataaggagggcagggagcccctctaggggcatga

SEQ ID NO: 12172 - DNA, 1501 bp, Oryza sativa
ataggcaactgatgcgaaatcttcatcgatcataagagcttgaaatatttcttcacccaattagatctgaatctgaggcaaagaagatagttagaactcatcaaggattacaatcttggcattcattaccatcccgaaaaagctaatgtggtagcagatgctctcagctgaaagctacatcacattaccacctctgtccaagttgatcaaccgaagttactctctgatttttagaaactcaatttggagattgtagatgaaggttatgttgctgctttagcatttgttaacagcaaaatttggcaagatagtctcggatttggagttggatatcgaattgggtttgaaggagattgaatcttgccaaaacagactgcgccgattgagcggatatggcaagcagccgatacgactcaacttgggctcggtttgggcctcgattgagataactgatttttccatatagagatagagctcgtttaagacaattatatctattaattaagatattaatgtcaatttgaattagagatatagtaagagtctgccatgtggacttgtttgtttgttttatctttaggaaagtttgagtcgtgtccataataggtacgttttgtttccggggtataagtataaaccctagatcattgtaataagggatgacaatccaataaatacaactttcagtgcgttgccaccttttctctttttactttcgatgagttcttgcttcaagttggggcatcggctgcgatctctcgacaagaggcaacttgtctcaatggcttgcactattggagctcttacatcgctttagatgtattagtattttattgtgatcatcgctatcatatatattagttaatctagtttagtatctcgatttagtcgtatcggccgattctcgctttagggtttatgctgctatcggctaaattatcttactagattagattagctaagatatctaccatcccgaaaagtggataattccttgattgatttttatcatactttaagttgcatcaaccctagtcttgtctagaaccttaaaaactaacctggaattaatcataactaaggatagtatcggagtttcagccgatcttacctaatatacatgatagtgcatgtttcgtgatatgttttatgtatatttgccacttatatacatatatattactctatataaatacatcaagttagattggtctcgattaaacctcatattttgtgatcgattgttatttgatatatttatatagattgacttgtttatataaatttgtattggagtaacagctaatacattatctatctttgctctaaatattggtctatcagctatttctataatactgtcttaaagtgattgataaaaacaaaagagacagtattacagccgatacggcatatttagggtttcgttctatttattcattccaaagccgcagtcgatttggttcaacctatcagctgggtccaccaaaccatcgcagcc

SEQ ID NO: 12173 - DNA, 1501 bp, Oryza sativa
aaatccgagactatcttgccaaattttgctgttaacaaatgctaaagcagcaacataaccttcatctacaatctccaaattgagtttctaaaaatcagagagtaacttcggttgatcaacttggacagaggtggtaatgtgatgtagctttcagctgagagcatctgctaccacattagctttttcgggatggtaatgaatgccaagattgtaatccttgatgagttctaactatcttctttgcctcagattcagatctaattgggtgaagaaatatttcaagctcttatgatcgatgaagatttcgcatcagttgcctattagataatgatgccaaatctttagagcatgaactacggccgctaattccaaatcatgggttggataattgacgtgaagcataagccaccactttgccctcttgcattaatataaaatcaagtccgtgtcgagatgcatcacagtaaatatgaaagctttcatgaatatctggcatcactagcactagggctgctttgagcctttttctcaattcatgaaggcttaattcgcatatctcagaccactcaaatttgtgttctcttttaaagagttgagtcaagggccttgtgattttagagaagtttttgatgaatcgatgataataatcagctaggccgagaaaacttgtgacttcgggaacgttctagtgttgtttccaattaaacacattttgtacatgttggcggtatgtcatgagacccttcgaccggtcctgctgaaaccgtgcaaccaatggagggttgaagctcaagacatcgagtctgtgggggcgaagcccacatggcgaagactatgaagcaaagatggcgaagggcgaagaatcacgctggtatcccacaaggtggaagacattttgggcgaagactatatggcgaagaaggtatggcgaaggcggatgacttcgccatagcaagccgaacttcaaggaggcccaagaggccgtctcagccaatcaagcccgggggccactgggccagcgttcgccagtcggcccattagaggcccatgtacctcaattacactatatacccatgtaaatgtccctttcataagggcaaccatgtaaattcccctgttaaacctaaaccctaataggggaacctgtaatagggctataaatagacccctaggccatgtaaaagggggatcccaagaaaaattctcaatttaatacactttactgctttccaaccactgttgagtactttcgacgtatgccgctgtcgtttcgacaacagctggcgccgaccgtggggacctccgagcgaaatcattgagagcgaatgccaccgaagagggtcgtgaagaagaaggtcgcaaagcgaaaggagaccgaagcaggagaggagatggccgccgaagaaggagcagagcctccgacgtccatgggcgaagctaggggagcaccatcggcttcggcaccggcgccgcaactgccaccttcggctcctgccgcttc

SEQ ID NO: 12174 - DNA, 1470 bp, Oryza sativa
tctctccagatgatcatttttctttttataaaagaaaccagatagccatcttcataactgtcaaatattaaaaagaaataggggatcaaactttcaattgagttggtccacaagacatatatttactagtgaaaaataaatctagtgatgatcttaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaacaaaaagttagaaaaatttatgtatagaaatactatatataaaaaatttaaattcaaattcaaatttgaatcgggta

SEQ ID NO: 12175 - DNA, 1501 bp, Oryza sativa
ctcccgtttgaacctgaattagacaaatcataaattttacatgcaaagttcagtacatattcactataaagtcagtactagagtaaaatcaaaacttgagcaaaaacaggattttaggtccaggtactgaattggacttaaattccatgtctcaaaactaattaaatcagaaaaaaaaattcataacttgacaacttgaacttgagtattcctgaaaattactactactcatgaactagagttttagttttgctctatgaactgtagcaatcagacaaatagagggcttaccaccggtatcaatcccacctctatgtaccatagctccagccccatcctgatctgacgcttctatataacaaaaagaaagttaattcattcatgtacttgtaaaaatatccagttattttgggggaaacattttcagaacaaacaagtacaacttctgatttaatgattctgaacaagaactactgcattttcagatttcagaactgaagttaaaattcaggacaaatacaagtacaacttaagattttagatttcagaacaagcacaactatattttcagatttcagaacaagcactagtacaaattcagatttgatctcttcagttcattttcatgtttcagaactaacgctcgaaaattggttttgttaatatactaggactgatttcagaacttaaatcacaactcagtttcagtacttgaatttcagaaatcatttgcacttgaatttcaaaaataaattcagaacttcagtttttagaaggtatttaggatttcaggacattgctagaattgagatggacagcaacatcagatcttgggaagaggatcctctgatgttactgttcactatgattgacatgtgagctccaccactctcgggcccacatgtcaaccaccaaatcagtaggaagttatgtcaggggatctcaatcccaaatctttaactagaatactcctacagtcactacaacttcagtcgctgcagtttcagtactagagcaaaatttaaaacatgacaacttaaattcaggcacctaaatttcagtaggtttagcttaaattgaggagttgttcattaactagattatgtactgaatcagagcttagcttctgatttcaatgatttcgaaacaaaatttcgaacctgtgattcacaacttcaaattcagaacttcgaatttagaactagcattgtgcatttaccgtactcaacagcaatgaaaccagtatgattaacagctcctccctctccagtccttgttcgccacgacacgtcttacttgactgtaaagtctaccacccgaagacagtgtactagtctatgtacgtgttggactcgttcttctccaggcttccctcgctctctttaatctgccaccatcaacaaattaactctgcactgtgcacacatatgtaagaatcctactattatcctttccccgtttccgaccaggctttccacagaaagcagagtagcgaagcaca

SEQ ID NO: 12176 - DNA, 1501 bp, Oryza sativa
cacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgat

SEQ ID NO: 12177 - DNA, 1501 bp, Oryza sativa
tgaggcaagggaggggctggccaggtttttcttttatttaagttggggttagctagaccggcctaaaagtcatctagaactactcctaatgtgtggaaccattacggataggagatacatctgtaacggctcctacaggagctattacagatgaggtgcaaccatttctaatggctcataatggaaagccattacaatcatgaggggctcgtttgtaacggctcctcaacttaaactgttacaaagttggtagatgacatatgtaacaactccatataactggagtcgttatagatcagtgctaatccctaatggcttgaatgtcactcgttatagacacgtgatatgtagcggcgcacttaagcccatcatagataatagatgtgaggatatgtggtagtgacaattaccgagtgtttttcactatttaattaccatgtgtttcgggcacaagggagagattcccttcttagtgtctgtagttttgatagagatcacgattactgtgtaaaataccatatcatagatggattttacgaaccatagtaattttacattccctgtggaggtaccataagctaccaaaaatttagggtaaaatttggtacctcctagtacctagataccaaaaggtaccaaattacaatagaaaaagtggtacctcctcaagtactataaaattgctcgcaagaatatatatactactctctccgtcctaaaatatatgcatttttagcataatgacaagtcaaacatttttaactttgactattaatagaaaaaaaataaaaaaagatcaaccatgtaaaattgatgttactagatttcttattaaacaaaatatcgtaatatgcaactcttcttatttgaaatattttacttttatagatattgttggtcaaaatagtatctcgaagatcgtgttagtcataaatgcttatattttagaacggatggagtaattcttttgatttatagatgtgagattttgacggaaatagcaaatccaccttttccagagatgatatattgtactaaacacatgcgtacgtggctagctgttattattatatattcataatatatgccagatatgtgcaagcacactttatggagctcgcgtggtatgttcctgtacaatgagatccaaggtcgaactaaagcaggtatgcaatttctagggctaattaagcaagcaaagcatatgatgaaaagatgatcaatatatcgtgtggcggatatatgcttaccatcgatgccattaccctgtagacaagctacttgaagtagaatgtttgccaggggccaattaggcacatatatgcgcacgatgtcactttggcctttcccgcttttggcatctggttcactgccccccggtgggtggctgcctataaatgcggggtgtaccatatacatgcaaccatgcagaaacgaagcggtcgcacgttcttgtgactgcacaacacaccaacacctcgatccctgtcaattctctcta

SEQ ID NO: 12178 - DNA, 1501 bp, Oryza sativa
aaataatggaggaatttatttatttatttattatttttattctaggtaaacgtgttcgttttcctggccgccgcggcttctcctcctctcttcttctccgcggcgtccattcgattcgccctcgattataaataccccctcccccgccgcggcggcgcagaaacccgcgtctccgccaccaccctccaactctagggtttcgctcccgcgccgtcgagcggccagcattgccgccgccgccgccacgcgcgccatcgatttgctcgacgactgatgtgagtgatggtgtttggagtttcgcactgtgtccgctctatttcgaactgaactgaactgcgaggtttgggtttgggtttgggttttggtcgcgttggtggtggtggtggactggtggtggtggctgtgcgttgcatgcctgccggtgtttgcgctgggtttgggggggatttgtttgggttttttccatggctgtttttttttttgatcgatttcggtggcaaatttcttcgaggaacgctacgtttgtttgttcgcaaggtgcggcggctgccgggatgtggtttgtggggttgcttgcaaatggatctactacaagttgttctgtcaaaactttgcgagtttgcagtttggatgtctgcttctcgagtttttttttctgttttctgaatttttttatcgcctattaattgatgagtaacttgtgtttcgaattttcttttcgaaaaaggctatattcactaactttttcttactaaactcttagtaacacggttgtgtcatgctatgtgtgcatttaattttttttaacttctatctacctaaatcaaatgatcaaaattttagtaagaaaaaattagtaggtgtagcgttgcgcttttttttttttttactgcgtgccattggttttccatgtatctggcttaaaccgagccccaccacgcatgagggatgagaggaggtgttggatcgtacggttgtactcggacatgtttgtaagctagctagccgcggttaccttacctgacgacaattttgaagtggtttgtggcactgacgctaaaaagttgtgctgcaagtgtcgaactagtttgcaccttggtaaaatcttcgtagaaagtgtatgttgaaaatctatattcgtctcctccgaatacaaaagttcggaaaattatgttgcggtgtacgtagtacacgcaaaataaatatttatacttcaaaccgtgcatgttatataagtaacacaccaagcaattaagcacacgtctgatattttgatggctataagtttgtttcgaggtttctctcgatttgactcgtcttgaggtagcttgacgccttgacccgagtttgcaaattttgtagacgacatggggcttctgatgtttttatatgccaatatgtgtgtcttgaattcagtcaaaaaaatatgtgtcttgaaaatccatgtaatatttatgtactgtttctgaattttaattactattgcagcttctgtttagtc

SEQ ID NO: 12179 - DNA, 1501 bp, Oryza sativa
tgatattccagtcccaatttttctttttttccttcccctctgtgttgtccttatcttattttgtcttttttttttcacacgaacatgaaggaagaagagaagaaaaagggagtacaaaatataaagaaaataaatctaacatttgtgtgcaacataggatccgaagagttattgtaatttggactagaatgacataccttaacaagtttgagaacaaaatacattttgagaatttcggaatctgtataacacgtatgaacaagtttagagactgaccgtgcactttactcattttgaaaattaataaatttagagttaattttagtttttcattgtagtttgttttcagatattagcttttaaaccgtttaatgcttaatattttaatgcttcttttatttctctatgctagaaaattctccatgtttgtgttagcccatagcatacatgtccagtgagatcacaagtgaatgcttgttactaaattgaaaagaaaagaaggaaagaataatggaaaagtattgttcatgtgtgtcaataaggtgtcaacggccttgtgctcggtcggaagagcatacaaagaggatatgcatggatggaggtgaaattccatactcacctaatcaccttttggcggtcggttggaatctagcaggccagcatatgcatgcctatatttatgtcattgctaattctaaattattattattttttttcaaagttttctgtaggttatagttaggtcgatagcattcggatagctcaatttttactctctttagcaataaaggacatatctaagtagaagtattactcatttcatcttaagatataagatattttgattcgacatgatacattatagtattatgaatcttcatagaagtccaaccaaaatctctcatactttgaaaaggattgatggagtagcagctcaaacaataaaattatcatggcacgtttttcaaactgctaaacgatatgtttcgtgtgaaaactttctatatgaaagttgttctaaaatatcagattagtccattttttaagtttataataattaaaacttaattaatcacatgttattaccacctcgtcttacgtgagacacttaatccttatctttatctttataaataaagttcaaacaccattagaatcacagatggtcataggatagaatccaatttttacagagcaaaaccagagaatagaaaccagctcgtctttccgccgcaccgggccaggtgtacccaaactaccgtagccaacgaagacgcaaccaccgccccaaagcctccaacccttcgagaatccatctctcgtcgcctcccctctcctctcctctcctctccgccgccgtcccgtttcctcctcccgcacagattccgcagtcgagtcgcactccatctcccccaactcgccttcccccgctctataaatccgcaaccaaaaaccccaccgcgcaagccaagtaccgagatccccaacccaacccaagccg

SEQ ID NO: 12180 - DNA, 1501 bp, Oryza sativa
aaacacccataagagatatccctttttcatgtcacttaaaaagtcattaaaaaatttagtaggatagattaatatatgatatgtcacttcacaaatatacatattaaaattaaacttatacaagtaaaaccaaaaataacaaatttgactatgaatagaaagcgtaattcacagtcaaatttgttatttttgtttcaaattgtataagtcgaattttaactcgcatgtttacaaaaagatatatcatatattaatctatcttaataaattttttaataactttctgaacgccatacataaaatgagaggatgtcccctcaaaggacaaaaatccatttccagggtataataagaaatcttatacgatagaactattccttttacaaaacatgaaccaagggaactctaggagttatcagagtgaatcggcaacttttgtcctatcaacaaaaaaaaaaggaatttcgatcgtttaccaaaagaaaaaacaataccaataccaaaagaaaaacggggctaccaataccaaaggctggcccagcatgacttcgaacgtgtctatacaggatggtcccacagctaccaaccgtgggctcgggccgttcgtcggtcgcaccagaatgcaaaacctggtcgaacccaaccgccttcgtccggtccggacggatccgaacccaaagtcggcgggcgggatgcctcaaacccatccccgcctcgttggcgggaacggagccccgcccacttccctcttgctaaatacgcttcgtacgcgtggtcttcggtaggccaccggaactgtgaccctgacgctgggacccactgaggaaaggctcgccatggaccacgttcacgggagaatccctcgcgctcgtgctcccgagaatttcatttcgtgctgcattttttcacatgcatccctgacacgtcagtatttcgttccatagcctccgatcggctatgaaggcacttccacttttgccgctggtagtatttctttttgagacagacatatcttttgctgctgtcctcgaggattttgtagccaagcccgaaaacttttgggaaaattagtatcaataatgtgcttttttgcttaattaaaatttataatattttctctacgagttcacatagttatttttcagttaggactcaatagaagcaacgaggcttaattatgttgaattccactagagattacttttatttgcagtactagtagaatttagaatgaaataaatagctaatacttcagaaagtcacgtagtttgcattatgtcctggcaaaaaaaaaaatcaaaattttagaacgaatgtaagattaatatgcaatactgcaatagaaaaggggcaaaatgcaaactgccaaaaaattgcggatacaaggccactcgtataaattagctgcgctctcctcccttttcccccaaatcgctcggtccttcgaacccccaccgcctccgtcgacacattccgcgctcgaatcgaatctacgaaaccc

SEQ ID NO: 12181 - DNA, 1501 bp, Oryza sativa
gtggtcccctccgacgggcggggcccttgcggccagtcgagggtgaggagggaggtctccggcggcggcgcgagctcgaacgagacggagatctccttgccgccggaggtgcgggaggccaccgacgtggtgcggtcgccgcggaaggaatccctccgggcaccgacccgattcaggatcacccaggttgggttggagtcgccggcgccgtccaacgacagggctgaggaggaccgcttcggccgcccgtggccgccgggaatctccgtctccttggtcggcgttggtttgcgccggtgtacggcccgcgaaccgtcggacgatcccttgcgccgcctgtggctgggaatccgtgcccccgtccccgtctccgtctccgtctccgtggggatccgcatggcggcgccggcggcggcgagggtttggtgtttggtgcgcgaaagggtaaatcaaaggcgagagaggccgcaccacccgatcagttttcggcccggggaaagttggctcgttcttcgttgcaaccctatacagatacggggtgatactgtccgattgattgtcttttttttgtttaccagccgaattcctgaccgttcatctaagtttaagattggtgctttatccggggtcgccattttgcatagattgaaccctgttttgtctctccgctccagctactctactctacggagtaaacgaaactgtatatttacaaacaaaaagtaatttctaaataaaacttttatatatgtgttcttatcaatctaaaagtaaaggctaaaaaataaagtttgataaaaaaaacccttaaaattagctctaaatttaaggttaaaattttaaaatttgactaataagtataagcgaaaagataatatcctagtgcattccttctgaatccaccaagacacccacgggaggttgacactgtcgatgagacgggaggttgacaccgtcgatgagatggccatatatatagtcgtcactgacaatgtgagtctcttttctacactttggaggcaactagttaagggtttgattcgtttctaaactcgaatggcttggcattttgtttgccccaaaacatgggtagtgttatttgggtattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtagacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatc

SEQ ID NO: 12182 - DNA, 1501 bp, Oryza sativa
tataaacattaccgaaaataaattgtgggaaattcccaaaggcaacgagtgctagatacagaatttgcattccaaaattccatggccaaatcaattaacagtacagccatcgccaagcgctccacacaaggacacacatgcatcacccaaacctaagggaggaaaagcacgcaacacaggcgcatgcaaagggggggcaatgcatacacgcatcgatcgggggggatcgacgcggcggagaagaaggagaggaggaggaggaggaggaggagaggaagcaaacctacctttgaggcgtccgaggttcccgtcgaaggccgccctcaggagagcgctctcacctgcgaacaaaccgagaaatcgccattagaccacatggccgaggagctagcaagccgatcgagctaggaggagatgcggagaggtggggggaggctggacgaactggtgccgtcgtcggtggggcggcagtagacgaacggcgccgccatggccgcgaggagggaggaagcttgcaggaggaggaggacgaggagcggagtgggtgggggtggggggttttggtttggttttggtgcactggacccggtgcactcgtgggactcgtggacaaggtgcacggagccgttttgctacactacctctcgctgtctcgcagatagatggtctatgagtatgacatgggtggcccattgcaggggtctaggccctgtttagtttctggaaaaaaaatcgcgctgttacattgaatgtttggacatatgtataaaacattaaatgtaggcaaaaaaaaaatcaattacacatattacatgtaaattgcgagacgaatcttttaagcctaattgcgccatgatttgataagtggtgctacaataaacatttgctgatgacggattaattaggcttaataaattcatcccgcagtttttctgacggaatctgtaatttattttgtcattatactacgtttaatacttcagatgtgtgtccatatatccaatgtgataaccaaacccaaaaacttttcccaactaaatagggccttagtttcgggaaagacggactcccctgacagtaacataagagagagaagcgggttgtctatgtcggactctcttaggttagtctctttttgtttagaagggatggagtataccagtacagatcttatttatgtgcatccctcgctatgactaatcttgtctacaaacctacggtggattggagttctgtagcccctcccctgtcacgcactgaaacttgtccccttttaccccatctctttgcttgcatacatttgatcccaaatgcagcatatcagagagagaaagaaatcagatccttcaatctaaatagctatcaagaactccataatacccaaataacactacccatgttttggggcaaacaaaatgccaagccattcgagtttagaaacgaatcaaacccttaactagttgcctccaaagtgtagaaaagagactcacattgtcagtga

SEQ ID NO: 12183 - DNA, 1501 bp, Oryza sativa
taactacatttagtgggaatgaactttatagatatataggattaaaacataatacaattttatacgtaagttatatagtttactaatattgttacattgtaattatactatcagtgtcgttaaaatgtaacaatgcgtaattacaatgtagttactaagttacactattactttcactattactttgatatagttacatttgaaagtttttataaaaaaaactttgtgatagtttttttaagcaatttccttagctttatatttattaatttgccaccaaagataaaaggattgttaattttatcccactttagaaaaagtaaagtagcacactatgacggcgtcttgatttttcataaccaccaactggttgaatcgaatgaccgagatcttgttagggcattgcaagctacttagatgcgtgtatttatgtgtcaaatatgcaaagagcaaataattatggctacacctcctacagcgcatagcggcaagcgaatgtctatagcttcagatgagcatagagttaaaaaggcatatgatgagatcacgcatctaatacgggcgtggagtcgtgtcgcgtggacatctgatcttggacgcaggcgaggtgcaggtcatccctgtgaagggccggacaaccaactgggaattcgactcacatagacgtgtacgcgtttttcttacgtgttcactgcgaggccaaacaccatgtatctgcattgttagggcctttacaatacaggtcacgtataggattggcgcaagaggccatcaagatttaagacctagaaaagccacaaaggtccatggtgcatgtagaaaaagtggaacgaagcctcgccctcctaacgcgtctgtagccttatctcccctcgccaagaacaggtgatcaaagaagatcatgcgggctttaatttggtaggcctgcccacaaacgtggcaaagattgacaccgaatctctgacgtgaaaagaccgaactgaataacagctcaccgcattgtaaaggcccttactaatcttagcaagagtttggtagaagttttcaagtaactcttgcactactatgctgagaaaaaaagtagcgatgagctgaactcaataaaaaaaactgacgaactgaataccatcatatgtattctataagcgtaaccgtaaagagaagtcgcacatgagacatatcagttcacatgtcccatgtacgtaaaagggtttaagtattagggcctcattgtaactcaaatttaataataaacacaattataaaagttttaaatgtaaattattattttattgtctttgtttatgttttaggtaggtctgtttgcaagagttgtaaccagggtttcccttaccgccggtaaccgcgcggttaccgcagttaccgagcttaccgcggaggtacggtaatataaataccgcggtaacctccttaaattcaaataaattttaaaaataatttgaattttttataaattttacatggttttgtacggtttttc

SEQ ID NO: 12184 - DNA, 1501 bp, Oryza sativa
ataggaggagttccgatgaggaaagaaccagagttctacatggaaacgacaaggactactcggattgtatccatattagtttccctagttatacttggacaagggggaacctatgggtataaatacaagcccccctaggaggacaggaggacacacactcaccatgagacgatcaacacgatcaccactatcgggacgaccacctcatcaacacccaacacaatcaacatacaagcctacatacgccaagacacgccgccggatatcgacttcagggataagcatggctattcccctacggtgtctccggataccgtcaggagatacgaaagcgctatctctgatctcgccggacacggattcgaggaggaaggctaccctgttgtcgaatacgagtcagaccttcagaccgccatgtcgacaacagttagataggctaccctacatattgtaggggtgtgattatggtgaataaagagcatcatcggctccgaccaacaggatgtagggttattacctgacaactcaggggcccgaacctatataaaaatccttatctccatctcttttatctcagtctcgcgtatatcctagcaccgacgatccccatactatgcaaataccagaatgacgacatcaaacgtcgacaatagtgatttaaaattttaaaatgcacctaaaatgtaaacaatgatttatccatacattattgacgtaatcataaatatacatccatgtaattttgaagttaagaatactcaattttaagatccagagatgtgtcaaaagaagggcctctgtgtttgatatagtctatttcaaaatcttcctggcgggccttctttaattttttttttttaaaaaaaagaagcttcctggccaccgaacgcatgcaaaccatgccctttgagactttgatcgagtgcatgcttaattacttacctcgctaggctacgacgaaatcacgacaaccacctactcaatatatgataatcgaatcgacaatcttcctagccgccgaatgcatgcaaacgtgcctagtgagacctttaatcgagtgcttcagggtacgacgaaacacggatgagtgcctgctctgctcaaggtcaatttcgttccgcgttgattaattagtcagttcgttaacaacctcgactactccatatgcccaattaattaagttaaccaactcatctaatgatgattatgtaaatacgcagggcaggaaacggatgcgcatgtccgggaaagactggagagatactttgaacttcaagatgtcgtcgtcagtttccgtggctggtccaaaggctggacaccatcgccacagcagcatgcaatgcatacatacaactaccatattcatgcatgcatgcgtttcctataaatacattggccagatggccatctcagctcaggcaaagcagcagcttacggcactgcgcacacgaatctcaattagctgtgtgtgttcttacgcttgggttggcgattgaattgt

SEQ ID NO: 12185 - DNA, 1501 bp, Oryza sativa
tcatctagccaccacattgcttagttaattatggaccaaataatgtaaaacctgttagccagggtggctagctatctggtttgtttgcgtctatcaactcttagactgtcaattggtcgacatctacgcttatcatttctccctctactattgctgacgccaccaacgcccatgtgaacaccgaagaaggagaaagcgatggcttagcatgtagggcgccgcactgccggagttggtgtcgtggttggggaaaagggataaatgaagggaggaggaggagaagagaagacgctagtatgtaggacatatgtctcttttttattttatttagtgatggggctaccacgtggacaccacgtcagcaaatactgccaatactgctctgagagtctttttaaccggtgtcaagaattggagttgttattatatccggttttgtggttgagggatactcactcctttccaaatttatcatcatataatggaatccaaaatttctcaaattgatcatcatataatcacatggacacgaatttcatcggaataatgcatcatgggagaatgtgtgcatgctaaggtgtaattagtatggtgttttaatcgatacatgtattgcgggagaatatgtgcatgatgtattaattgatgcgatttaaattatctttggtcttgatgtataaacttatatgatgatcattttggatggagggagtatagaagtatgaattagatggacatatatttgagagagttaaagtggactttattctccctgacgcttcggcacgaattacctacaatgggctgtgacgtgctagcctgggtcggcccaagtcccacctctggcttacgcaatgctccctccctagtccgatgtccgatctcccctcggcctcggcctcccgtctcctcggctcctcgcccacttcgtccgccgcctgcgctgcgccgagacgccgccgatccccatcccgcgagcggcggggccggcctccatcccgtgaccgcgagcaggagcgccggcgcggggcacgtgctgctgcttccaccaatatcatcgccggtgagggcacccggtacggaaatcctcttcctcatttatctctacccacacgctctctctttgcccttaaccttggcttctcttgtagatctggaagcctttttctctttgccctaaccaatagaagttcgtttccaaatcaagattttgggggttcaagtaaacccccatgcccaacgtaaggtccgcccctaaattaccatgaccgcatattttcactgttttgcatttgtacctatagcctgtggttttctatttacattactttcttttttttacaaatttgcagaacttgttaagccataggctctggttccatatgagagaagatccatatgctcttttgagatagtttggaaaatggcatcaaagaaagtataagtgggttatgtcaagaaggcctgtgattttctagaatcaatttggtgagccgaatga

SEQ ID NO: 12186 - DNA, 1501 bp, Oryza sativa
cccagttgcactccttcttgacggccgccaccgccacgcgctcctccccagtggtggtcgtcatcgccttccgcctcggtgccagggcgacgtcagcggtggcccagccacatccttgagggggaccaagcagaggcggacctggtgagtgaaggcatcgatgtgctcctccgtcatgggcacggtggtcatggtgacggcgaccccggaggacgccatcattcccctaccgtgctcccctggctcactttctccgccattgctctcaaattctcgaccgactcccccaaatcaaaatcatcatatctgagcccggtgtcgatgtcagtcgcccccctctactggtgcggcgagatgcgccagccctgccccccagcttccttcactggctcctcccgtgtcgcttgtcaccgcctcaccctcgacatagctttttttaagcagtggcaacgaggaagaagaggaagagctggcaggtgggtcccaccattttttaagctgactggaccgccacgtatgatccaaattcgcactgagtcaagttagggggtttttcatccatattgatagttgtgggttaaagatgtctggtttttaggtttagggggataattcatactcatccaatagttgaggggtgtaattcggacttttccctaaataaataatgcactctataatatagtttaactttttttaagtcaaacttcttaagactaagtttataaaagaacaacaccgaacaaatattccatcaaaatatattgactgttggatttaatgaaatttggtgttataagaattgttaacttagaaaaaattaaagcctggccaaacttacataaacggaggaagtgctatttttaagttaaaaactaaatggattcgctcaacgcctcaacacattgttattacttgtaacggtctttgacactattaagtattaataacaatcccgaataaaaagtacaaacagcatggactatgagtaattttactgttcttaaaaatgtacccgaagatgataatataaatttggtacctctagatatttggtatttcgtggtgtcaaattttttagtgtaaattttaatacgtaccagtacttttccaaggaaagtaaaatatcttaaaaagcggcacagctacaaaattagagtactatacgctactactcctctaatgcttcatctttgcatgactccatggccacaactgttaacacctcattataaaccgggggctctccccctctctctctctctcccctctacatttgcctcgatgaatacaaactcatccacataaccccaagaataccgacgagtgctcattaacccaaataaaacaacagatttaggggacggcgaatcggagaagaagcacgcagtgagagagagtgcgcatgtccgcaattggtgactccatcccggccatcttcctccctctcctttcatcttccaataaaataaaatgccggtggccgactgcgaaagcggtc

SEQ ID NO: 12187 - DNA, 1501 bp, Oryza sativa
aacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccgcctctgcttggtccccctcaaggatgtggctgggccaccgctgacgtcgccctggcaccgaggcggaaggcgatgacgaccaccactggggaggagcgcgtggcggtggcggccgtcaagaaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagt

SEQ ID NO: 12188 - DNA, 1501 bp, Oryza sativa
tgaaatcctgagattagcctatgagagttgccaagtcgtcagttgttggattcttgctatattcggttaaggaaattgatctactaaaggaagcttatccagaagagaccgagttcaaagagaatgcggcatggcaagttatctattaattagtaatagtttgttagtttccttttatctttaggaaagtgtatttagtgtcctataaggactttatcttttccttttatctttaggaaagtttctttcttgttcgacaaggacttgtatcaacccatgggtataaatatgtacacccggggtctatgtaatgtaacacacacgttcaatacaatctcggcgcatcaccaccctttttgctttagttttgtttcgacgagttcttgctttcgggttgagctgcatcggtttcgatcttcaacaagaggtaaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctggcttagattatatacgatatccaccactctatgaaacttccaatggcttgattgtctagatattgtccttcttttcacacttatagctgcatcagttgtttgatcttatgagtcgtgattagaatatcaatctctagcctgcttattggttgctgattagggtagtatcagggtttcaaccgatcttacctgatttaactatacttgctttatatgctttattgacatgttaaatctgccctttatgttaagatcttattgcatttaagtatattaggctttcgtttgatatattctgcttactttaatatcttaatatagagttgtatctgagtactagccgatacatgctagatctatctgatcagctatgctataaacatatatagtcttgttgttggtatatatttcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccacggtttctttgtttctatttcttgttgattgcaggatcaaatcaactggtacgctagcatacccgaaggtgagttttggacctgcactggagttaagcagatctctcaggcctcgtgtttttcatcaacacgcaattggcacgcccggtgggatcacgaattttatatccacaagtctgaagaagaagtcaatgccaagatcatggtcacggtggagaatttaacggaggaacaacaatat

SEQ ID NO: 12189 - DNA, 1501 bp, Oryza sativa
caaggacatcctcagttcctccaagtcctccttacagagtaactggcatgtatggaacacctagatatcctgcagagaaatcggtgctattgaaaaagaataatgtgattcatcggcaaggcgtcggtcgatccgaaggcgacgcaaacatgaaccacaccggcaaaggaactgtggataagtggcttcaaatgctcatggaggatcagcagcagcaagaagatcctgcagcagcatatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccagaacgtgctccacttgaagaacccgccgccgccaccgctgccgcctccgccgcgccgcctcctctccgtgctcagcctgtccacctgagcctgcagcgcgctgcactggacctgcacgtcgcgacgaagacgaggacgaacacctcaaaaagctttgaatcgaatcgatgaacggcggcgagcggcggcggagatggccgtacc

SEQ ID NO: 12190 - DNA, 1501 bp, Oryza sativa
tgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttccctcctttttgtttctcgcttttggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaagaaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacaatgccaaattgcttaatttcccttgcccggccggctgctcccacactcccacactcccaccttaccaacccacgccaccctgctacgcccaccgccacagccgccacacccaaacccaacacacctcccgacccgacccgccccgccccccacctcacacttcaccatcagtactctggcactctgccactgccgatctcgctcgcgcgagcattcacgtcgtcgctaccgaaggaggagg

SEQ ID NO: 12191 - DNA, 1501 bp, Oryza sativa
gcccttgacgccgtaccttattggtactatggcgaagggcgtgggtgtggcgaaacctattcacccgcagcccttgacgacgtaccttattggtactatggcgaagggcgtggcgtgtggcgagaagggtcccattttgccctttcggtctgggtatccccacggacggcgccagctgttgtcgaatggacaactatgtcacattgaaaggcgtggttctctcaacaatatttggaatgtaaaagcaattgtattaattcgtaaaattttttagggatccccctattacatggccctagaggtctatttatagccttagcacaagcttgcaccttctagggtttagggttataggggattttacatggttgcccttatgaaagggacatttacatgggtacgcagtgtcatttgtacatatgggccgttaatgggctgataggctgggcctggtctatggcgaacgggcctaaaaggccgggggcagcctgttggtcctccttgatgccgaactcgtcatggcgaagtctttgtagttcgctcgagatgcctttactttcggagtaccgatgcggctttccagccttcgccatcttcgcttatggctttcgccatagggcttcgcctgaatggttttgatgtctttggcttgaatccttgctggtactatggtttcggtagatctggccgaagggcttcatggcatgcctccaacaaagtttgtctagccgatgatcctagagctaccgtgcatttcatctacagtgcaaccaagaagtaaaaggagaactgaagaagaaggcatcgcggacgcccgatgccaatggcatcttagatagtcagtagccatcaatttcgggaggaatctacccatgggagtgggacgcccaatgcctccaaaaaataggaggatgatcaaatattgcagttgaccaacaactgaaacattaagttatatatggtgaaacaaaaaaaatcagcaactaaaacatttaaatatcttataaaacatggtgaaaatacacgttaaaacatgtcgttatcacatattttttatataatggaatgaaacatcctagtctttactcaaagagttacagccaattattacataattcacatagaagaaaactcacaaagaaagttcacgatagcagaaacaaagctaagcaaacacaaactaatagactgtaatacccggtgttcttgagcatggttgggcgaattcgagggcgatttcgatttaaatgggggaagaatgtaatgccctgagtttcgaattagtatattttggggaatattagaacaaatgcgcaaaagtttaatttttaaaccattgttcgaataagcgatcaggaatcgtggatgcatagagttcgccgagtagtgcaaatagactataagttaaaacaatgtgggccgttagatcttttcagtctccttatatacccaaccaaaagaaaaacgaaaaacaaaaaagaaaaaaaaacagggggatcgc

SEQ ID NO: 12192 - DNA, 1501 bp, Oryza sativa
ttgcacgaatggatgggagtagctacaccgctgcacattatgatatcacatagtttataaatgttgtgattagggggtaaaattagagtttgttgttatagtggatttattaaatactatagatattcaccatggtttatctaccattcttagtttgttcatatgtgtcagattgttgccatcttagatccttgtatctatatgtcgaagcttccacaataatttttttataacaaaaagaatctaatgtaaaaatttcatcattttcacatggtcgtatggttctttagtggcatcccaggcttttgggaatttctggggtgttacagttggtatcagagtgtaggctttagattctagggaaaacaatgattaacttgacacacatgcacatataggatggctgtgggtttgcgacttgcatccaactattatttttgtattgcaaatgattatgattcccatatttcttaatgcctgttgtagatgttccttatcttgttgtattggtaccctgatgtggtttatatcgttgctcatctgcgtaaatagagttacctttccatatgctttgtacaagtacacttgtgttaatttttcaccatggttgtttgtcatcattaaggcgttgtatgtatgtgtgtgatcttgtgttgcctttcactatgtttttatttgtatatcattaagattttgtattcatatgtgatgacgatgctaagaggtttttgttgttgctcttgtctgttgggcctgttttcttttcctacatagtaagtgtaataaaacaatgtatgtgtgttgagtgctagtgccttctattgttctgtctcaattgttagggtcacaactatccattttgagaaaaatatttgagtgatagatggactagccaccatgccatgcatcttaactacttgctaggctggatatttgtttgagtgctctttttagtgatgatattttcagccaatcacaatatcataatagggggttggacttgagtgttccaagaaggctgtgagggatagatgaaaccatatttcgatggaatgtttgcttgatgctttgagaacgagtgtacaagtctaatgattgcattatcatgttattatgtttgcttaaagtttttatggtggttgacatgctttaatgttttgttttgtataatgtttgttttgagtggccacaaaggtatctttgctactgattggttagctgttagcctagttgattgtttgatgggcatttgaggttatggtctacctattatgtaaaggttgttggtgtgttcattgtactcttctttgtgtttgttgttggtatttcttaacgacattactagaaatataattcccagcaatggcgcagaaatacttctgatatattatggttacagagttcatccgcagaaacacatttcacccgagagtattctaatggtatcgtatttattttatcccgtgggaagatcatgtagagagaacattgactaataatt

SEQ ID NO: 12193 - DNA, 1501 bp, Oryza sativa
caaaatcacctcgccatggagcattcgactgctcatattcatcttgcgcgactattgttgcagcaacgatgatttcatcactggatgaagatgattcatccaatagaacatgtctcaaaatgaagatcattgagtgatggaagaacaacgcacaataatgtggatggagcaaaaagatatgagtacctactttacattatgttcatgttatactgaatagacggctagcttatctgggagatgctttggtgtgggtataatgtttgcttatgcaattactctatgtgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttgcaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttactattttttgttgttgttcgcatataactacgcggcactattgaggcgattgatgctggtcatggactcgaggcgtctcagctttccggtcgatcggccgcgagtccactccgccggcttgtcctcgccaccgccattgctgattgcaacaacgacttcaccaccggcctgcctccgtcgccgccgactggtgttcccgtctgcatggctggcctatta

SEQ ID NO: 12194 - DNA, 1501 bp, Oryza sativa
  unsure (1)..(1501): unsure at all n locations
ttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccccaacctatataagnagggcagggagccccctctaggggcatga

SEQ ID NO: 12195 - DNA, 1501 bp, Oryza sativa
tggagatcggcgtcccactcactcccatcccccacctcatcggtggattggattggataccagtaggggggcgatcgctcatcgctgcttgtgtgcatttcttctggtaggattgggggatttactgcgtgaccgtggtgtgatattatgttcgtgttcagtgcattgcttcttcttccaggaagagatatcaactctcttttattaatcgacacgcgtcctgtgtgttcttctttttatcgcatcgtaacatcgttaatgatgcagggtggttatccgcgttgttagaagatactatatggattgtaaaatctatagaggattgtttcattttcttcttattgttgctaacattaagaagatgctaggataggatcataggatggtgtaggtcgacactgaccactgcattgctattcgcgcaacgccaatcttttagtacttcacttcctgcttcactcctctgtcaaaagtcgatgcttggaattaaattcttctggaaattgggagcttcttcaaagaatcgtgttgtcctgaatttctttgtcccgtttggcattttcctttttttttatattgaatgactcaagcccatctagtgtaagtgtgtaactgcgtgctctaacattttcaactgaaccaggggatagttttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaccaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatca

SEQ ID NO: 12196 - DNA, 1501 bp, Oryza sativa
cttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggcaataaaattattaaacgagataaaaaaaatgatgtagcttgatttataaaaaatacagatttaaatttcattcataataaataaagataaaaagttatatacatatttaacaaaatttacctgtatagctagagaaattatattgcaactatgtaattacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatc

SEQ ID NO: 12197 - DNA, 1501 bp, Oryza sativa
cccagttgcactcctcctcgacggccgccaccgccacgcgctcctccccagtggtggtcgtcatcgccttccgcctcggtgccagggcgacgtcagcggtggcccagccacatccttgagggggaccaagcagaggcggacctggtgagtgaaggcatcgatgtgctcctccgtcatgggcacggtggtcatggtgacggcgaccccggaggacgccatcattcccctaccgtgctcccctggctcactttctccgccattgctctcaaattctcgaccgactcccccaaatcaaaatcatcatatctgagcccggtgtcgatgtcagtcgcccccctctactggtgcggcgagatgcgccagccctgccccccagcttccttcactggctcctcccgtgtcgcttgtcaccgcctcaccctcgacatagctttttttaagcagtggcaacgaggaagaagaggaagagctggcaggtgggtcccaccattttttaagctgactggaccgccacgtatgatccaaattcgcactgagtcaagttagggggtttttcatccatattgatagttgtgggttaaagatgtctggtttttaggtttagggggataattcatactcatccaatagttgaggggtgtaattcggacttttccctaaataaataatgcactctataatatagtttaactttttttaagtcaaacttcttaagactaagtttataaaagaacaacaccgaacaaatattccatcaaaatatattgactgttggatttaatgaaatttggtgttataagaattgttaacttagaaaaaattaaagcctggccaaacttacataaacggaggaagtgctatttttaagttaaaaactaaatggattcgctcaacgcctcaacacattgttattacttgtaacggtctttgacactattaagtattaataacaatcccgaataaaaagtacaaacagcatggactatgagtaattttactgttcttaaaaatgtacccgaagatgataatataaatttggtacctctagatatttggtatttcgtggtgtcaaattttttagtgtaaattttaatacgtaccagtacttttccaaggaaagtaaaatatcttaaaaagcggcacagctacaaaattagagtactatacgctactactcctctaatgcttcatctttgcatgactccatggccacaactgttaacacctcattataaaccgggggctctccccctctctctctctctcccctctacatttgcctcgatgaatacaaactcatccacataaccccaagaataccgacgagtgctcattaacccaaataaaacaacagatttaggggacggcgaatcggagaagaagcacgcagtgagagagagtgcgcatgtccgcaattggtgactccatcccggccatcttcctccctctcctttcatcttccaataaaataaaatgccggtggccgactgcgaaagcggtc

SEQ ID NO: 12198 - DNA, 1501 bp, Oryza sativa
tttactttatatctgtatcggtacagtcgtataattagcctaccagagaggtgtagtggtgtgtgtttaatgcccgtttactcggttactatatgtcatctcgggggatgtagagtagtatttaataatgtagacgtggtgtctagattatgaagtaggcacatatgctacgggtcagttgaggtgggtcgctgatggtgacagctcagtacaggtattcctccaagatagtatatattcctaagaaactttcctaggagggtactccttcgtatttagccccgattgaacggccatgacaggttatcgtaagaaactcggcaacctggagtggtctctcgaagcactaggaggtcactgttagagggtactggctatatggttgtatactagcaggtgtaaactaaagttgagtgtatattagaattataggaattgatcgttcttctatttcttcttccacttagtttaggaatgattaaatgagatatatgagtgctttgcttcgtgtcactctacccgtttgccatatcttaacccctgcctagactttgattatacaagtggcatgtatacattattagcatagttctctattacaatcttcccttaggattaaataaattaatacgataccttggaatacttcgggtgaaatgctacaatagtatatccgtgcgtttgcggattctttctttaaaccaggatcatttctagcgtcattgctgggaatttatatttctagtaatgtcgttaagaaataccaacactggtggcgctggcaacgaaggcgaaggcgggcaacgttgcacgggggcgggctggcggtcggcgcatacggcctgtgaggaggaacgcggccgcgatggtgagcagtgcgaggaccacggcggcggcggcagcggaggtgaccacgatgacggccttgggcgtgtcaccgcctcccctacgcgcctacgggtctggcttgctgggtgacgacaacacgttggcggcggcggcgcggggagcagccgggctgctgttgtccacgtgggtgggaggggagggagatcgaaagggagacgaggtggccactgcctgcctctccgccaaagtcccacctcgctactgcctccagccactgtccgcgtctccgccacacgccgcctcgcccaccacggccaccgccgtgtgcaccaaccaccccttccacctccatctcctcccatttcccatccacctccactccccctccttcttccgtctaccttccccatcccatgcgtgaccgcccgcccccgcccactatccgtccctatgccgccgcatacctccctgcccctgcacactgccccgtgaaagagagaagagagaggagagagagaggaagaggggtatgacaggtgggtcccatattttttaataaataaaatgctgactggattgccacgcgtacgtcacgtaggacaaaaccactctggattgggtcaagggggttaattcgtccggtattgaaagt

SEQ ID NO: 12199 - DNA, 1501 bp, Oryza sativa
gcagctgacggacccgagggtgaggaggcaacagtttctaccgatggatctgttggctcgatgtgatctttgttgaattcaagttaatatacgatttgttgatttatggtgaattattttgttgtgagttgatgcatagttgtggataatttgttggcttgttatgaagatttgttgatacatagtagtggaggattatttgagttgatgtatatatagttgtaggttgcgttgtacgatgatgttgcttatctgttgaattgagtttaaatttaatgattctagttggtgtgtaatagctgttgcaagagaaaatttgctgaggcttgagcccatggctgtactcagtttagaatgcattttctcaggcagggtcagcggcagcgcaatagttcctgggtaaacaaaatcgtttgccataagtcaatatttcggatttaagagcccaattcacatcttcacctggctctttctattttattcgaagtagaaacttcaggacctatttgaccggcccttaatcgaacacttctttttacaaattaacaacgaccttatgaatcctaaatatatacacatatgtgtgctacagtaattgaacagataataattctattatgtacaaagtacaaacatgataacatgcaccattaacagttaaccaaagtttatcttgtgagaactggagaaatgtttagccgccccaaccatcccgccggccgcatcatacccggcgtggccgcccgagccggagcccgcggccgccgcctttgaggcgcccaagcacgcgaaccaagacgccgacgaccagaaaccagagccggatttcttcttgcctcccatggctaataatcaaattaacacgaggggaattaacaaagctagctcaactagtacgtaagtgacagtgtgtatgtcttattaatgctcgcttaaatagcttagctacttgatgagcaccgatcgaactgactacggaatgtttttcttttgctgaaggagttgcagttactggaggctttatataggatgcatgcgagcagctgaggtaattaagctggaagctgcacacttgcttcgtgcttaattacttgcttggcgaccaagctgcaagtgagagaatcagagagagacctgcagtgttctgacttctgactctgaggatcgagagatgatcttgaattataatgtcgctatcacttgacctgaaacttggtcatggtcagttaatactcggtatatatttagtttcacttaaatcaggaaacgtgtacaattcaaattatgcactcttgtgcacaccttggcatcgatggacacgttcgaggcaagagcttgctgaccaagacatgcagacatgcatgcactaggaatggaccaggatagctatctgctgcttgttcaagaagaggagctgtagtgctgtactaatataattaacgacgatatcaaagagtgatagtactgtgataggaacgttagttgtttccttgattttaaa

SEQ ID NO: 12200 - DNA, 1501 bp, Oryza sativa
tttttcaacaaaagattacctaacggcttacggtataattaatagagtcgttaaaattaagatcaaaaccggttaatgaaagcaatcaattcactttcatggaatcaaaaactaatttacatttgtaaagaatatttttagataaaagaagataactatcgtacttacatgacgacgaaagattactttctgagcaaaaaagcaaagaaatagaaggtataaatagaacaaagtaaacagcagataattcaattgttggatgttgggtgccttcccaatcgaccatatcttaactaatataaagattcataaatttccgttcgtcacacttattttcgtccatcaatcgtgcgattccctcttccccctctcgcgcgtgtgtgcgttgcccgtctccaatagttagcgcggaaaaataacatgggttgcatcgtaatacagtaggaaaaatagggtttggatagggctttattctcagctagatatgaagcagatttgatttgatttttgggaaaacggaaagaggagaatataaggattgaaacccctcaactaatttcatattatcttaaaggatgcggccgagttttatgaaggcggtgacatcgggaggcgtcgggaagatgaggaacttgacggaggtaggggatgacactgtagtgatgggcccacacgacagtgagatagggagggtaattagtttttcgttgcttgctgggtcggacgcgtgtccgcgggccgaggaggaggggagaataaggaatgaaagcgggccggctcggctgtggactgagggtggccatgggctgaaaatggcccaggtgtaatgaggattttatttagattactatttaaataaatgctgaaatgatatttgtattattaaaaatagcaattaagctctgaaaattccaagaaaattccagaaagtgtaattaactatagagaatttaattaaaattaaatctagccatatcaattttatttcctacactaactttacttttcaattaatttaaacacctacctacttaaaaaatacttaaaaaatacaagtattccagaaatttgtattttagttaattaagtaaatctttcttaactcctcctcaattttctcatcttttcttcccgttgcaacgcgcgggcactttttcttgaaaaaaatcaaagatgatacaaaatcctaatcgtgaacggagtacaaatcacaacataaaaaccgaacgataatcccaaaaaaaagaaaaaaaaagcggcgtcacctatcatttgagacttttcctatcaagcaaaagtaccaaacagtgtgaaaataactttggctaaaaataaatatttttagttttaatacactgtagcgaagcacgggtattttgctagtatacctatagatacatatacgctatgccctggtcttttgacgtacatattctacatgatacgtttgcaatatctcagtctattaaaagacgatctgataaaaaaaacctcctcaagt

SEQ ID NO: 12201 - DNA, 1501 bp, Oryza sativa; identical to SEQ ID NO: 9974

SEQ ID NO: 12202 - DNA, 1501 bp, Oryza sativa
  unsure (1)..(1501): unsure at all n locations
ctccaccctggagctttaaaagcagccaatttgaccttttctttttgggttattataagaaattcagggtgcacacaaacacaatggacgtaaatagtcggtgctttatttatgatttatgtattgtatttaaaccctggcaagaattgctgtcaaagcctttcaatgctctatagtgcacgtgttctctgacctgtgaataaaaaaaactccaacgaataaataaaccaactcgagtattttcacggaaatctattatatccgcnnnnnnnnnnnnnnnnnnnnnnnnnnnnnnnnngttctttgctgaagttaattcgcaaatcaaattttcattgtgtaaaaattaaatcatgagaattatattgtgattgtggttgaaacgctcaagcttgctgtcatttttaaataattcaatctcttactgtcaattttaaatactaggagagctcaggttaggccatctactttcaacctattcaccggatgtggttcgaaacgctcaagcttgctgtcatttttaataattcaatttattgccgtcaattttcaattctagcggagcttaaggccatcccggcccaaatgggtgccgttggcgaggagccttgttcacgccgttcggctcgccatcgcttttggagccggagccatctagtgcgctccctagtagaggtacgtgcctccctgtgctcctcggctccttttcatcgagccatggagctaggctctgtgttgggcgatgtcatgcctagcctcatactcatggacactgctcccgcaccagagatttcttcttctaccctcggccttgtcgctaggagtaggaacacggcggtgggaaggagtcagaggcggtgagatgatggaggagctgtcggcggtcctggtgaagatggatctgtgatacggccgaccagatctggcctcctgaccagccgctcgtcgtcgaccaccgcgtcctgcgccccgctcgatgtcgggcatcctgccctgcgtgttgcttgccgtgcggagggagagagaggcggcgacgggcggagggtgagggacaacgtgggagaggggatcctgttaccgacgtggtggatggcgacgagcggcgggagagagagagggagagcgaggcgacgagaaaagatgaggccacatggggtggctggctggcgggcggagaaaaaaaaaagaaagaggagaccaggctgtgaaatatagtagggacacacattgtggctggattcgagtactttcaaacagttgcctcagattttgtagggcccatttaagtgtgtcttccattgggagatatgtatcccatgccgtgtatagtctcgggttgtatggctcacctgaggctacttatagctatggctttcgttggggatgccctaagctatgcagtttcctggtcatcccttgggtgaatctatatcaggctactgggtatttatataatggtagtgcgagtgcgcataggggttggcaagctcggatgcagcca

SEQ ID NO: 12203 - DNA, 1501 bp, Oryza sativa
accacctctagacccacctcaaacgtactgtgggatatgcatcaaccactggagattaattacccaggcaccgcatctacgcaattaataactactttagtgccgatcaaacactaaagcaatcactataaataaatggactatagtgaacaatgatcccgtatgctaattaggaactaaccaagaagtaattctcactaagtaaatcttaattactcagaatgatatttctattaaatcagagtaataaataaagtacaagagataagagaggattaccgacaactccagaattctttatatagctaccccactgacttttttatataagtcaaggcactgtgtgggtttttaaagcaattgattggatacaatatcgttgctttttgccacgtaagtgaacatttttattggtttaggctgattatatattgtggtcatttttctaggtggttggtaaatcctttatgagtttatttactcggattttataccacatatgccatatatttccaagtgtggtgaaatcatgtgtcttttagggacttaagcacatctgttaaagcagtgtgcgcatggtgtatgcccaatactttagaaatttctttattcacaatatacaagcttctttatagctgttttgctatgtaaattttcaatgatgtagtcaactttagattgcacgcatcatattttacaaagcagtcggtatatcactcggatcatgttattcgggaattcacaccgcatatgctatatattaatatcaagtcacttgattgactacagttatcaaaaccactcggttggttggattatttactccttgactatatgtttagcttgttcaactaatcacatagtcgggggctacacctattaggtgaatctaattgatgcacctaagtttacattcagttatttttcagctctccacagtctttagatttggtaaaagtactcgggaaaccatggcgaagatgagaagatgattgaagcactcggctttggagtaatctagttcgaaagaagattatcttttcgactgtgaaggtctcaggggctactgtgaagattatgggtaccccatacccacacggcatagttatccgactagttataggggataacttatatctatgaaatatgtaacggatcatgacttgggtattacgtttccttatatattatggaatggcctaaagtcctgatttgataatattgtaaagtacatataggaaaccgatatcgtatcggttaagatttctatcttgtaatcctgcccctcatcctatataaggtgggcaggaggccctctagggggcatgatacacaactagatcgtcagatctataatacacacggcgaattcaaatccctaaacaggagtaaggtattacctctcatcgagaggtcctgacctgtctaaatctttgtctccgcatccatccacttttaggtctcatgcgctaccccctttatattgctgaattattgtttc

SEQ ID NO: 12204 - DNA, 1501 bp, Oryza sativa
ttcgcatggcatccgaataactaaatactgtacaaactatatattggcaacgtatattatgtcgtcatacatcattctataaacatgcatagctaaattagatcatatgtaaataaaaattacaaattcaattgtgccaacgttttcatgtaaaagaatattttttttgagggaaatgtaaaagaatatttatctagggaccacactattaccttttttttgaaagaaaattggaaattttaataataagttgttgttcatctccagcttcagtcacagcataatcacgttgtgtcacctcacttaaaatagttctcagaattctcatcatgtctggatttcgtgatactgatacgaaaaccgaacaggaaaaatttcccttgagctgttggtatacttggtatgcaagagtagttttaccaagtcctccaaaaccaacaaccgagacaacctttggatgttgttgctttgactcacagccatcatcatcggacaataatttgattacttcatttttcggcccttcaatacctacaagatttgaagcatgctcaaagatagagagagccctgtggtcaatgattgtattgctggtcctgcagatggtcttctctgatctataccttgcatgcctttctccgacaatgttgatttggctcttgaaatcttctattgccttggcaattcgacgtttagtcttcatatttgcgagcgatttcttacacttactgatgaacccatctggagtggcagattcatcatcaacatggaccatgaactcgtcaataatgtcctccatgtcgtaggatagctcccttacttccgtcatccaagcctggtcttgggcatcaggattctcctcctctgacatattgagaaggaacgcatggatggccatgagttcggtagagagagacttgatctccttgtgcagccccttgaagatcgtgtacttatcaccaagcagagcggctagcttcgcaaggacgggcttcaaggccccggttgctgtgctcactagagctccctccatctcttaaaactctgtctgttttgagggcaacaacaaacccgaaaattattttccattaggaacagaaacatgaatctgttgctagctgatacagaatacatgtacgaatcatatacagggacataattaagcttgcttaagccacaagcacgcaagacagagccttaagccggagggatatagtaggcatatagcacacaaacctgaaagtgatctgtataaagaggagatgacagatcagggtcagaagtcaccacagagcagaagaaaactcaacaaaagctgcagatatatcggtatatatgctgtactatgctattagccttctagagaatggtgtcgctggaaccgatcgaatttgccagggcatatatataccgctgagcagcgagacttgacgcgccttgccggtacgacacggccgggcaggaatgagtttttgctggggacagaacttgttgattcagg

SEQ ID NO: 12205 - DNA, 1501 bp, Oryza sativa
aaagtcagtggggtagctatataaagaattctggagttgtcggtaatcctctcttatctcttgtactttatttattactctgatttaatagaaatatcattctgagtaattaagatttacttagtgagaattacttcttggttagttcctaattagcatacgggatcattgttcactatagtccatttatttatagtgattgctttagtgtttgatcggcactaaagtagttattaattgcgtagatgcggtgcctgggtaattaatctccagtggttgatgcatatcccacagtacgtttgaggtgggtctagaggtggtgacagccctcaagagcacttaagtcctccctgtccgggtacgtagtagagcgaaatctgagaacaacgggttgccagtgcctgaagtattgcgttaggattaaagttaagcttttcctagacacatcacttctgaccctaaagggaggtgttcggcggtggacgctagggtttgttggatgcaacctgtagctgtcgttctacgtctattatagtttttagataataaattaaaacccaggcctttacatctaaaatggatgtacagagccatcctagatatatactccctccgtactcgtaaagtaagccgtttaggacaatatttaagtcaaaccttgagaacattaaatcatgaataactcttaagttgttgagtttgaaaatttaaaattatatgaatagatttgccttgaaaaatactttcataaaaatatacatatatcacttttcaataaatattattatagaaacaagaagtcaaagttgtgttttggagaccgtgtcgctgtgcaaaacgacttcctttatgagtaaggagggagtatatatatctgagaggtcgaagatgcattctatcccttgtcccacaattaagctcattgatcagctttcgtcatcatcccactgctccccgcatgttgcccaccttgttggaaataaaccttacacgatgtatctagtagtagctagttttacgttcctttctgttgatgcatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagc

SEQ ID NO: 12206 - DNA, 1501 bp, Oryza sativa
caggcctttgacacatcgccttgtccgattccaatttcctgttccacgcgtttcccgtcctgtttgttcgcacgtgccacgtttagcgtgactttcctttaatttcagcccgaccgatgatcccgtttggaatgttgcacctggcctcgcgtgtctcgccacccgtgcgctcgcttttgttcagtacatcgtcatgtactcgcaagccacgcgcccacgtgtgcaaaccacatgtggaacgatcacatcagttcatccaattaaaacagcagcgatctgtttcgattggttaattagctaattacaccagcactttctgttgattcgtgtggagattatggataccccatacctacacggcgtggttatccgactggttataggggataacttatatctatgaaaaatgtaacggatcatgacttgggtattatgtttccctgtatattatgtaacggcctaaagtcctggtttgataagatcgtaaagtagatttaggaaacagataccgtattggttaaggtttctatcttgtaatcctgccccccattctatataaggtgggcaggaggccctctagggggcatatgacccaacctgatcgtcagatcaatacacacccgacggaatcaaatccccaaacaggagtagggtattacctctcattgagagggcctgaacctgtctaaatcctttgactccgcatctatccacttttttaggtctcgtgtgctatcccttttattattgccgaattcatgtttagacagttggcgcgtcaggtaggggtgcgtcaagatttccgtcaataagggcgatggaaacaatttcaggaatcgccgacatctttttcggtcgaggataatctcaattagaactacgattctaatccctggtttgtcatttcaatattttatattagattgatttctaatcatatattgatttactctccgatattttgttcgaatacgtgtactggaggtcgatgagatctgccgaccacctgtgcacgactcatcgtgctgggagactatcaagcaagccatcggatacgtataggagacgtaatgtggaagccacacgtgaaatactccaattgccacagactcctgatggtgtcacaacatataaagaagcagaaagcagatggcatacatacatacatacatacatgcattgattaatacccataatcatctgcactttttatttgtttctactaccaatctcagtttgatctgtggtttattattttgcatgcacctcgttgcccgagtctaattcgatccggactcggacccgcgacctgtatgcacgcatggcagaagattggtataataatctgattgtatggatgcatataatgttcatgctacaggagatcaatcggccaaccaaataacatatgtgtgctgcatatatgcaaatatacatccacaggattaattttcttgatactaactagagactatttttgtctctttacatgtattgttag

SEQ ID NO: 12207 - DNA, 1501 bp, Oryza sativa; identical to SEQ ID NO: 12200

SEQ ID NO: 12208 - DNA, 1501 bp, Oryza sativa
tccaaactacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatggtaatggaaagctgtaaaatatctatttttttagttgatgggtggttttctaagaaacagggagttcaaaagcatgtgatgaaaattaattggaatctgaagtgttctcccctctactatacctctaaattaaaaaaaaaaggttcaaaacaatttaatattatgatttcttttttcaggcggtgctcttcagcagccatcagcgaaaattggtttccatcgatgggaatataacaaacatgcttgtaaaaatagccctatatttataagtagaccccttaagtgacagccggcgataatcgattttcattggcggtaccactactgcagatttgattttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgccctagctccatcccaaccaatgacagttgccgctcttgcaccgacctccccgctaggatcaccttccccacaagcttccttgcctctagtaaggtcaccacaccatccaccatccctaccagtttcgattcctccggtaacgtcaccacatcattcacgttctccacctacaccttctgctcaagtcccttgccctcccccttcgccacctaccgaacaaccatctcccattcaccaattaatctcctcctacaccacaatttgctctcgcccaacaagtcccacctcaccaagtaaatcaatctggccccatttctactacccttgaacatcgcaggctcatacgaaaattggtttccatgtacgaccacaaggaaatgtcaagagataaagagaggttcctgttttcaatcttcagtgggagaggttgggcaaagaagaagaaagaagatgttgctgagctgtaaaattcctagaagtcagtagtatgggccaaggatgagttgcaatcttggctatctgtagatgtgcccc

SEQ ID NO: 12209 - DNA, 1501 bp, Oryza sativa
ttttaataatggaattcattccagcctttgcttcaaagaagctacagccaaattctttagtttcacacagaacgaaaaaggctatcgttattgtcaggttggaactccaaaagtccaagatataacacacaaacagcagggcagggtctaatgagaaacatcagacattcagacgcaatgtgattattgacaagcccatctctgccccagcatacgtgggcaccttgaataagcagaagtcaaaaccaccatggtatatgtaggtgccccgttactgctagtcatcatcagcatgtacccgaaacccaatttacccaagtggtcactagtctcaagtctcaaaaaacttataggtccataagtccatgtaacttctcagctgatcatccacagataatgtatcttgtcagtattctacgaagcttctttgcagatatatggcctcctatgcacttatagcaaagaagagatagaaacagctaaccatttacagcagaggcaagaaatcgcctcagtgcgcaagaaaaaaaaaagaatcgctgcgagatttccactagctccagaccacctagtagctgacctgctgccaggtccgcataacgccgaacacctgtcaggcaaaggggcggcaacatcaaatgacttaaaactcaccggctcgacggcgatcgcggcggcctcgacagccacccggcgagcggggaggcggcggtggccaaggaggcggagcggggctcgggcccgcgggagctggagcgaggcgccggaggagcaggaggccgcggcggctgctctgaccgcgagctccatggtcgggcgcagcgcacgcacgattgatgatttcacttgcaacgttgcacgggaaaaaagacgagaggcgacgcttaggtaagttcggtgggggggggggggggggggaatcccgcggttgtggcgggagagcgtcggcgtggcgcgagccgcggccgttcgcgcggtgccggtgccggtgtggtttttgctccgatgggtcgcggattttttttttccttctcgtatggccctgtttaagtttccaaaataaaaaaattcacgctgtaacatcgagcgtttgaacaaatgcatagaggattaaatgtaggaaaaaatatacaaattacgtgtaaattgcaagacgaatcttttaagtctaattgcgtcatgatttgacaatgtgatgctacagtaaacatttgctaatgatggaataattaggcttaataaattcatctcgcggttttctagcggaatctgtaatttgttttgttattagacaacatttaatacttcaaatgtgtgtctgtatatccgatgtgataaccaaacctaaaaattttccccaactaaacaaggccaatttacgtgactcattcgcgtgccagatgccacgtctcaggtctcaactccaattaccacgcgcttacgatacctggctaagtttacagtgtaacatacgattagtgaagtattttactattttaaa

SEQ ID NO: 12210 - DNA, 1501 bp, Oryza sativa
tatatattacactattaatatatagtcccacctttttatacacataaaacattttgaaatccgtgttgcagctagctacaaatttgtaacctaatttccttcttagggcacccgcaatggttatctataggctctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttactcttctctaaggccctcttatcacattcacttgtatttatagctaacttgtagtctgttattgtactcgttctaaggccatgtttagatcccactctaaattttttcaccctgtcacatcgaacatttaaacacctgcatgaagtattaattataggctaaaaaataattgcacgtattgcgactaatttgtgagacggatcttttaaacctaattgctccatcatttgataatatggtgctacagtaaacatttgctaatgacagattaattagacttaataaattcgtctcgcggtttactgacggattatatataattagtttttttattagtgtccgaacaccccatacgatacgctatataatatctaatatgacacgttaaaacttttacacctgatctaaacaccccctaaatcacctcacctatgtaccactgtactatccaccgctcccatgtcggcattccgttctttcagctgcgatttcctctctctttttttgttatcttctccgtgggtttctccgctcttctcacatggatctttgaccggggaaaagtgatggatggatgctgtgcattttgtttggtcacttgtccattcaggttttgtttggatctagtcttagatcgtggagatcatccagtggcagtactagtactttgttactgtatgtattattcaggatggattgcacatttgattagtatttgcatgggcagaaggaatcaggcaacagtttaagaacacaggatgcaatcacatttggcaaaggctttttagctgaagattggatactcctctcaatctgtcgcctcaaacaagcagcaatgtatgcatcgcacgtgaggtcaatgggaggggagattgatgtcacgtggcaagccagaaaagaatgggcatgttcactttgatttcattttcaaccttaccaaattttaggaaagttgctaaaaaaagtgactacatttagtttgctgtcaaattttagtaactatataagaaattttggcaaactatgttaaaattttggtaatgccaaaatttagtaaggttttttttttgcaacaaagtgaacaggcccaaagaaaacgtcttcgtacatttcgcttggtcgacatggcg

SEQ ID NO: 12211 - DNA, 1501 bp, Oryza sativa
caaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcgggggatgcgagaatattagcagcgtacttcttatattaactttgggggcttagatgcttagtgatcacgatgttctatgcacaaagactagctacagtcttagttaattgaggctaagattgttgatgcagattggatggagtattcaaaaaataatccattagttgatgcagatcgatctgaccattaatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatatttgatgtaatatttttggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagtgtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctt

SEQ ID NO: 12212 - DNA, 1501 bp, Oryza sativa
acatttcaatttggaccaccctattccatccatatccaagtccggtgtgacgacgctctctctcgtggcccgatcttctgatgagggggataactctcactttgatcgagtgcgacgtttgcgatgtggctaccaaccagaacaagtctaggacgctgtgcaatcgctacaccataaacgatgtcgtaccaaccgtggcacacggttgatgatccctacaatgcaaacgagagaacactacaagaacaagataagatgcaatctaaatattgcgaataggtaattaagtacaaaggaatagttgcgattgaagtggtagatctaatcgacccggcaaatcaacacaccaactattgggggctctaaatttatagtcaccgactaatcgagcgaggactagagacaaggtgaatggcacttggcaaaattcaactaaacaaaacccaatttttctaaagggtgtgcatagacatttatagaggaaaatagatctagggttatgttctaattcgtggaggtggacggagacacttccgagatgggcctagtctattacaaggctgaaagcccaagttcggtttcagcaacaacactgccttgttttgatgattcccgttgactcggaatgaatttggatatgagactggatgcatttgaaaggtaatgagataagctttccatcaagtcgaagatcacccaaatcggagttggcatgaagatgctaggtctgtttaaagttagtgttgtctccggagaccgaactatattccacaactcattggacttgaatatcttgtagatcctctattcatccgatacattctttgacaatgttttatatttcttatgcttggttacatatacttgatggtcacatcacagtgactcaggaaccactccgcacactaactctctctctctctccattttctttttccctccaacaattggggaaccgctatattcagcaagaaggagcccaaatctagtgtcttcgctcttcatcgggtcgactcctgcctcctccttgactccctgtgtctctgtaagaccgacaccaccgaccttaatggcgaccataatgatagtgtgcatgacgagaggggacgagaaaaaagggtgacccatggaggataacttgagggtgcgattgcacatgcaaaggcggagatgagcaacgatggtggctcatggagaaagagcggtggtggcgatgcgtggagtgatagttgttggtggtacgaggagtttgttgtcgatacgatcgctaatcgagtttgttaatttttgatacgtgggcaactagtcattataaagaaatagctaattttaaagtagtaaaaatattgagataaatgtgagagtactcgtattaactttttgccacttttaagatatggtaattaaaaatttatcactcacagtttatgacacgtagggcctgtttggtacagctccaactcctcaatttaactccaggagttgggtctgggtctgttca

SEQ ID NO: 12213 - DNA, 260 bp, Oryza sativa
ccgcccatccccttccttcccccgccgccgatccgccgccgccgccgcgtcccctcctctcgttgggattgggttgggttggtgggtgggtttgggctcgaggcgaagccggatcccggaggcggaggcggagacggagctcgcgatcgtttaacgacggtaacttggaccgatcgcgctgtcccccattgattacgtcggcttttttcctttttttttttctttcttttctttctttctctctactgatactactgtga

SEQ ID NO: 12214 - DNA, 443 bp, Oryza sativa
ctaagatctgatcctaatggccatttaacaattgtgtgaattagtgattattacagcagaagtgtgtgatcattgagtatgtttattaaaattctttgaagtggtggaatttttttacactgccaccacatgtttgtcactgttgttggtatagaaagtacaaattttcattctatgtgatatcaactgtttattttcaagcccattctttggtttgtcaaggtgggaaattcaagtaaaggcttgttttgataacctcttgtgcaggatttattttcaatttgttcaaggctgttggtattgcacggaggaaattcattacctactttttttttaaccttgcaatgtcatattgataacccatgtatccccgcaaaaaaaatattgataacccatgtaatcatgtcatcaactcatgtgatatttggagtgccttggagtgt

SEQ ID NO: 12215 - DNA, 1455 bp, Oryza sativa
acgccacctccacccccacctcctccgtctcctccccaacctccagctccatggctggaaccttcagactccaagctactagtctcctcctcctcgccggcgtctgctgctccggcgagacggcgtcgaacaccttgtggccgtcgcgtcttctctctctcgtctcctcttcgtgcgcgcgtgatcgttttgggccttgggctttataaacggaaggaggaggagggtggggcccacgcgcgagggaatcatggaggtgtgggggcccacaagtaagtgggatggggacgccacgtcggacgggtggcaacgggcgttgccagctgtctccaagtgggcggctggcttgcttgctgttgctaacttgctggggttgtttggtcggtaaagtattttcgtttgcttgattgagaaaaccacggtaatatatttgttttttttattgggttgattaagtgtgtatactttgtgcctgttcagagtacggcactggttgatattattttaggagaactaagcagagtccactaaataatgacaaatacaggtattatatactatacattattacatggtagacgcatggtgttatgattgctttgttgtttatgtatatatatgagtgtattcgaaataatcaaattgactttgaggaaagacttccattacagctgttgataaaatttaagcacgcacctgcacggtttctcgtggagcaatgaaatgcatttcttgaagtaagaaactttgatgaaacgtactaaaagattataaagaacaatcagtactagaagcaaaggcagctagtaggtagtaaggagattttgtttatccctattaatctatccactactattacactacagatgaagcgtttacttgcaaggaaggaggagcgcgaggcggcgtcgcgttcgtttcacacgcacgctgacatgcgtcgccattgactttcgccgccgccgccgcggtggcgcgcgcgcgcacgcacgctgggcgacacgccacgccgccgacgcgacgcgcgccgtgcgcacgagcaacacgtacgcaagggagaaggagagatcgctatagcttccacgcgcaaagcgcaggggcacacgtgcgtgttcgacgtagacataacacggcgcacaggcaagacggcgcggcccggcgcgggcgggggcgacggctccgaccaacgaacggcgtggtggacggttgggcgcgtcgcgtcgcgtcgtgcgtgggcgaagttggtcggcgtgtcagcgcgcgaccgcgtctcggtctcggcctcgttgctcacggcatacgaagccttgggcttttacgcacgggagaagcccacatatactgattcttttgggccgtcaatctgaggcccaatcaggctcgaacatggcatatatgctgcgtggttttatattagtcccacctcgcgccctagacctgattggaagaggagac

SEQ ID NO: 12216 - DNA, 1501 bp, Oryza sativa
taacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatga

SEQ ID NO: 12217 - DNA, 949 bp, Oryza sativa
tccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacttgataccaactttgttggagtagaggtagtaggagaatcgctacaccgctggtcgaggaccaggtagtagtcgtaactcgaccacttgaagtaaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatat

SEQ ID NO: 12218 - DNA, 1501 bp, Oryza sativa
  unsure (1)..(1501): unsure at all n locations
cttaacgttttcggccgatcgatctctctcggcctctctccttcccgccactgcctagggcaaatccccgcgccgacgccgccgtatctcgccgtcgtctcgagctcgtcgtcctcgccgccggctccgcctactccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccggcgccttcgccgccgagcgcgcaatgccgtcgtcgtcacgccacgccgacgncgccacgccacgccacgccaccagcggcacgccacgccgccgccgccacggccccacaacgccacgccgccgccgccgtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 12219 - DNA, 1501 bp, Oryza sativa
aacgtttgaccactcgtcttattcaaattttttttcaaatataaaaaacaaaaagttgtgtttaaagtactataaataataaagtaagtcacaaataaaataaataataattttaaaaaattttgaataaaatgagtggtcaaacgttgcaagcaaaaactcaaaatcccttatattacgggacggagggagtaccactttcgtttttaacgtatgacacaattgattattttaaacgtttaaccatttattctattttaaaaatttatgtaagtatcgtttgctttattctgacttaatttattgtcaaatgttttttaagcccaacttaaattctttatatctatataaaagttttaaataaaatcgaatgataaaatatttataaaaaactcaatgacatcacatattaaataaacggagttggtatgagttgcaactttgaaaggtatgcgtctgacgttgagttgagcttgatcgtcatcgctacttaagtgcctcaccgaggggcagcaaacgtatcgatcgatcatcgcacattttgatcttccattcctcaatcgcctcctctccggcctaattctcctccacctcctgtgatctaatctctccccgtgtgtgtgcttctcttctcccaaattaatggcagcttcgtcgtcgctagccaagaatcgcgacgtgatcagcaccaccacctccgccgccctcgtgatcgccgccgccgcccgtcgtctacttactcctgttccccgccgcggccacgacggcggcggcggcgctgtcacgcgccgcggcggtcgtcgccgcggcggcgatcaccgtcgtgccgcggatgctcgccgccctgcagtcgccgtggttcctccgcgccggcgggggcggcgcgctcacgagggcggcggcggcgtcctacgtccaaatgtgcgccgccgcgagcccacctcgcggcgacgacgacctcctcgccgccggcgcggccatggcggcgctgctagtggctgttctcgcggcgtcctacatgctactagtagctgatcagtggacgtctcgatcggcggcgagtcgaaaatgcaggcagtaaattaataattaaaatcggagtgaggcctcactgtagttaattaactgggtttattttttattttttacttttctgttctgatgacgagtaattatattctgagtgaggggctttgcttcgccgtttgatttatttactgtacgacttccttttggtccgtagtggttcactctgtcgtttgaggactttgtattagggccgaaatcccgaaattttgaaaatttcggaaattttggtccgaaatttccaaaattttgagcaaaatttagttaaatttgaacaaatattacctaaattcatgaaaaaattttggtcgaagtaatatcgtatcgaaggtgactgaaatgaccgaaatttccgaggtccgaaatttccaacctactccgtacttctctcgatcagtcttttgtgcatgcatga

SEQ ID NO: 12220 - DNA, 1501 bp, Oryza sativa
agaatcatattctgacttggttggttgcccaaaggagatggtgcagcatcttttccttttccttttagcccggcctttgctttcttctgtccatcagggcgcttctctttgctaatggtttcctcctgtgtcttggttagatgaagaagtgtatgcttctgatgatgaaaccttggtcctcttatttccactatcctcttggactattctacaccatttaggcaaatccttgacctctctccacatgtactccaaggtgaaaggtttgtccttgttttctttttcgaatatcgcatgggctgagttcatgaccatgtcatcagattgcccactcttccaggtagctttaagtctaccatatactccacagaactttgttatatctctcttcacatcaccccaatgtgtcttcagttgcttgactgacctcttgtgtccatttgttggcgcgctggtgttgaacacatcagctacagctttccagtaaaattctgatttcctgtcgatgccttttacaggatcagttgagtaatgtatccaatagctaagaaggtgtagattctcttcttcagtccaatttatgcgtgtacgcctctgttgtcgaaacgacaaccgcatacgtcgaaagacgtggttactcaacaatggttggaaaagaagtaaagtgtattaattagagaatttttcttgggatccccttattacatggccctatgagactatttatagcccctattacaggttcttactactagggttttggttatacagggaaatttacatggttacccctatgaaagggacatttacatgagtacatagtgtaatgaggttcaagggcccttgatgggtcgtcaggcgatcgtcggcccaacagcccctaggcttgatgggccggaaaggcttcttcggcccgagctttgctttggcgaagtcgtcccccttcagcatatactcttcgccctgcatccttcgcccaagaggcctctagcttggcagagtacccgcgtgatcccttgcctctcgtcgtccttgttccgtagtcttcaccatgtggggacttcgccccgactaactttgacgtctcgggcttgaatccccactcttcgcatagctttcggcagattttggtcgaacggcctcatgccataccgccaacaagcccctcacgggcaagggtgagattggagcttcggccgagaccgtgcaaaccatgtggtatggtatgtggcgccccctttcgaccgatgctccttccaaaaccttcattgttcctacaaataaagtttattgtctttgcggctggtattgttttgccgctcttcgcctcctgcaggcggttgtatattatttttatctttcccgggccgaaaggaacagtaatgggccttctctttgtgggctttttactatgtagctcggtcgataggaatttaccgtttcgcctaccctcgcgacacgtggtgctttattactggtgggtaggtgaaccgttgcttgg

SEQ ID NO: 12221 - DNA, 1501 bp, Oryza sativa
ttgcttcgtttttttttcttttttttttcaaagaatttgtgatccatgtgtagattgagatgaagaatctgtggttcattgtatggattgagatgtataatttttttttggaatctcattgtatggatctgagatgtacatgatttgtgtatgatttgtatatttgggatgtttctttgatttggggtttgatttcggatgtataatctgtagtgtatatgattgatttgtgtatttgggatggtacgcatcccacctaatttgggagaaaataaattagagattaaatagtaagtaaatgaaaaaaaaactattgcccactcccatctttagtaccgggactaaagatcgatctttagtcctgggtatttgaaccgggactaaagatagggatctttagtcccgggcctatctttagtcccggattcatagtcccggtttgaaaaccgggactataggggggttacgaaccgggactaaaaacgatttctccactagtgattgtttggattttctaattgactcgttcctcttcttgattacaagaactaatcaactgattgtaagttttgatcttatttggaaagttcttgtggctttctgtgtggatttctctgtgtgcgccttcgaagcctcaatgaatcgagaacagtactaggggaaagaaaaaagtttgattttcctttcttgttcttgttgctgccgtttcttgttgttgctggtcgtggctttgttgaacgcgtcgctgccatcgcagctgtcgggcgccacccttgcagaccaccgagaagccgctagtgaagcggactagggcgtgcggcgacggcggcagccaagaagcgcagatttggccactgacaccactgtcgcgttggccgtcgccagccaccgacgccctcctcctctcccgcctcgccccgccagcctcctccccacccgccgcacagagaagtgagagagggaggaggaagggagagaagtggggaaaagagataatgacgttgcaggtctcacgttgacttagccactacgtcggataaaaccgaggtcaaaaccactaaaggacctaaagcgtacgaccttgtaagttgagggacgtcaaatatctggttttacggttggagaacaattttgtaactcgatgacaagttgagggaccttcggcgtactttttccttatcttggtcccaaagctccgtgtgattccggcccaattagttgtggagtcattttttcttttcattttggggatatctctactacttaaaagttccgtagtggtggcggtgactccaaacacgcgaaatatagaacgtgggatagcctaatcgaacggctcagatcgcctttctcttcctacgcatccagcgcacgcgtctccctcgaatctcgatcgctctctcctctcccctaccctcaaccccccgatccacgccgccgcaaccccctcaaccgcccgcatccccgatccgttctctccctctttcctccttcctcaccg

SEQ ID NO: 12222 - DNA, 1501 bp, Oryza sativa
gcaaccattctcgagcgatcgagaaggtgtagagtctgcgacggagccttgtcgacatttgtcgtactcgccttagtcgatcttggtgtagaaccatagagacatggagtcttcgtcaatgtcgaatagaattttcctgaaatcaatactcagaagagaatatcaaatagaaatagcccccgagcgaacgctcaaagagtgacatgttataatatatatggaaaactaaaaatgaattaaatttaccgaccaatgttttgtgtatgagcttcttctctcttaccgactttgatcagtcagtttgtagagtcatacactctccctagaccctagccttgtcgttggagaatcgttctcggaggagaaggctcttggacccttgacctgccttggttgaacaagcactgatcctagcccccagccgtgaagttggaaaactcaatttccgattacatgacttggttaatacgcacggcgagaactcttacatgaccagatcttacatggtcttttgtctctacaggatccgacaaggccttatcggctctgggcgtccccagccgaagttcccttaggttcctcggaggccttgtcaagatggcgtaaagggacagtaggataggtttcaacgctaggtgtcgtcgtggtaaggaatctctgggtaaaacacttggcgatagtgtgtacctgataccaactttgttggagtagaggtagtaggagaatcgctacaccgctggtcgaggaccaggtagtagtcgtaactcgaccacttgaagtaaaggtagtgggagaatcgctacaccactggtcgaggaccaggtagtagtcgtaactcgaccactggaagcaaatgtacgagagatcactacgatcaactggttgagaaccagtgagtaggtgtctctcgatcatttggagtcgtggtacgaggaccgctacgctgccggtcgaagactagttgtagctgttcctcaaccatctaaagtcatggtgcgaggaccgctacgctgccgtagtcatacctcgaccatctgaagttaaggtgcgagagattactacgtactggttcgagaaccagcgagcgagtagaattatctctcgaacaccaatggaagttgcggtgcgagagattgctatgtactggtgcgagaaccagcgagcgagtagaattatctctcgagcaccaatggaagttgcagtgtgagagattgctacgtactggtgtgagaaccagcgaacgtgtagaattatctctcgaacaccaatggaagtcgtggtgtgagagattgctacgtactggtgtgagaaccagcgaacgtgtagaattatctctcgaacaccaatagaagttgtggtgtgagagattgctacatactggtgtgagaaccagcgaacgtgtagaattatctctcgaacaccaatgaaagtgctagagttggtttattacatgtgtatctcatgtggccagcatgactcacatacccaacttatagcatat

SEQ ID NO: 12223 - DNA, 1501 bp, Oryza sativa
cgatattacggttgagggccccttttattcaaaggaaattcataggaattttagaggatttcattcctataagattttttcctatatagccctttgaatcaaaggaatggatcctatagaatcctatgaaattcctatggattgtcttttcccatgcaagttttggaggaaatttaacatgaggtagaatctcatggaaagaatcctttgagtctttatctctcctcaaattcctgtgtttttcttgcggcccaatcaaatagtcattcctatgtttttcctgtgttttgcaatcctctgttttacacttgcattcctgtcagaatcctatgtttttcctattcctccattttttcatttctgtgattcaacggggccctgaaagatgtgaatcgatatcgggctagagtcgagggtgacgaaacacacttgttccgctccacttcaccaaacaacccaaaatgcaggcataaggaaaaagtacatcagaggtccctcattttgtcaccgaattacaaaatcgtccctgaaccacaaaaccggatacaacgcatcccccaactcacaaaaccagtgcaaactaggtccctcggcggtattgtctccggttttggctgacgtggcgcctacgttgctcctttcactaggtcttagttccatgtggcaatgacgtggcgcttatgtggcaatctgatccaaaaataaattaaaaaaactggggcccacatgtcagttgcatgcggcgtccaggagggagcgcgggacttgcggaacggctggcgggggcagtggggcacccgctcacgccgccggtcttcacgccgctcctcctctggctcctaggcagaggggcgctttttcttctcgcgcggcttgggagttgggggttagtggacgaggccggcgagtcggggaagctgtccatgtccatgaggcggagagggagcagccgtcgacacaacaacgagggtggggagcggcgcagcgaagcgggacgcgaggcgagagagatggtggtggagcagccgatgattccaagagaaacgccgttgcaggagccgttgatctttgccgctgccgtcgacccctgcggcggcgacggcggcacggtggaccacctcttcctgcatgtgctcagcggtgatgtcccacgagagcgcatccctctccatcccgctaggccgtcacgctctctgccctctcccgccacttccgcgtcctctcgtgacccgtcccagttcggccgcattgactctggcgaccttccccgacctgctcccgtcgctcccggcgaggccgtccttcatccgccgcctcgccttcgcattccagcaccgcgggtgtcctcctccgccttctcccgactcctcgacgccaccgccgaccgcggcctttccgagcttgccgtctgcctgcaccgcaacgggttccttcccaagaacctcctctccatccgctccctcaccgtggtctcactcaactcatgcgggttgcctcgccg

SEQ ID NO: 12224 - DNA, 1501 bp, Oryza sativa
caacactatcggtctatctgtcggcacagatttatctgtcgggaaagacttttgccggcagcacttggcctgacagaccttatctgtcgggaaacgttttgctgacaaataatttggcagcatatagggcctttcctgacagatatgtagtaagcaaacttggggcatggtgtagtgttagtaacaccaaccgggactaaaaacctatttttagttccggttgatgttactaaccgggaaaaaaaaaattaaaaacacactatataatccctattaccgatcctcttttcccgtccacacaacaaactcatccctctatctctttctccctctccaacttcttatctcttccttatctctaactcctaccttctctttcctttttttttccttccattcgtcacagcgaagcagacggcggccgacgaggcggcgcgggggtccgcgcggaggcggccagcgcggaggctcggggggccgcgcggaggcggcctgcgcggcggcgcgggggatcgcccggtggcaggcgaagggccgctcggcggcggccggcgcggcggcacgggggcccgtgcggctgcggcgaccggccggcgcggagggaaggaggggaggcggcagtggccggccggccggcttttcttttttttcttttttttacaatttatgatttatcctgtgatgtatttgatttgtgtgtgatgggaatctgtgatgtattttttagaatttgtgatgtaattttttacaaggaagatgttaaaataaaactatctacatcctaaaaatataacaatttgtatcaaatagaaaacattctagtgctacaaatttatccagattcataatactagtatatatgttctatctgatattatgttgatgtattataagacaggggaagtacacaccatccattttcacagggaaaatgagaagggagagaaacttaggagaagaagagaatactaatagtttgatggctaaaataaaaaaaagatgaaatggtattaagagatctagtaggcgctataacctaaaaagatactcccttcgtaaaaaaaaaaatccaacttaggagttggatgtgaccaatatagtacaacgaatctagattgtgtcccatctaactcttaagttggtttttttgatagagggagtagacatctaaaagctaaaaatttaaaaaaaatgacgggggagtaatgaactaatgcatgtatcacttgtgtacttgtgtgaagttacgacaaccaaattagggtgacgtgtcaatgataagaacaatgcattatcttcatcagtcacctttcctagacgtgccaatttttctaatgttatgtgtacatagacctaattaaatacttatttatttaagttgctaaatttgtggacttttaattggcattgatttgtcgatcgtgtcactagcttccatgtacgattgaaggcttattaaaagtcacgtcaaattatatgaaaattgttgaataggaggaga

SEQ ID NO: 12225 - DNA, 1501 bp, Oryza sativa
tgttcttatcattgacacgtcaccctaatttggttgtcgtaacttcacacaagtacacaagtgatacatgcattagttcattactcccccgtcattttttttaaatttttagcttttagatgtctactccctctatcaaaaaaaccaacttaagagttagatgggacacaatctagattcgttgtactatattggtcacatccaactcctaagttggatttttttttttacgaagggagtatctttttaggttatagcgcctactagatctcttaataccatttcatcttttttttattttagccatcaaactattagtattctcttcttctcctaagtttctctcccttctcattttccctgtgaaaatggatggtgtgtacttcccctgtcttataatacatcaacataatatcagatagaacatatatactagtattatgaatctggataaatttgtagcactagaatgttttctatttgatacaaattgttatatttttaggatgtagatagttttattttaacatcttccttgtaaaaaattacatcacaaattctaaaaaatacatcacagattcccatcacacacaaatcaaatacatcacaggataaatcataaattgtaaaaaaaagaaaaaaaagaaaagccggccggccggccactgccgcctcccctccttccctccgcgccggccggtcgccgcagccgcacgggcccccgtgccgccgcgccggccgccgccgagcggcccttcgcctgccaccgggcgatcccccgcgccgccgcgcaggccgcctccgcgcggccccccgagcctccgcgctggccgcctccgcgcggacccccgcgccgcctcgtcggccgccgtctgcttcgctgtgacgaatggaaggaaaaaaaaaggaaagagaaggtaggagttagagataaggaagagataagaagttggagagggagaaagagatagagggatgagtttgttgtgtggacgggaaaagaggatcggtaatagggattatatagtgtgtttttaattttttttttcccggttagtaacatcaaccggaactaaaaataggtttttagtcccggttggtgttactaacactacaccatgccccaagtttgcttactacatatctgtcaggaaaggccctatatgctgccaaattatttgtcagcaaaacgtttcccgacagataaggtctgtcaggccaagtgctgccggcaaaagtctttcccgacagataaatctgtgccgacagatagaccgatagtgttgctacatatttaccgacagatagttttaccaacagacagacttttaccgacacttaagaagattcccaacagatagcatgtcactgtgttatagatttaccgacaattaatgtattgatggcaagcacaagaactaacaagcaatcagtcagtaatccacacaaaaaatatactaattaccaatcatccattttatgaaccatacctcaaattaaa

SEQ ID NO: 12226 - DNA, 1501 bp, Oryza sativa
tagagcaagcaaaaactcaaaatcccttatattatgggacgaagggagtagtattattagatattccttttctgtttccttttattagtcatgaaaaagagttagtaataaaaagtgaggacaaaaattcttttaaaaccaaattgtaaccttttaaatgagtttcggcctttgagctgaagtatagagccaaacacctctaagatcaagattgtagtcacatataaatatacttttttcactcaaaccctaaaccatatcctgagtagtagaaacacatttttctggacgtgacgagtactatatgaaatatgagcaaaatttatacagaaaaatatatctttgcaggaattctcacgtacattctatgtactcgaaacagtgtctccagaactatccataattttggagacacataactctcgtattcgatccataaataaaaccgtgtcttcaaaaccatcgtcacattgcacaccgtcaccttcctacgtgagagtttcatacgtacgtgtaacgaaatgttggttaatttccctactgccctttttgtgaacatgcaatatttccatgaattctccttacacattgttcacacccacctgtggctcgatcgtgtggtctctctccccttggtcattttcttatcttttttgtctttatgattttggtttttttcagaaacacgtaatgctatagctacagtagcagtgaagcaaaaccttctcagctaattccaaggagtctccatcacgcatcaggttcgtcaggcttggagtcgttttgcattgcagcacaatttctctgatagttacggcctcgatgtgacaataaacaggacgaaaaagacagtggggattgttgattccaaattcttgcaagattagatcagctcaaatggcagattattaatccgtgcatcacaaaactaattaattagactggagccatacacgtgtacttcaaccatattctactaatcatatttgttcctactattagaccgtgtcagcatggtttagataaacaaagggtcggtgaagcttactagtgacaaaatagtcatcaacaccctgacatttagttaaaatattgtcgttagaacaactcaacaacatatggatattgcaggcaatgccagttcacatgatctatctctcggtctctccgatatttgaaacatgaatatttattttctcgaacgcacaaaaaatttgcacgtcaatatattagcaggaaatgagtttttgttatacaaagcaatcagccagactggcttatgcctaaaaggggggacttgaagctaggaactactacgacggttaaaaacgcaactccaaacagcgggagggggcagagccacgctacactaccaagaaatcccccaaaaaaagcaacgccgactaaagaccacagctggccctccgaacggatggactccagaaccactgcgaccgaagcgagcgcagagtcgaaaaccctgaagtttcgttcctttcta

SEQ ID NO: 12227 - DNA, 1501 bp, Oryza sativa
ccctcggtggttttggagggcggtttcactgacgtggcgccacgtggcgcctacgtggtgatattgaccgagtcttcattccacgtggcgttgacgtggcagcgaaattaaaaaatatgcgtgggacccattagtcattcaaaaaaagaaatgtgggcccactgacatgtggccttccttcttcctcccccctctctcccttctctctctttctctccccttcttccccttctgtcgacacgcgggatggcaacaagagcgagcagcggcgggcggcgaggccggagctgcggcggtgggcgggagggcggcgagatcgagcggcggcgcgctgcgacggcgagggagctgcgctcggcgggagagcaagcggcgaaggaaaaggacccccaccctagacaccgcccagcctggagctgcgctcggcggcgagagcgagcggcggcgacaagtgtaagcacacgttcggtttgttttttttcttgtttctttgattcgtagccgaagttcataactgaattttccttgtttcaggacgacgtttaagaggatcctgaaggccaaatcgaccgagcgattcgatgggctcccttacctgttctcgctgctgaactgcctcatctgcctgtggtatggacttccctgggtcgccaatggcaggctgctcgtcaccaccgtcaacggcaccggagcggtgttccagctcgcctacatttgtctcttcatcttctacgcggacagcaagaagacgagcgtaattcttcccatcctgcacctaattttgtcttagaaaaatgtacttgtagactgcagtactagattgctactgtagtagcctagtgctgtacattttcagttttgtctgatggcaatatgccatcaagaaaggaaaaggatggtggagctctgcgcgctgccgccgccgctctcaccgccgagcgcagctccaggctgggcggtgtctagggtgggggtccttttccttcgccgctcgctctcgccaccgagcgcagctccctcgccgtcgccgcgcgccgccgctcgatctcgccgccctcccgccgcagctccggcctcgctgcccgtcgctgctcgctcttgccgccatcccgcgcgtcgggcgaaggggaagaaggggggaggaagaaggaaggactgacatgtgggccccacatgtcggtgggcccacatttctttttgtgtgaatgactaatgggtcccacgcatatttattaattccgctgccacatcaatgccacgtggaatgaagactcggtcaatatcaccacgtaggcgccacgtggcgccacgtcagcgaaaccgccctccaaaaccgccgagggagtcaaattgcaccggttttagaagtttgagggtcgagatatccggttttgtggtttagggtcacgtattagattttgatcacttttgagggttatcaagtgaacttattccgaaaataaatggaataagttcgctttttgtcccttatcctgatatc

SEQ ID NO: 12228 - DNA, 1501 bp, Oryza sativa
ccccctccccccgagtggttgtagtgtgcccttccccccttcccgcgagcggcggggacggcgacagcagctctctccgccccatctcacctccctagccggcggccgctccctccgccctgtctcgcctcccttccgcggtggatacagcggcgatggcggagagttggcggcggccgcaggcggatccgagggttgtggcggtgggctccctccactccctctagccttcctcccgtggcagatccgccggcggtggccacaggcagatctagctgcggcggctccctccgtcccctctcgtcttcctcccgcagcagatccagtgacggtggcggcgtccgtggccggataaggagcggcggctccctccgccgcctctcttctccctccggcagcggtggtggcgtcggcggctaccgcggatggatcgggtggcgatggcgacggccgagtgcggcggtggcaacggccgagggccgcggtggcgatggccgagggtggatccggcagcaggcaagtgatgttttgtgatgtatgttgttgttcttctttttttatgtatatttttgtgaagttttgtgatgtattttgtgattttatgatgattgtggttgattttttgtgacagagtggttgagttttggttgcgccgattttagaaagtatttccctgtatccaattctaagagcgattgggatttgggggctgcgaaggcgcaccgccgacggacgaaggcgccttcatccgtcttgtggcgaacggaaaattacgaatattttaattagttaagatttctagcgattttaaaagtagatgctaaaaacttcgataaaataactcgaaattaactgtctaaatttaatttttaaaatttaaaattttggctatgagtgataagctagaatgaaaacaataaaaggctactccaactcaataggagaaggatgtagcttttaagctgatatactcaacatcgataagtggtaatataaaaaagactcacatgcttttttgtacatcttcagtgccccgagcattgtctttgacctctagagcgggggcgtaggaaaaaaaaagaagagggatggagatggtgaggtctcattgacgatgaggatgacacctgaactctagagggatagagatggtgagatctcactcgattagatagttagggttagaggcggtgagatggagtagatttacggtgagagtagctttagagggatgattgaagtaggagaaaaccatgatgtcatcatcaaacccgtagggacgaaggaggggtgatggatggcggatgtggtggggaaaaacaagaaacaagcggttgatcagggacgacaacagatatccagcaaagcaagttgccaaagttaggggaggagagttgggcataggaatctcgtcggagttggtgaagaggagtgacttcgataacgatgaggtgatcgcgtggagtcgagataaacgtcaggcacaattaaataggacaga

SEQ ID NO: 12229 - DNA, 1501 bp, Oryza sativa
gaatcttgctcacagattcgtttggttaaccgttcactcatctcaacattcccatgagccttgcaagcagtgaggagtgcaccaaacagtggcatagcatccttgttaattggaacgtcaccgatcaacctctcagcttcatctagtagaccagcacgacctaggaggttcacaaggcagctatagtgttcaactcttggttctatctgataaacctccctcattgcatggaactgcttccggccttcatcaaccaagccaccatggcagcatgcacttagcaccccaataaacgtaacaccgtcgggcttaactttacttctctgcatatcttgaaacagttcaagagctctaccagcctgaccatttgtggccagcccacagatgatggcagtccaagctgtggcatctctgccttgcattcgccagaagacctctagagacttctcaatgtgcccacatttagaatacatgtcaatcaatgcggtgcctaggactgcatcgatcttcattttcctttgttcagcatactggtgaatccattcaccttgatcaagagcgccaagattggcacagcatgtcaggagagtgacaacagtgaacctgtctggctcaacccgttgcatctgcatatctcggaacaatgtcagcgcctcctcgaagcatccgtgttgcacacacgcattgatcattgcagtccacagaattagatccttctctttgcactggttgaagagcactctggccttgtccagctgcccagcaaggccatatcccgacacaagtatggtccaagaaattatgttcctcgcaggcatttgctcgaacaatttcaccgcctcttccaagcaatcattcttcgtgtacatgtccagcagagcatttgcaactggcagattgaaaccgaagacgttatccatgtacacatgaatcctccttcccaagctcaggtcccttgctctagagcacgccgtcaccgccgtcaccaacgtcaccctgtcaggtgtgacaccgcttctctccatctgttcagacaaagcaactgccgccgagtaccacccgcacctgatgtagcacctgaccatcatgttccacagcaccagcgccctactcggcatttcgtcgaacaccttccgcgcgatgtccacgcgccccagcatcgtgtacatctccatcagcgagctcccggtgtaggcgtcccaccggaacccggtcttgacagcggccgcgtgcgccttgcgcccctcgaccgacagcttgaggaccccgacggccctgagcacgaacgggtaggtgaagctgtccgccacgagtccccgcgcgcggaggtcgtagtacaccgccatgacgcgcgcgaagctcccccgcctcgccagcgtcctgatcagcacgttgcactcccagagcggcatcccgtggcccctcctcgccgccgccattgccatcgcgcggggtgggtggcggcgacgcgacgcggccaagacgtggggggggaatcttt

SEQ ID NO: 12230 - DNA, 1501 bp, Oryza sativa
atttcatctaataatttcttctaaattagatacctcccggaactaaacggagagacttgcaatcggctgctggctgccgcagagcacgacgtcgtcgacgcgtagccgcgcataggtatctctggctcgcagtcgtagacgtagctacgctgcgtaggttaggtcgcaccatcggaacaagacaacgcggctggaagggcgacggaataggcgatgaggcgaacagctatgagtgatcacacggaaggaagccaaatcgacggaaattttttcaggaatgtgtgcctcttcctctccttaggctagtgtgcttcctaatttctatggtgggctattatctacagcatatatgaggttgggccagctcgttataaactttgagcttgtctcagcaaagctcgcgagctttagtttgggcttgagcttgactcgtttgtggctcgaatccatctaggacgagccaagcttcgagtttttttttcttttaacacatccacatctctgggatgcacgcgtgctgtattatctatccaatttctccaactcaactgacagcagataacccaaacagtacgggttcttgtacaccatctactatgggcacacatacttagcgcatgtatcatcaccacaggggtcctgccgtccagggcaattttacttccgcatatgctgcatcgcaagtttgattccttaactacagtaacatgcagagcaagcggtctgacatgctgtcaggatgtcactgctagtactgacatgtatatttgggcaaccgcaagtgtaaacatgctcagaatggggttgtctatgcggtagtgtgtggactacctgaatttggtatacagtattctgtgtacactcattagtgcaaaacaggacatatgtgtgaggcaggaaccatcatctgtgtcggagggaggctacgtcacgtattattggtcagtgatgtgaaaagttatctgtgtcaggtcagataccgtcaccgatagcagttatctgtgtcggacctatataaaataccgtcatcatcaatagatttaacccaacagtactcgttgtagcgattgagcatcaactaatatgtgcagaaactgaatttgcaggcggcctgatcgggccacagattatcatgcatcaacagatcacaattcacgtgaacaggccagtatttcagattagagaggcagtagatttcttcccagccgtgagaaaatgctggttatggactgcaaccgctagctgcctagttcaatgatcagttcgtgcattcgtggattgttccctttttgggttcagattctgcactggctctcttcagtggatgaatttgtccatgcgcaaaaatggattggttattcccactgccaatgatttccacagccgcaatcaccaccatctacctaaccaagctcgcaattttccaaccaaaagaacaacattcagcaccaccaaatcgaaagaaatgggcaaaaggagacatcaaaagcctgacagaaat

SEQ ID NO: 12231 - DNA, 1501 bp, Oryza sativa
ccccctccccccgagtggttgtagtgtgcccttccccccttcccgcgagcggcggggacggcgacagcagctctctccgccccatctcacctccctagccggcggccgctccctccgccctgtctcgcctcccttccgcggtggatacagcggcgatggcggagagttggcggcggccgcaggcggatccgagggttgtggcggtgggctccctccactccctctagccttcctcccgtggcagatccgccggcggtggccacaggcagatctagctgcggcggctccctccgtcccctctcgtcttcctcccgcagcagatccagtgacggtggcggcgtccgtgggcggataaggagcggcggctccttccgccgcctctcttctccctccggcagcggtggtggcgtcggcggctaccgcggatggatcgggtggcgatggcgacggccgagtgcggcggtggcaacggccgagggccgcggtggcgatggccgagggtggatccggcagcaggcaagtgatgttttgtgatgtatgttgttgttcttctttttttatgtatatttttgtgaagttttgtgatgtattttgtgattttatgatgattgtggttgattttttgtgacagagtggttgagttttggttgcgccgattttagaaagtatttccctgtatccaattctaagagcgattgggatttgggggctgcgaaggcgcaccgccgacggacgaaggcgccttcatccgtcttgtggcgaacggaaaattacgaatattttaattagttaagatttctagcgattttaaaagtagatgctaaaaacttcgataaaataactcgaaattaactgtctaaatttaatttttaaaatttaaaattttggctatgagtgataagctagaatgaaaacaataaaaggctactccaactcaataggagaaggatgtagcttttaagctgatatactcaacatcgataagtggtaatataaaaaagactcacatgcttttttgtacatcttcagtgccccgagcattgtctttgacctctagagcgggggcgtaggaaaaaaaaagaagagggatggagatggtgaggtctcattgacgatgaggatgacacctgaactctagagggatagagatggtgagatctcactcgattagatagttagggttagaggcggtgagatggagtagatttacggtgagagtagctttagagggatgattgaagtaggagaaaaccatgatgtcatcatcaaacccgtagggacgaaggaggggtgatggatggcggatgtggtggggaaaaacaagaaacaagcggttgatcagggacgacaacagatatccagcaaagcaagttgccaaagttaggggaggagagttgggcataggaatctcgtcggagttggtgaagaggagtgacttcgataacgatgaggtgatcgcgtggagtcgagataaacgtcaggcacaattaaataggacaga

SEQ ID NO: 12232 - DNA, 1501 bp, Oryza sativa
ataatttttttgggtaattttttgtaccatcaccatgtacgctacccatcttctttagaaaaaggaaaatttcaccatcagataagtcgtacccatccactccagtccaaattcctacagctgatcggcttattttatcctgagtcattgactcattgtcaggttgatccaggtgctgttctttttaccagggtggtgtgttgtttttttaaggccccgtttgacttaaaacaaaacataagaatttcagctccatagaaaaaacttctctgtgagcctttgaaagaaaaagatcgaatcctatcaactcctctgaaatggacaatcctataaagattttagattaaagctagcaagaactccaacctcttacaaattttcctttgaatccccttgcccgccacgatgaggactcgcccggatctgggccgccgacgcgtgaaggggaagggagggcgtcgtcaacgaggaatcgtagtggcctgcgtgccgggcgtagctgagctgggctgcgttaggcatgaagaataaggcggcattggggcttgatttggagagggaaaccgatggcgatctcatccgcgacggcaaacggccgccggcggcgaggggcgcggagagctgggagagcgtcggactcccacaccaccgaccacagggacctgtttgcatatttcagccgttggatcaaggacctatctgaaaaattacggtccagtccactagtagggactagggactagagaactagggatcctggtggcaaaatgggccaggatacggccccaacggcccagcccagcactgcacgggcacgggagctcgtgggccgtgccgtgcttgggccgccattcggcacggcccgtttctgtagcgggccggtacggaatagtaggcgatgacaaattgttgctcggctgttgccatggtgcccttccggcggatccgtcggccggcggcgagccggcgactggatatatttcttgaagacaacaagaaaagatttgctctttcttctttactcgtagcgctgcgcggccgtagcacccaatgcgatggactacaacccgatagccctgcagctgtgactgtgaaaactcgtgagtcatgtgatcacgggcccgtgtcctatgctcggcattgaagctatacacatttactgctacactttttacagtcttctgtcaccgctgcttgccctctctgcacagcattgattatcagaaatccagacttggcattggttctcccccggcattggcaaccagccagcctccagctacacactgacactgcactccagcctccgtaggagtacttcagctcactatagaatggcaacggcaatggcatcgttacctccaggccccagctagtgcagagatttctcttcctttgcccagtttccaggcagaagcatcaggccaagagctcaagacccaaccagtgtagtggttgcagtcagtgagtgagtgagtgaccagtgagatagtggcatcga

SEQ ID NO: 12233 - DNA, 1501 bp, Oryza sativa
tgaaagtttacgtgtaggaaagttaaagttaaaagtttgaagaaaaaaatggaatctaaacatagcctaactgctatcttcgctaaagaatttgcagtagatatcatcatcagtggcaaagacagggacttctcttcagatttcagaacaaacgcatcttgtcagcgtcaacaatgcacacacaattggcaaaccgagtcgtgtcacaccggcatagaacagctagagaatcctctaatcaatcatccaaaatgctaaaaactgagaacgaaccggatggaacaagatagagagagtgtgacatttcacagcattttcgctcgatcgagacgtacgaaacagtcttgacatgtttctccctcagtcacacggcggtgacgaccatcttcatgccgaggttgcagtggccgtagcgggtgcagacgaagaagttgtcccccctggcgagcctgacgctgtcggagccggaggtgtagtacctcgagaacggcggcgggttgcagtcggcgtacccgtcttcgtcgacggccaccacgttgtgcatccacggcaagtacctgaacactgccatgtccgcaaaacggtttcagttacagctggctttgtctgatcgatgagaaaaatgttcagagattgatcgaaatgttcagagataagtactcctatgatttaccgaggatgtcgccggcgtggaacttcttgccgctgggccagctcccgctgccgagggaccagccgaggctgtcgccgacgtagtaggtggcggcgtcggcgacgccgcagccggagaggaagatgcagctcacgacgacggcgagaaacgcgacggcgacggcgcctcgcattgcactgcctcttccccgagccatcgatgccactatctcactggtcactcactcactcactgactgcaaccactacactggttgggtcttgagctcttggcctgatgcttctgcctggaaactgggcaaaggaagagaaatctctgcactagctggggcctggaggtaacgatgccattgccgttgccattctatagtgagctgaagtactcctacggaggctggagtgcagtgtcagtgtgtagctggaggctggctggttgccaatgccgggggagaaccaatgccaagtctggatttctgataatcaatgctgtgcagagagggcaagcagcggtgacagaagactgtaaaaagtgtagcagtaaatgtgtatagcttcaatgccgagcataggacacgggcccgtgatcacatgactcacgagttttcacagtcacagctgcagggctatcgggttgtagtccatcgcattgggtgctacggccgcgcagcgctacgagtaaagaagaaagagcaaatcttttcttgttgtcttcaagaaatatatccagtcgccggctcgccgccggccgacggatccgccggaagggcaccatggcaacagccgagcaacaatttgtcatcgcctactattccgtaccggcccgctacag

SEQ ID NO: 12234 - DNA, 1501 bp, Oryza sativa
gtttaaccatatcaatatatttttataaattgtgagccgtcaatacgatctttattgaatttaaatacttataggagtatagtcttgacctttttttagagattctacattgaaatatgaataataagtctaatgcaagtacttatccaagattggcttagctagcttaacctttgatggttctacatcagtgatacggggccctttcagttcagtaagtgcacattagtgttttttacaataatttctaggggtgaacagttgcaactaaataatttatggggcggctttctgtaaatttcccccaaaataaaagttgggatagtcgctagtgccaagcaaagcaaccagccaaccatatgcacacgccgagccgcgagtggttgctcgatcgaccaggtccaggtgcaatgcaatcggtcagttggtgactcattcatgagccgcagtgcagtagtcgtacgtgtgtcacgtaaacagttaggtagcgcaccacttacgcgccgcgctagttggcgacacgaaaacggtttaaaaaaagagaaagcgttcaaacgacacgatcgacgagaaactgaatcgatcgatcgaactcaccgagcacgtcgccggcgcggaagcgcttgcccctgagccagccgccggagttgaagccccagccgccgcggtcgccgacggtgtacacggccgactcggcgagctcgccgtggaggagcacgcagaggaggaccatcgccagcacggcggcgttgcgtcgtcctgcagcactgccccttccctgagccatcgccagtagctgatcgctttgcaacaattgactgaccgtttactactgatctcagctagggggtgcaagtagtgctgagcgagtgagtgtgaggcgagtggtggtagtgcccaagttctggcgacgcgagcttccctttataggggagtagtacaccccacccacccaccgatagccatcactgaacacacacttactcctacatgccatgaaataaataggaaattgattaattaaccaaaattagagcttgtggctgtcaattgtacatatgtgtgaaaactgtgaaactgagctcagcgaccgcgtgggaattgggaatgataggatctgcgacgcgccggcgacacagtgcaactagcgagctagcctggcagctgggaggaaaccacgacttagtgggagtgaattttaatccctcgaagagatattcctgtgtttttttcctttcaaattcgatacaaatagttaaaaaaaattataaaaaattgataatataaagtatatagtaaaatcgataggtaataaaaattaagtttaaatactcggctttagtgaaaaattcagatgtgatccgtataatactattcatatgctgatatttttatatctcgatatatgagttgagtttgaacttaatattttgtggggttatatagatatgttgtataagtgttattaaatttttccacaattttttatactccctccatt

SEQ ID NO: 12235 - DNA, 1501 bp, Oryza sativa
ggattgtagatcggataagtaattcgagagaaaactttataaggggaaaaagacatgcatgtgtgcgtagtatacttctccactgctcgcacgatcgaacagctatgacacaacgtgcgcgatcgaatgaatctaagcagtgtcacgcgataagacaataacgagaggtttcgccaattagtttttgcgtaatatgattgatacacagactagagatcgatagaggagagaaaccaccgcttgtaaaaatcaagacccgtttaaaaaatggtataattcatagagcactgctgcacgtactaaatttttcttactttactaacaatcgtcaaattgtttgatttaggtagatagaagttaaaaaaacaaatctagatacactcatagcataaacatcagtgttattagcatacaagaatctagtaagaaaaagttagtccttatagccttttcctagttcaaaataacaccaatctataaagcagaacagcgtgtttcggagagaaaacaacacatggtttgtaaattatacgctcgtctgtaggggtgaaaacagggtaggtatttcccgcccacacgtccggccacattatttcgtgacaaattcgggtacgggacttttcacggatatcgggtccaaatacgggtccttttttatggatacgagatcgggttcggtaacatagtatctgacgaatacggattattcggtaaaaaattctggtatttcccggatattacccatattatgtttttgtgaagcacctttttgtactatgtattggttctactatgatgtattataccatgtttatttcctaaggtcctaatggcctaatataatcgtattacggatatatggaattgttaaatggttattgtctactccttccatcccaaaatataagcaattttatcaatgaatctggataaccatatgtccagatttatagacgaaagttgttatattttaggacggagatagtacgtgatatataagattgttggttcgacttgatatccgaataaatatccgtaaccgatagtgtacgtatccgttttggtacttattcgttccgtatttttgtcggacattatctgagtttgaatccgtattcgacactatccgtttccgacccgattccgattataaaatatggattaggatataggaggagtgagatctgaccgaacccgacccattttcaccccctactcgtctgagtcgtctcatcttgaaatctctaaaacgactccggcaaacaaacgagagcggaacacgaaataactgcaccccgcctccgcaccgcaccgcacccgaacccgtcccccgaaccatgcaatgcatgcgcccggttagccggaaaaaaaaaaaaaagaaaagaaacaaccggagtcctagtgtctcactgatacctgggccccacctgcctccgtacgcggtcgtaccggactaccgactctgacactgagccgtgggcccacctaccactccgccgcc

SEQ ID NO: 12236 - DNA, 1501 bp, Oryza sativa
catccacccctaattgcaacgcacggacatgtttatagttattttaaattttaaaagtagattactgtaatttttaaaacaatttttatgtagattttcttaaaaaaatcctcgttcagtagtttaggatgtgtttgtgcgaaaaaagagtgacttttcagctctttgcccatctgtagaacgcatctaagtgtgatgaggggataagtatactacaaataacattatcttacattgtaatagaccagtctcatgcaagtagggataaactataaatgtgattagaaaataaaacattgaatatatatggtggctatgtatatagggattagctctacatttgttgtcaaattttaactaaaaaatttgacagatgtaattatagtataatcgtgatgtaattacagtgtgacttacatataactatagtctatagtttaacttatacgtaacttttaaaaatccttaggcgacatgaaaattcagtgaaaacggaggtaattgtaccgaatcacctcacatatgcgtgggttgtgattttttcctacctccattgcacaaattttaaagcaaatcgaacggtttaaaactaatttgtagttacaacaagttacaatataattacactatgattatgctatatttacattatcaagtttttagaaaaaaatattatcaacaaatatatagcaaaatcgttatacctatgttatactccctccatcccaataaaaattaacatagcaatggatgtaacacatccaaatattatgaatctgaacagatgtatgtactagattcgtttattttcgaatggagggagtacatgtgtaggtgtgctgcacgtggtgtgaggaggttggaagcatgggtgaaaacggtcagaatcaatggcttctcttcggaaacgacgcttgatcggctaataattgaccatatttattatttaaactactcagtgccgatattaatacaatttagaaagaaattagaaaaaaaacaaaatttaaaaatagtacagtcagaaacggtaccctttatacgaaaaatgcactcgatcaggaatttcggtggacttaaaaggagtacgacaccgcttttaagctacagcgtaccgtaatagagatgagagaaggggagggtacctacgagtttggaaaaagtccactttgactcccttaaatataggtaaaatctaattcgtacccctcaactggaaaaccgggtaggacgactcccccaactattgtaaccggtgcaatttgactcccttggcggttttggagagtggttttgctgacgtggcgctgacgtggcaaaattgacccggtcttcgtcccacgtggcattcgaattaaaccaatatatgtgggacccatctgtcattcacaagaaaaaaaaatatattgtgggacccactgacatgtggggcccacatgtcatcatcaatctatctcttcccttcatcggtttgcaggggcgggagctagacaagcggcgg

SEQ ID NO: 12237 - DNA, 1501 bp, Oryza sativa
attttaaagttatttctttttgcagctgacatgtggggccacactttttattattttgctgagatatagttgccacgtaagcgccacgtcaatgctacgtgggacggagacctaatcaaacaagccacgtatgcgccacgtcagccaaaaccgcctttaaaaccgccgagggaccatgtttccccggttttcgtaagttgggggacgggtcatacccagttttgcggtcaagggacgaaaatcggtctgggcgacaaatagagggacccaaagtgaacttattccggaaaggaaacaatggcccaagccaatggttcccttgctttctaagaagtccgtttgaacgtgaaatttttgaaggattttgtacgattcgaactatttttatataaaataatcttaaggatctctgcgtttcaattatcaaagaacctcccaatttcatttttcgaatcgaactatttgaaatctccccaaatctgtaagctcgaagggaggcctcaccgcctcaatcctcatccgtgtctaactcgaacggtctgctccaatcgaccgttcctcctacaaaacggtggccgaattgatcacgaggggaattcgttcccgggctcgatccgattccttcttccaactccaaaccaacatacccttcctcgccgcggcgcgggatcccctcctcctccgtaccaaaccctagccctagctggttccctcgggtctccatggccagcgaggaggccgcccgctcgcacctctccccgcgcaagcaccgccgctcgccgcacgacgacgacgacgcggaggacggcgcctcctccccgaagcgccacaagcgcggccaccatcgccaccgccatagggtctcgccggctgcggcggatccggcggagggcgaggccgaggacggtgagatactagaccaggccaccgcggccgtgggtgtgggtgtggggagggggctggatgctgatgccggtgagacgggctcagtgcaaggtgttctacctgctccggtctgttccaagccccccatccattttgttgccgttggttataggttattttcgttaccccttgatcctttgttccggagttcttaattttcatgtgaatttgggcgaattttgctctgttttgttctggacttaatcgtacacaaagcgcgtagggtatggcggtatgctgttgttagcgataggaatacgagtcataggacgaacaattttggaggtagagtttatattaaggaagcaactaacaagcaatgaaggcatgctcgatcacctattcatttgtgttttgttatcatttgtcagagcacaggcaagaccaccctaggaaataggaactaaaacaatcaaatttaatttaacttttgtgaagaacatgtctgcatttgttacttatcaacgaagtcttttacttataacttttattagtaacatatgcctcagtctttgtgggtagatggcatgcacttttttttgtcctgagttaaaat

SEQ ID NO: 12238 - DNA, 1501 bp, Oryza sativa
gcgacgttgcgcgtggtgtagcggaactgcgtgcacagcacaggcacagcaaacaattctcggtgtggtcatgatgcctagtactactatagtaatccttcccggtcccggcgtttagcaatgaacttgacacgacgccgctagttcggcagcaagcacgttcacgcgccgtccggctcgctggacttgacgtgtggcgccggccggcggccgcgcggctgctcgatcgcgggatcgatccgttcgttcatggaggcaggccgaacccggtctgaccttagcttggccgcggcggcttctgctcctgacgccgtgacgcgtgcacactcttcggcaataatgagcctccgagtctccgacgtgtggccaggaggagagaaaaccgtagcgttcagagacggcacccggctcgccgcaaagcgtatacagcttcacgggacgcggcacatcaacctgttcagtggcgcgactccacgggcggcacgcgcgcgatacctgcgctgagccctacacgtgtgcgactgcgtggagaggagacagtgctaaccgaaataaaaaccgtgctactagtagtagcagtagtgaaattgaaatatggaaacatgattgcacagagcgtgtttactactcttattgctactagtacgtgtgtttgtagaagaccggcggaaagtgtgaggagggtgacaaggggaatccggaatccccaaatccaagcgcacggatttttggaggtcatgtgggcccaatttgttggcacaggtgtccgtagaactataacagctcggtcttttgttgcatttgcgtgtacagtactactagtaaaattgtaatggtcgtgtcatgtcgttcttgttttacttcctgtgaagttggcaacacccgacgaaggatttttgctgttttcctggtgcagattgcagaacgaagcaacagtttccatgtcgtatagtggagtactaagcagttcgttagccaaacgaagttgaactaagcatgacgacggttgagataaacctccacacaaacaggcaattcccacaaacagcctcatccctttacctcggccaacataaaaaggatactgcatccgatgtggcattcttacccgaaacagagtctcccaaaataaaacaaaccatatcatctactggtagattagtctcaaaagagctaatctactcaattttacacgtcacagagtcaaaaaaaaaactagaaaaagccaaactgaaagaaacataaaccatagccgtgcaagcaacggggcccacataaaccccccaaaaaaatcacgcaatccatccatccctccatccgcagtccgttcccttctttccccttgtataagtagcggatgccactcccgccactctgccttacacaaaacacatcaaacacaccaagctcagacaagagaagagaagagaagccaagaaatcatcatcatctcacgcatttcttgctcgaattccagctcgattgagcatcatgggttaca

SEQ ID NO: 12239 - DNA, 428 bp, Oryza sativa
  unsure (1)..(428): unsure at all n locations
gagggggagaaatgacgataacatgtggggcccacgtgtcggtgggtcccacatttttttttgaatgacatgggggtcccacaatttttttaactctaatgccacgtaagcgacacgtcgacgacacgtgggctgaagagcgggtcaacattgccacgtaggcgccacatcagccaaanccgcttccaaccccaccaaaggatatagtttgcatcggttttgatagttggaggagtctatatacctggttttgtggttcgaggatatgaatcatactagttgagggagtcaaagtataatttttcctttttttttcccaccgggccacggcgcccatgggccaggcccaggcgaggcatcctattccgtgacgtggataaatttctttttcgtctcccctgatcgcttctttccccatcgagagttcg

SEQ ID NO: 12240 - DNA, 1501 bp, Oryza sativa
cagtcatcgctacgtacctcgccgcgtacaggatccgacgcccgtatgagatgcttctggtcggctgcaattccgccgccaagacttcctggacgaggatgaggaatcgaggatgagcgtgcgtggttcaggatggaggatgggcctacgtgatctgtgggggcgatggagttttctcgctcgccgacgagaaatactcagattacgctagtggaagacgccgtccgtcggtcgacgaagcaccggagggtggaacgaaggaggatgcgcacgggatcggataagtgaccgtgggacccacaaaatatgtttttaatcgtgagtgcgcgtgaaaacgcgtgctatcgccgggcgccagattagctcccgctccgttctctctcatcgattctcttccctccatctaataaaaaaaaacaatataatagcttttggagcctgctgactaggattattgcatctgctcttgtacgtgtgtatggcgatcgagtggcagtcaacggtttatttcttcctaaatcatggagtattaaaaataggacggctaatgacttggctgtgttgggtggtgggggttgggaacccatcattcacgcacggaaaacacaatggtctattaacgcgtgattaattaattattagctatttttttaaaaaaagataatataatttttttaagcaactttcatatataaaccttttaaaaacacaccgtttattagtttcaaaagcgtacacgcgaaaaacagggggagttaggaactcctgatatcgaacgcagcctaattaatgtttaaactggaaaggaacacgacgcaaacagcgaaaaccaggtaattaaacagcgaaagctacccgacgcaatttttcgctagcacctgttcaacagctactccaggaagcaacagcgaaaaccaggtaattaaaccagcgcgtgcatcaggctgcgtgcatggccggagtgtcaaacttcggccgtgtttagttcacctcagctaccctaaacttccaacttttcatcacattatatcatatccaaaactttcctacacacataaacttttaacttttttttcaaacttttaactttccccaaacttccaacttttttcagcaactaaacacagccttctgcgctcactcgatcgatctggccgtgaatagctgatattttggctaacagttaggcgtgaaatgagagtacgaatccatcaaaccatacgagcattcgacgattctcctgcacgcaccgcaaacgggttgctatggatggcttcggagcccacggacagcttcggaggccttgatcggccccagagcacttagatgacctcgaaggccttggatgaccccggagcccctaggtggctccgaaggcctgggttggctccggagcctaaatcagtagatgcctccggtcattctcctggggtgaatggctccggtaggtgttgcatcacatgacggaggctggctccgctacccggagccattcccccaa

SEQ ID NO: 12241 - DNA, 1501 bp, Oryza sativa
atatatacaaaacgtatacaattaaagtccaaacttgctacatgcaaactatatacgtagatttttttttagaaacattccgcagaaattttatgcatatgaatttgaaagaaaattaaaaatgtacaaactttatacgagttaaagcacaaatttatgcatggaaactatctctaatagaaactttgagtaaagaaactttatacatataaatttaaaatgaatttaacaaagtctacttatttatactttaaaagacgctgtcgtcttcctctgtgtcccctactgcgtgcagcgtgagaataacacaccaaagaccaaactgtcccacccctctaaccctacttcactacttcgtattactccaaatcacgttagtgtacgcgcataacacaccacgtcaagaaaagccgcaaggcctcacacagaaaggaataagttcactttaggtccctcctttgtcactgagttcgaaattcatccgtcgaggcacaacacatctctcaacttacaaaatcagtgcaaacgagatccctcagcagtactgtcctggatttggatgacatggtgcatacttggctcctttgaggctttaactaggtcttcgtctcacgtggcattaacgttgtacttacatggcaattcgatccggaaaaaataataaaacacgtgaggcccacatatcaattacacacaaaaaaaaatggtgggcccatggggccccacatgtcatcctcactatcccctactctctatcccccctctctctcccctcttctctctatccccctctctctccaaccagcggagcggggtaggcggctgccgaagcgggcgacgggtgggatggagtggtcgggcggtggagggggcaacaacggcggaggtggccggaggaggagctcaagcagttgctggtgagcacgacagctgtggcggtgtgacagcggttgacaatgacggtccgctctgcaccactggcatgctccggtcgccgccgctccgaccaacgcccatcccgctccaccgtcactaagtgaagccattagagcatctatgagatgaaacaacttactactagagagaggatagagagaagaggggagcagtgaggatgacatgtgggaccatatagccccactattttttattattttgtgtgtgaaactgacatgtgggtccatgggttttattatttttccgaatcgaattgccttgtaagtccatgtcaatgccacgtgggatgaagacctagtcaaaggagccacataggcgctatgtcagtcaaaaccggagataatactaccgagggatctcgtttgcacagttttgtaagttggggaatttaagactcaatgacaaatggagggatctaaagtgaacttattccacacaggaaaaggaaaaggaaaaggcgcggccgcctgggccagaaacggaagaaagcctgcgttcgcgagcattcgcccactagggttttccagtctccaccacggcacca

SEQ ID NO: 12242 - DNA, 1501 bp, Oryza sativa
acatccgatattagattgattttttttaaaatggagagagcatagcctaccatggctgatggtaaaacatataacgaaactacccgaacttgactcgacagtgtgactgcaaggaccggacatatatgttcccgcccttcaggagcttgaagattattacgttgggttccacctctagatttccgtgtccaactttgactgtccgtcttatatgaaatttttttataatttgtattttcattgttgttagatgataaaacatgattaatattttatacgtgacttgtctttttaatttttttttataatttttttaaataagacggacggtcaaacgttggacacggaaaccatggtttgtctttttttgggacggagggagtaccctccaagcctccaagggctaagagtgtggtggcgactctggtcaatcctgttattttctaattaagattcggattttacatcgttttttatttgcatagttttttttaactactaaacggtgttacgtacgaaaactttctatatagaaattgttttaacatattaaatatgttaatttgttaagtttgtactccctccgtccaataatatagcaacctagtattggatgagacacttcatggcataatgaatctggaccgcaggagtgtctcgtacgttatattatgggacggagaaagtaataattaaagacttaattatatgttaaaattgttttcgttttcgagctcaaactccctccctgcgcgccgccacgagctcggcctccctgatgcgtcgccgcatccacacctccaggcgagaaggcggcgttgagctctcgtcgtccttgccgtgcgagacgcttcgcgccgccgcctccaagggagcaactagcaagcagcctcgcttcggcgccgctgccgccacagcctactccgatcgatctgtaatagcgtgcatattcactgcatgtgtagttgtgttgtggtgatgtacacgcatgtgaacgtgaatacctaatatgatgcctttggtccttatgcaatcatgctaattgttgttgttgatagcctggatacttggattacggtaagatttggtgcttattcactggtgtttggctatttcttgtcttgctttgctgctaccaaatctattgagatattgtcgggtgtgggcacccgacggtgccccatacccgcacgggggcgggaacgggggaggggaaaacactcccccgcgtgcggggatgggaatggggacgggattttttttctactacggggacgggacaggatagcaaaatccgacgggtgtagccttgtaggtgtagcccccccattgccatccctactcgtattccctcccaggcccaagtataatggggccacatttaagtacttcctttctggcccaactagaatgggctgaaggtaacatcacagtgccgttccaggccgactgtaatcggactcaaatcaccaagtcgtgtgctccaccagcgtgtcactct

SEQ ID NO: 12243 - DNA, 1501 bp, Oryza sativa
aatataacgtacgagacactcctgcggtccagattcattatgccatgaagtgtctcatccaatactaggttgctatattattggacggagggagtacaaacttaacaaattaacatatttaatatgttaaaacaatttctatatagaaagttttcgtacgtaacaccgtttagtagttaaaaaaaactatgcaaataaaaaacgatgtaaaatccgaatcttaattagaaaataacaggattgaccagagtcgccaccacactcttagcccttggaggcttggagggtactccctccgtcccaaaaaaagacaaaccatggtttccgtgtccaacgtttgaccgtccgtcttatttaaaaaaattataaaaaaaaattaaaaagacaagtcacgtataaaatattaatcatgttttatcatctaacaacaatgaaaatacaaattataaaaaaatttcatataagacggacagtcaaagttggacacggaaatctagaggtggaacccaacgtaataatcttcaagctcctgaagggcgggaacatatatgtccggtccttgcagtcacactgtcgagtcaagttcgggtagtttcgttatatgttttaccatcagccatggtaggctatgctctctccattttaaaaaaaatcaatctaatatcggatgtgacacatcctaacactacgaatctggatatatatatatcgagatttatagtattagaatgtgtcacatctgattttaaatttgttttttatgcgttggagggagtagtggtcgtcgaagcccgagtccgctcagccgggagccgtgtccaactgcctcaggctcgacgagttttgattgaaaaactccattctggctagctcgtgtcgcctactcgccctctcgatcgtccgtgccacggtctcccatgcgatgcgatcccaccgtgtcgtgtccgccccgtcgtcggcaacgcgtactacaggagggaaagccgtcgtagtggacgcacagttcgtccactctccaggatccagatcgtgccgacgcacagttcgtcgtagtggacactggacacaaccaccacgccaccccacctctatctgcatgacatatgggcccacgatgtcgcggaccccacgcgccagcctctcctaacacgtcccccgagaaagccgtcgcctcctccccccttctccaagcccgagacgtccgagaaaaccacatcacacggccccacttgtcagcgacgccaaggtgggtcccacctttgccacttgtggcttcttctcgccgttcaaattttgaatccccacgcggccaccgctaattgaacggaacggaacggtttgctgcggagttcgcgtcgtcgtggacgaaaaagacaacggctaactccccctacccccaccacttctcctcctacttccattttgtctctcgccttggcttcttcttcttcctcctcgcgctgcccccacaggaggagtttgtgagctctctcagcgtcga

SEQ ID NO: 12244 - DNA, 1501 bp, Oryza sativa
gggttactgtagcaattatggctaatcatagactaattaggctcaaaagattcgtctcgcgatttcccccataactttgcaattagtttttttaatctatatttaatactccatacatgtgtccaaatattcgatgtgatgttttgggaaaaaaattgggaactaaaccaggccaaataacgtatgattgattgagttttaattattacaaacttgaaaaatagattaatatgatattttagagcaacttccatataaaaagttttcacacgaaacgtaccgtttagcaatttgaaaaacatgcaacggaaatcttaatctccatccaacttttattggagaaaagaccaggacccagctgtggatgctcaccaggacgacgtcacctccctcttccctggcttctcccctgcactatgctcgatgagagatttgataatttaacactccttaaaatgggttttgattatttgaaatcctgtcccactttcattcactcagatgatcccacatgtcattctcacaagtgtcaactaaaacaattggacaatgaaaaaagtgttaaattatcaaattttcctgctcgatcggcacaggcgagacaatacgggaagaatttttttttttacgcagagaggatgggggagattctcgacgcacaaagaatatatttttatcgtctccgtcccaaaaataattactactatatttgagagggtaatatgcaagttccctctgtctcccaaaataagttattatgagatatggcatattccctctatcttataaaaaaaaactcatccttatatttccattgaaagtttagtactaatgtgaattacctaaatgcccttcacccgaagggcagtttcccaacgaggcaacgatcgagacgatgctagaagcaaacagaatctcatccccaagcggccggaagacgcagcctaccagagagagaaggtgcgtctaccagagagagaaggggagggggaattaccgccggtgttcgccgccgattcaaaccccagcttccacgcccaacgatcgagagcaaacaagcagaatcctacccaccccaagcggccggaagacgcagtctacaagagggagaaggggaggggggcattaccgccggtgttcaccgccgattcgccggagcgccgtgaggggtggcgcgtctcctcctccgctcagctccgcgcctcggcctcgctggttcgccgtgagacacgggaaagaggaaataaaaaaagctaccgtgccaagaagtcggactcggactcggtctagcaaaggccataagaagttgggccggcccaatatgactaggcccatacaatctcaggctttcccttctccaatccatctctctcgcgaggccaagttgaggtagagctcagctcgacgcaacgcagacgcaggcggcggcttcggcctacctcgatctctctcccatggcgcactagaccaaaaccctaaccctaggtccgcctcctccgtc

SEQ ID NO: 12245 - DNA, 1501 bp, Oryza sativa
gtccttcgcgtccattgccgccggacggaggaggcggacctagggttagggttttggtctagtgcgccatgggagagagatcgaggtaggccgaagccgccgcctgcgtctgcgttgcgtcgagctgagctctacctcaacttggcctcgcgagagagatggattggagaagggaaagcctgagattgtatgggcctagtcatattgggccggcccaacttcttatggcctttgctagaccgagtccgagtccgacttcttggcacggtagctttttttatttcctctttcccgtgtctcacggcgaaccagcgaggccgaggcgcggagctgagcggaggaggagacgcgccacccctcacggcgctccggcgaatcggcggtgaacaccggcggtaatgcccccctccccttctccctcttgtagactgcgtcttccggccgcttggggtgggtaggattctgcttgtttgctctcgatcgttgggcgtggaagctggggtttgaatcggcggcgaacaccggcggtaattccccctccccttctctctctggtagacgcaccttctctctctggtaggctgcgtcttccggccgcttggggatgagattctgtttgcttctagcatcgtctcgatcgttgcctcgttgggaaactgcccttcgggtgaagggcatttaggtaattcacattagtactaaactttcaatggaaatataaggatgagtttttttttataagatagagggaatatgccatatctcataataacttattttgggagacagagggaacttgcatattaccctctcaaatatagtagtaattatttttgggacggagacgataaaaatatattctttgtgcgtcgagaatctcccccatcctctctgcgtaaaaaaaaaaattcttcccgtattgtctcgcctgtgccgatcgagcaggaaaatttgataatttaacacttttttcattgtccaattgttttagttgacacttgtgagaatgacatgtgggatcatctgagtgaatgaaagtgggacaggatttcaaataatcaaaacccattttaaggagtgttaaattatcaaatctctcatcgagcatagtgcaggggagaagccagggaagagggaggtgacgtcgtcctggtgagcatccacagctgggtcctggtcttttctccaataaaagttggatggagattaagatttccgttgcatgtttttcaaattgctaaacggtacgtttcgtgtgaaaactttttatatggaagttgctctaaaatatcatattaatctatttttcaagtttgtaataattaaaactcaatcaatcatacgttatttggcctggtttagttcccaatttttttcccaaaacatcacatcgaatatttggacacatgtatggagtattaaatatagattaaaaaaactaattgcaaagttatgggggaaatcgcgagacgaatcttttgagcctaattagtctatgatt

SEQ ID NO: 12246 - DNA, 1501 bp, Oryza sativa
caaaatcacccctcctcttctgcttccggcttgccgctcgccgcgacgacgacgacgaccgtggatgcggcgccggcgctggcctcgacgtccttgctggccggcgtcgtcgtcgtcgacgacgactcgtcggaggacgaggtgccgtcgacgtacatcccgatggcggccttcctgacctcgagcacgaacagcagcagtgtgagccagacgatggcctagaagacggagagctggacaacgagctgctgcgccccctcaccgtacatggaaggccgtgaagatcgagagggcaacggccatgaaccaccagctccaccgctgctttgtatccacgagcaccggcaccaattgcgggtcccacgccagccgccgggtctgctcctccgcctgccggcacgcgtcgttgtcgggcatcaggaactggatcagcaggaggtccagcgactgcgccgtccctccctgttgccagcggcagcttcctcctccctttaccttgctgcaatcgcccggcaccggcggcgggggtgagcaggcagcaaccacccgccggcgctacccgcctccgcgccgtctcgccgtcaccgacaccgcccgcgccggcggaggcgttcgggtccgatgccctcaaggagactttctccgttgacgtggtggcggccgaggcgcggccgctgaacgtgcccctggccgcgcccttcaccatcgcgtcgtcgcggctggagaccgtgtcctacgtcgccgttcgggtggagctccgcagcggcgcggtcgagtggggggaggcgcctgtgctgccctccgtcaccgccgaggaccagcccggccgcctttggtgcccatcccatccgcatctggcgcaagagagatgaagagaggggagctggggagaggaggaagatgggaaggggtgagttagcctgacatgtggggcccacatgggtcccattgttttttattcttttgtgtgaaactgacacgtgggtcccataggttttattttttttctggatcaaattgccacgtaagcgccacgtcaatgccacatcagatgaagaccgagttaaactagccacgtagacgccacgtcagccaaaaccgccatcgaaaccgccgagggacctaatccgcaccggttttgatagttcagggacccattgtacctggttttatggttgaaggatgaaaatcggattcgttgacaagttaagggacctaagatgaacttattcccacccccataattttgaagaggaaaaagttcactttgggtccctctatttgtcgccccgtccgattttcgtcccttgaccgcaaaaccgggtactacccatcccccaacttacgaaaccgggcaaacaaggtccctcggtgattttggatgacgtggtgcctacgtggcttgtttgactaggtctccgtcccacgtgacattgacgtggcaattaaacctgaaaaataaataaaccttgtgggacccacatgtcagttttacacagaa

SEQ ID NO: 12247 - DNA, 1501 bp, Oryza sativa
gcatgattcaatatagtgcgccagactgtgaagtggcgagaagtccacgggggtcgctgggtagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctgatcagagtttaatctattcgaatagccgtacccgcggttatgggtgagttgagcaatgtttttcgtgattagtctcacctttctcaccatagtaaatgatgctttaattggtaataatttgattagctcctggtttggaatggtatattcctggtttggagatagaactgtgcacccgggatggttgttctgaatggttgggcctatacaacagggtatgttgtatagcgttggattaatattgtttattacttaactgttttattaaattctcaaatgtttgctaaatgctgtttttgcaaatgaaactatattatgccatcctttgttatcctgtgcacttgcatatttgctgtgtggcttgttgagtatgtcatatgctcattcttgcaatattcaatcatcagaagaggagtatttcagcgaaggtgatgatctgaaggattgagcttgttctggttaagatgcctgtggagtggagtcgccatagctgttccgtagtttgttatagttagtttttttccgctgcgtagaaggttatttttttgagaggaactatctacctctgtagcaatttattatttgcgaatattaaatagttaattatttgtactctattatcaattttgttattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttataaattaattaagttggcagcacatgcaaggttatgcacaaaattaaattaattcattttcttttcttttaaaagaaaaaaaaattgttcttctcaaaatgtttcctattccgccttagtaaacttcattgattagtcggcactgtacatctattatggtatcgatacaatcatgatagcactagtactactcatccttcttatggtgacactgtaccgtgcatataatagatcataagtattttagttttattttagttatttgtcaaaaaaaaattatttgtctctgtccaaaaagttaaattctaaaaatatatgtataatagcttaagtatgtgtcttttcttttatttttcttcctctttggtcaaatcagttaagtctagatggtgcagctaacttaaaaaaaaatgcattaattcctctcttctatgtttctttaga

SEQ ID NO: 12248 - DNA, 1501 bp, Oryza sativa
gatcactagccaacgtcacacgaacacgacacttctcctcgttggggtcatgggaaatccggcgatactcaggagcaacttcatagcctacctcaaaagccatcaacctcagctccctgacgaatcctaacaccttgatcaaatttctcggtgaatggggcggcatctaaagaaacatagaagagaggaattaatgcatttttttttaagttagctgcaccatctagacttaactgatttgaccaaagaggaagaaaaataaaagaaaagacacatacttaagctattatacatatatttttagaatttaactttttggacagagacaaataatttttttttgacaaataactaaaataaaactaaaatacttatgatctattatatgcacggtacagtgtcaccataagaaggatgagtagtactagtgctatcatgattgtatcgataccataatagatgtacagtgccgactaatcaatgaagtttactaaggcggaataggaaacattttgagaagaacaatttttttttcttttaaaagaaaagaaaatgaattaatttaattttgtgcataaccttgcatgtgctgccaacttaattaatttataagagaatagagaagagcagttctatttttttcaaaatattttgaaggctacttaaggtttaccatttggcttatcctaaggtcaaggtggctctgataccaacttgtcacgcccggaatttctatccaaaattccaaacgcttacatgtgtgttaaaccctcgtccaggaatcaaccgaggcacacaataacaaaattgataatagagtacaaataattaactatttaatattcgcaaataataaattgctacagaggtagatagttcctctcaaaaaaataaccttctacgcagcggaaaaaaactaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcaagtgcacaggataacaaaggatggcataatatagtttcatttgcaaaaacagcatttagcaaacatttgagaatttaataaaacagttaagtaataaacaatattaatccaacgctatacaacataccctgttgtataggcccaaccattcagaacaaccatcccgggtgcacagttctatctccaaaccaggaatataccattccaaaccaggagctaatcaaattattaccaattaaagcatcatttactatggtgagaaaggtgagactaatcacgaaaaacattgctcaactcacccataaccgcgggtacggctattcgaatagattaaactctgatcagaggtgtaccactgtacccacaagacacaaccccacatcatgtcaccatgtgcctcaataccaccacg

SEQ ID NO: 12249 - DNA, 1501 bp, Oryza sativa
atgtagatttgtactagttgtttaatatagtaatgaaattaagtctaaacgttatcatcacacaacaaattgtctagtgtttggtgccttggtggaataattaggtgaggacctggactttctcgtagtcaacgttaccatgttttacaaaataaaataaaaataataagtagaattataacaagagaccaagtaaaaggggaggaatgtagttgtgacaaagaccctaaattgcacactaattgtttttggaaatcataaatgtagagttttcatacaatttgtattatatcgatttactctacgctaatgtggggatctcaccatgtgtatatattaatcatgaaattagaagtcgtcaccctctactggctttggatagggtggaatcacaacaagggcaggaacgacttccgtcgcctgctagaacaattatgtatattttttcacaggtcgtcaatttgattgatggagatttgtccacatttgttagatactacctcctttcccataaaacgctgcttttagccacgaatcttgccaaagaatgaaaacaatatcatgacgtagatttgtactaggtttttaatgggacaatttcgtttttgcccccactttaatttgtaatatttattttgctcctagtttttagtgttttcgtttttactcccacttttttgaactgaaagaggcgtttacctctggtttggatggaagttagtgggaccgggtttatggcaggaaataaagaatttttgaattagtgatttaccattttacccctgtggaagtgttaaccatatggactctctctctcctctcgctacacagcaacccgaaacctagcccgtgtcaaaaaaaaaaaagaaccgtagacctagcctaggcggcggcggaggaggagagcggccggggagaggcggcgcggcagcgagcggccggtgcctaagcggcagcggcgagtgggtgagggcgagcggcgcggtaggcggcggcgagcgggcggctgcggcggcgaaggaggggagcgagcgtcggcctggtgccgctcctcccggcgcgtgcaagagagcggccggggagagggcggcgcagcggcgagtggccatcgcccaagcggcagcagcaagtggatggtggccaagcagcgcggtaggcagcggcggaggaggaggaggaggaggaggagagcgggcgtcggccaggcgccgctcctcccggcgcgtgtaggagagtggctggggagaaggtggcgcggcggcgagcggccaacggccaagcagcagcggcgagttgttgaaattttgttgaaatttggacaaaatttttgttcaatttctatcaaaatgctgccaaaattttgtcaaaattccatcaaattcaaaatttgtccaaattgtaatgtcaagatccgtccaaatctgtcatttgattttaaacatattcacaaaaataattttccaaagccattgcaggtggccgtgcaccaccgccccagctt

SEQ ID NO: 12250 - DNA, 1501 bp, Oryza sativa
caattttatacgcatctgccgtcacccctggctgctttgcctatcctttatttgcttacctggtgtgccgcggctcctatttattctccttgcaacttttaaaaagggttaattggattcatgccattgcaaatttgtgtaataaaaaataacattacgatttatctattcgtagtcgtgtcattagaattttacaaaaatagaaccatgccactactgtcacgttttccatctatttcttacttttccgtcttcttccttctttctcccatcttcttctctgagtaggagcagatgttttctcaaaatgaggagatggtttctgagaaaacaagttgcattcgcaagctgaagtaatagaggaacgaaacttgtttgttctgctgaacaagcagccatgggcagcgggctagttgtggcggcgacggcggcggtgagcagggactcgaactggttccggttcatggagtcgccaatgagcatcagccgatggccgcgcacagcctcgccaggaaatccgtcacgttgaacatacaaacctagcgagattggatcaaccatggcccatgggtggctggaggatgaggagggcacggagccaagcggtggccgggtgcttgctagtactacctagggaggcggcaccggcgcggcgcccaacgccaccgtgtgtaggcggcgcgtccggccggccgttcgacgcgcaggcgttcgcctcgtcgtcggcctaggggcacgacccggcgcgtgcagcggccgcgcctcctcgtcgccgtcgcgcacccactccccgtcgtacaggtcgcacgtcgttcctccacctacgtcctcgtcgttgctcaccttctctggcgatggcggggcagtcgccggcagtgacggagtggacgacgacgtcgttggtggcactacgccggcggcggagtgggcgacgacatcgttggtggcgctactgggactgggactgggagtgtcgatggcggagttggtggatccactcggcctgcccgacgactacctcctccctggctgcactgacctcttccactcaccaatccttacccgcaacgccgccgagctgaagctactccggtgatccggtcaggtgtgcctcctcctctcttcgacgttggtggcccctcccaccggaggacgtggaggcatgcgcggaggattgaccaggcacgagctctcgccggcgacgacgactccctcgccgcggccaccaccgaagacgcacggccagtctctatcgacgacgaggacgcctcccagaacgccaacgccgtcgcgacgcgcgcaacgagcccaaggaggcgaagaagaggcggcatgaggacttcgatgccttcacctccagcaaggcgcaggacccagctcgccgcggccactgccgaagacacgacgggctccatccctgtctccgtcgacgacgagaacgccgcccccgacgccgccaccctgcacgccaacgcagcaacgctgccgcgacgagcccgag

SEQ ID NO: 12251 - DNA, 1501 bp, Oryza sativa
agatactttataattgtgatccttccaagatgttgacatagcatgtatgttactcacattctgataactgcttctcaatgagaattcagtgagccatatttgattgtaccttcttttggaccattcattaaagttctcaaccctgcataactgcttctcaatgagaattcagtgtgccatatttgattgtaccttcttttggaccattcattaaagttctcaaccctgcgccaagaggaccagaagaaactctttttcctataaaagaagtggattactgtcacattttgaaacaaatatatactgctatatggatagatccataatgtatggcacaatttgtagcaaatgatgcaaagttgataataataggatcaggcagatccgtataaaatatgggccaattatttgtacaagctcattgcaaaacctagaaaaaaaaaagtagaactactggcatgaaagtatgaaactgcaatttgctcatgctgctgtaatgagcttcgcagttgtggttgtgatttgtgatggtgattgcattgttattctctgtataccaatgagtgatggtttatgaatctgacttcagcatctcaatcaataaaactgaagccaacgagatgagaaaccatcctagaccatgctgcttattcttccatcggcctcaatcctgcaaggcattgtgaggacgaattttttccatattatttcccactccacaagatagcttccagaaatggttagagatatacatatggtcaggagaaacgcaggaagcgaatatgcattagaccttttcttggttgggataaaacacaagtacctatcatgttgtcctctcaaaaagaaagaaaaaaaactatcatgtgctgtaaaaagggctgggatgactcaacatcatgtggactggaggcttagtaattgaaaccacgtcactctcggatacggttcttgtcgtttggtcatttagatagaacatgtttcatctcagtgcgcctactcccttagtcccaaaataaattaatcttatacaagatttggcacatcatagtactacgaatctggatatactaggatgtgtcacattccgtacgaggttggtttattttgggacggagggagggagtatctcggatgcctaccgcagtatctcatgaccttataagtttatccgttcttcattcagttaaccattgttgcggtggagaaaatttcgtttgttacgttaaaatttcatttactccttccgttccattttaaatgcagtcatgaatttccgtatctaattgatctgtgcatactgaagttaggacttcatgggctcgagttcccacactgccgctggctttgagccaccatgctgttgtaggtctcctatcagcttgtgctcagatttggaattaagagaattggggataaatcatagtgttctaagctggctattgtactactaaagggactaggaatatgattttcttagttcacattccacccaactccc

SEQ ID NO: 12252 - DNA, 1501 bp, Oryza sativa
cgttggccagctgctgcctgcctgttgctcgcctggtcctgcctcttgctcgcgtgctcccgtggcgtcgccagcaccggcctgcagcctccgccgccgccgctggcctgctgctgcacctgctcggctgctcgcgctcgcggcgccgcgcgcttcgcctgctacctgccgccgcccgccgccgcgccgcacgcttccgcctgctgcctcgccagagcgcgctccgctgcgcagctcgtcgttacctcgccgcctcccccgcgccgctcacctcttgcgccgccgcacggggagctcactgccttggctagtgctagggatttggggctggggattggggaatggaaacttgggctgggccgctgggggctagatgtggcctgtgggcctgcagcctagaagtattttctaaggggagtaagtccactatgactcccttaactagtgaccgagtctaattcgtatcccttaaccacaataccggatatctcgaccctccctccttcctctctctctctctctgacgcgggagctagctagagcggcaacggtggtgggatggagctggagcggcagctagcgctcgagggacggcaaggaggcgggacaagatggcagcgccgatgccgatgccaacgagatcgaggggggcggcggttgacagcttcggcgggccaagagctgggcactagtgtggcccgagggtaccagggggacatccgagcagatggcgtgggaccgcctccttctcctcctcctctgccaccgcgaggaggtgcgaccttgtagtccaatgccgccttcttctcctctgcctccacccgcttcagctccaacccaccgctgtcgcttcaactcccgctgaccaccaccactctggtcccgcccgccgccgctccagcccgtgctccgtgcggacgaccgaaggggagagaaagagaaagaaagagaggatgatatgtgggccccacaaaatttttttaatgacaaatgggtcccacatataagtttttaattcaaataccacctaagcgccacgtcaatgccacataccagtcaacattgccacgtaggcaccacgtcagcaaaaccgccaagggagttaaattgcacaggttttaatagtttaggggtcaagatatctggttttgcggttgagggtcatgcattaaatttgggttaaatttcagggagtcaaagtggatttattcctttttaaggggattccttttctaagtgagcctggcccaaatgcattcatcggcccaatttcacgctttttcaacctctagctatccagatacctagcgcacctcctactctatcatccatggcgaaatttttgaagagggcatagggtgggggttgtccataggtccagagagggtgggggaactcaaggcccccacccccacgttgaatccacccctgcccaacacaatttcttttactgtttgcactgtacatgcaacatagccccggctgtagctatagttggcca

SEQ ID NO: 12253 - DNA, 1501 bp, Oryza sativa
acggtacttggaagaagtccggtgaggcggcggacctcgtgcgcggctacgacctctttggctggtcagtaggatacttggccacggctgcagtcggctcctaggacgacagtgttgctctggttgatggaggtagagagagaacgtgggaggaggaaaatagacgatagtattgagtgccatatttggccagctagattttttttagataagccatctagacggagagtcttttggagcacttttttttttttgctatgttggctaaaatttagcttgaagagttggatggagagtctcttggagatgctctaaggctgaattcagtgttgaaggttaggaacccttcacctccggcatataaaatggagcggcgaattagcatgtaattaattaagtagtagctaaaaaaacttaaagaatttattaatatgatttttaaagtaactttttatgtattttttttttgaaaaaaacaaatcgtttgacagtttggacaatatgcgcgtgaaaaacgagggattagcaattgggaaaatgttgttctgaacacaccctaagtccctaacacatgtatgtgtgtgtgtttttgctcttatgtgttttctctataacttcggaaaacagaacacatttgcgtgataataatgatgctgacaattacaggcaaatagctgataaagttggtgatgccggatattaattacgtcgtggtacctgatttgtttcatggagatccagcaaccacatctgtgaactttaccgaatggctcgagtctcactctccggtacaattcttctcgatcaccatcttaaaccatcgtttggataggccaaaatttcgaagtcataccccatacaaatggatggggcaactggtccattgaaacgaggctgaagtgatttgtcttacagtactcctgctccgaggaatactccatccgttcaaaaaaaaaaacgtaggatcggatttgtagtactggaaaatattaaatccgatcccaggttagttttttatgtaacgaagggagtaagtagttttggaacacgtgcagtcaatatgagctaattttaatcataaaaaaataaaatcgtttaaaatttaggttcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaagaaggcagcgctcaggaaagctctagacatcctgggtggttagagcagcacgggagaaaaatccaacgctcgggatgttcaacagaacggaaacggcaacagaatacttctcgggtgctggttcttttgcaacacccgggatgtttcagtactacagctcaacattcttcccgtgtgctaaccacacccaggaagtttcagtcctacagttcaccatcacacgggtagtagaaataataagcaa

SEQ ID NO: 12254 - DNA, 1501 bp, Oryza sativa
ttcaatatcatgagccagtcttttccgccgagattatccttcttttcttgcatttctgacataagagggatgtatttattgatgtaaaatttccggaattgttctctatatgttggagcctgaaggccctgtaatattttatttttctgtactttatatcttatccctgatataaattaatccgtacataaatcaacccacaatgtcaagaacctactaatatatgacatcttagaagagagagaaatcgttcaagaagcaaacttggagaagtaatgtggacatgtggtagactgaccattcataacgcgttctcaaaaaacaaaagaacaccattcataacgcgcttgtccttaacgcgtttgccgatgtgtatgtgtgttttgtgttctctttctttatttgtttttacttggggtagggtagcctatttcaaagattccaaagaatgagtaatttttctagaggttatgaatacgatagcagttttaaaaacgggtttatccgcgtgtgactttgtaatcatggcagagcttatccgatgattgatcaaagtttttatttacatttacagttccttatttattaatatattaggcaactagttttcctactttagaaaaaagttcactttcatttgagttaccagatcgtttgaccgctgattcgctatacactgtactgaatagtagcaattttttgctatttatgtccgaacatccagaacacccaaacaaggattatacacaacagtaatgacttgcacacttgaaaatgattggcatgttagacatttagaaatgccctgttgctgctcatgtgtgaacatttttagacaaaagataagcgatccagctttcgatagaaagccacaacggcttcatgcctgaacatttccaaaacaagggtaataaaatcacaagagtaaatttggggcataagattttattgatggtataatagtaatgacttacacactgtttaatgactttacgtactgtagttctatgcttctattgctgtatgagcatatactatctgtaaatccttagtacacagcaggcagcaggatgccaggataaactcttgtctgcatgtctgagcttggacaccgatggactcactctagcaatgaaagtacagtagtagtacacttgaactgactcaggaaccttgttctatggcttgccagtagactctgcagcactacacgcaactctctccataccaatataagtgcaacctagcacgaatatgatatattttagaactacgaatctagatagctacctatctagattcgtagtggtagaatatgttacagccgtactaagttacactgggatggatggaatagcaagcaacggcagccagccgacccgttcttgtagatgcagtgctaattcacccagactcaacataggttgagcgagaattattgtgttcttgcatagttgcaaatggtgcagccataagataagaattttcaccgaaccgcaga

SEQ ID NO: 12255 - DNA, 1501 bp, Oryza sativa
gggtcactcctaatctcctgtttatgtacgagagaaaatacatatgtacaatttatccataaaaataaagatatacataagtatgataaaaaagataaatacaaaaaatttacatctgtatgaccgtatgattgaaagaaacaatcacagccaagattaattataaaacaaccagaccggccgaccagccaagattaattccaacgaccatgcaccatctgctcacggctcaagcacgtatatgcaccatggggagggagtttttctggtttttctttttttttttagctgagaagggggaggtagttggtacataagtgggtaccttttattttccttccgaatcgtatatacgttggaatatattggaaggagggcatggctacgtacatgatttgttttcttgagataagaactgatatttaaattaataatttaatggttaaaatattgtgtctacctatttcaatgaaaatagatggtccatttttttctcataatgccacgtggtggcctagtagcatttgtaaaacggaaatgctatataccggtatactgtcgggaagggtatcgacgggatacccttcgtccacctttcccatccaaataggaacgacgctgagcgcctaatctgtgaggaggaggtggccgtcggtgactccggcgcagggaagaagtcccgcttggggagagaaggacgcggccaccggagacgcggccgccggtgacgtggtcgccggatttgccgcctggtgctccatccgcgtggccggctggtgcgccctccgccagcgccccaactccgtcaccggtgacgtggctgtcgatgatgtggtcgccggattgccgccgagagctccagcaccgctgcctgccatccacggcgccgccgttaacgcccaccctcggctccatctgcgtggccggccggtgcgccctccaccggcgccccaactccgtcgcgggccctctccggtcggctccttcgtcgccggccgtcgatcccgctgcgagtccgggccttcatcctatccatctgctactttgggggagcaaagagacaagatggtgtgcaaagaacttgttaacttggtcatggctggctgtggagtgtggtagaatcatcttctacgtggtaagagtcgtatgatacatgataggtatcatattctacgtggtaagaatcgcatgatacctgataagtatcatcttctatgttgtaagaatcgcatgatacttgataggtattatctgattcctctcaagtatcacctgatatatagtagaatcacatgatacctggtaggtatcacctgataccggttagatatcaggacctgaaacatcacaagcatcacccaccacgtggtaagaatcgcatgatacctgataggtatcatttgatacctcgcaagtatcatctgatatgtggtagaaacgcaagtatcacacgatcctactaaagtatcatctttaaaacccataggatcttgttactaga

SEQ ID NO: 12256 - DNA, 1501 bp, Oryza sativa
aagagttctcgaaaaaaaaccaagaaaaggtacacgaaaaaaaaaagaaaatataagtctccaaagcttcggaatggaaataaaggtacacgtacacgaaagttggaccgagatgcaaagagcagaagaagaatgatgcgaagtgttccaaataaaatcgacctttgcacaaaaagttccaaccgagcacatcgtagagttgaatgatgtgtcaccgagaaaaaaatcgacttacagatagaagttgagcacaagcaaataaaaaaaattgtcaagttgcacgagggggcggtggacacggatgagactaaggcggaaatgctaacgcccgcgctggccccttccatgtactattgccttcctcttcttccccttcctcctcccctttcactacaggacaccacacaatttttttaaaaaaacaaaagttagaaaaaatttatgtatagaaatactatatacaaaaattttaaattcaaattcaaatttgaattggtatgtaaacttttgacttataaactttgggtctataaactttagatgtataaacttttagatgaatagaaatattatatatagaaaatatttgaattcaaatttgaatcgggtatgtaaatttttgacttataaactttgggtctataaactttaggtgtataaactttagatgtatagaaatactatatgtcagggttatgtacaccacatacctaatagtagttgactaaatctcggcaggacccaccatataccatgtcctatacggaaacaacctgcagatataggaggagttccggataaggaaagacaaccagagttctacatggaaacgacaagaactactcggattgtatccatattggtttccctagttctacttggacaaggggacacctatcggtataaatacaagcccccctaggagtacagggggacaaccatgatgagacgatcaacacgatcaacacccaccatgacgagacaatcaacacccaacacaatcaacatagaagccacaacatacaagccaacatactctaagacaagacgccggatatcgacttcagagataggcatggctattcccctacggtgtctccggataccatcaggagagacgaaaacgctatctctgatctcgccgggcacggattcgaggaggaaggctaccctgttgtcgactacgagtcagatcttcagaccaatatgtcgacaacagttagataggctaccccacatattgtactggtgtgattatggtgaataaaagcaactccggctccggccaacagtatgtagggttattacctgacagctcaagggcccgaacctgtataaaaatcctcgtctccatctcttttacctcagtctcgtgtatatcctagcaccaacgatccccatactgtccaaataccgtagttgagacatcaaacgtcgacagtggcgtgccaggtaaggggattttggtgctctaggatttcaacgagataggttcaaaaga

SEQ ID NO: 12257 - DNA, 1501 bp, Oryza sativa
cggtggcggcacggcacctgtggccacctcccacgccacagacgccatagacgcggttgcccccaccatagccgccttcaccactgtcgtcatggtcaccttcgccgtagcggcctcccctgccaccgtgcgccgctcccggccaccgcgcacccctccttttcccaccggctgcttccctgccatgcctggatagaggagaggggagtaggggagagagatgaagagaggggagatagggagagaggaggaataagaggagggggtgataatgacatgtggggcccacgtggcccccaccatttttaattttttttgtggaactggcatgtgggcccacagtttttattattttccaaattaaattgccacgtaagcgccacatccaatgatgattgattcaaattagccacgtcagcttattttgcatcggttttgacagttgagggacctgttgtatctggtttttcaattgaaggacttacgaaaatcggattcgtcgacaagttaagggacctccaatgaacttattccgctgttggtcgtctgtcgttgggggtcacgcaggtccaagaggccggatggcctagcccatggatctctcagtctcggacaggcaaaggcaacaaattaagttgagagaacccaaaccctaaccggcgcgcccccctcctccagattcctccggcgtctcggtgtcatggcgatgcactctcatgattcgccgccggcgaactcccttcctgatcccacccctgatcaggtactagttccgctcttgttcgatccatctacctactatagctagctagctgtcgactccctggttctgacgagtctatcagcgaattaacctgcaggccacgatcaaattaactgttttttgttatcttccccgagacaataacaaatataggggtttgatgcaattacctagttcaattcagacccttgttatcagaggagttctgtaatttgaccgctaatgatgaatattgccaattaattaaatatgcacaataagtgccagattgcagaggaggtctatgcaaagatatgtgctaaacttgttacttttgcttgaaagaaagcggtgacaatcagtttttttcttaatcaatttgtagtgtagtccgcattgagtacacgtggatatggtgggggcaaagaagagtattctatccccatattttatttttttttctcaagcctggttcggttaatccctatgagggaggaattagaggaaatttattccacacctattataatgtgaaattattcttcctcaatcccttctaaaccgaataaggcctttgtgatttttgtgtttctcgaaacataactttgccactactttatatatagcttcactagtccagatccttccatctgtgacgacccctaacaagattggaatttgcgggccgtcacaaggaagtaatctcaatcagtccaaagtttcgtctgattgagatatggtcgcacagccatggtagat

SEQ ID NO: 12258 - DNA, 1501 bp, Oryza sativa
tagttgatgatatgaataaattagaggtcttaatcaccttgctataaaacttgcttataaaatttgctcttagagcaaagataatagactaatagtggactataaacttatgtggaggataaagatttttttaaaaaatattgttggctttcaagtaaaatctagctctacacatgctttaaggtaaatatattaaattcttataagtaacataaagagaggaaacgaaatatagagataatcttatagccaacttataagctctaatataaacagcttagttatctttactgttaatacggctcttttacatatgtgttttaattttttacaggcccaattggccaggctcactgtaccatgcgtgacaaagccgcgctttttctagttgttgtcttaaatcgtaaccgtctaccccaagtctgacgaatcaaaacgagcaagccccgagcaccgacttgacttgttcgtcggccactttttaaaatccaaaaaagaaattcattttttttcttctttactactttctctgttcccctcgccgtcgccgccaccgccaccgtgaccggcaagtgacctccgcccctcgccgcggctcgccgcccggccgccgccaggttgcctcggatgcgtggaggtctggtcgcctctgcgcggctactccctcgccctctcgtccggtggtttctccagcgacgagctcagcaggtaggaattagggggtgcgtgttttccggcccttctctctccgcgccacgcttcttgttcccgatctgatttgctgtagtccgtagattagattgaaaatttctcgcaggatgtgagaatcgtcgatgtttaactactgctttgcttatttagttctaagttctaacctactaggggggagaggtttactaaaaccctcgaacgaagtctttagtggtcttcggggattggtgtactgttgttggcaggaaattggtgggataatctcttgcgccgtgagctaaattcaatatttggaccaaaccaacacatctgtgcaccatgaaagggtctggacttcatgatcaacctagaattggatagttcttactttgtggtctgctatgcatgtgcaatgttgaatacatttgcactattgctttatacttctgaatgatgcatatttcttggttctattgcaaaatacttatgcaccaacttgatgtttagtctgaatcatgggggtattcttgtagccatgagcacagccatggatgatccagacgtccttactgaaaagaaggtagttttttcttacattaccttgcagttcttatcagattcctggaggattcatctgcagttcattccatcgtgagagaatatggttaaatccatgcatcccatggatatgtattttacatagtatttatttatgcatacttgttcttttaacctgtaagtcagccagccatttcagttaccaatttgatttggatcctgaatttgaccctcatgcttatctttttgtgtt

SEQ ID NO: 12259 - DNA, 1501 bp, Oryza sativa
cgacggattgggaagaaatttctggacgcgcacgcacgcaggcaagagcatttcatcgatccctgcacgcgcggacgcacgtttcgtcgtcgagcctgcaaaaccggtgttgccacgtggcaccattctccttccgttttttggcattgaattcgtattataagattctttcacagctatcggttcaagtggctaatatgtgagccagattattttaacttataaatagattcggggattagtcatttacatatttattattatgctagcttactgctctacgcacattgtgacagtgataagctccactagaacaaaagctttagttttgtgttgggtttcattgggattttaggtagatttggttcagtataatagttaagtttattcagggccacacaggcccccaatcttaaggggcccaaataacttaatacgtgtcacaggaccattagcccaatagattaaatctattgaaatgtgcaattggaaacaaaggctgagcgagcacgtcgattcgttttcggcgcgtgtgtcgatttgagcgtcctcccgtccgtctaccccaatccatacgctgcgccgctctcgcactcgcactcaccgtctcgctgtccagctcgacgctcggctgctcgtcgctcggcttttggccctcgtcgcttagagcaagataatagtataagataatagtatagctcactttttactattagactattttaaagctaacatacataatagattggctataaggttggctataattttcttcacttctctctatctctcacttatatatttaatgaatttgtcttggagattatgttaagctagctcttgcatgagagccaaccctcttgattttttgttacctctcttctccatataagtttatagtagatttatagctcactattattatacttgctcttaccgtctgcacgtctgctgacgtgccgcagtaaagcggcaaggtagcaaccagcgagcaacgtctttgggcgacctccccggcgatatggcagcgagcacaagcggcaagcttagctgccctgcacacaccagcaaggatgccgggtacatgacctaaatttttattctgatcgctaggtttatggtgtatctaatatgtatactagattaaattttattcatcttgtatctatatatgcatagatttaagtagtatttcaacttctaagaaatgtcatctgcaaatcattgaaaactttatttcaagaaatactaaaggaaaaagaaagatactttccaattggagattatgcacaaagacaatttctattaagtttatattgctaaaatatatcatggagtgtaagtttaccggtttattttatcgcttaagttagaagatttcacacggggcctccaaatttcatgggacggccctgagtttattaaggagactgttaatattatgtaattttggtcaagtaaagatatatggaataatatctattttggtttttatatactt

SEQ ID NO: 12260 - DNA, 1501 bp, Oryza sativa
tgttcattcacatgtgaatacagtactactgtatatatatacgtatatcattcagtagagagagacaacagtagtagcataagtggatgtgccttttcctctgtttttttctcaatcatatatatgtaccctgcgggccagtccaatggagacaacagtacgcacccctcatgaatcatgatatgatatgatccatttctccgagtccaaaggttattttgtactcctattctatgttgttttattctgatactactacgaaggaagtatattatactatactaatttaatattagaatgttttgctcacgacggcgacgttaattcggtctgcttacggcccagcgaaatagcaccggcccagcacacgcagccaagaggcgatcaaaaaccgatataaaaactgggaaaaagtacaccgagttacaaaattgtcctccaaccgtaaaactaaatatcgagcgttctttaactaatcaaaatcggtctcaatagatcctttagtggttttgaacccggttttatcctacgtggcgcctgagtcagcgtgagacccacgtgggccccacatgtcgggtgccatgtcatatcccccttccttctcctttctctctcttctcttctttcctctcctcccctctcctctgggcaagccggccggcggctagggaggaggcctctggggcgaggcgggagaggaggagggcggctgccgcacgagagccgagagcccagatatgccaagcccatcattcattgctacttcctccgtttcatattataaaattttctagcattgtccatatccatatatatgataatgaatctagacatgtatatgtgcctagattcattaacatatatatgaatgtgggcaatgctagaaagtcttataacctgaaacggagggagttgtagcacatgtggggctcacaagggtcccacgctgactcagccgccatgtagaataaaaccggggtcaaaaccaccaaatgacctattgtgatcggttttgattagttaagagatgccggatatctggttttgcagttggggaacgattttgtaactcgatgacaagttgagggaccttcggtatactttttcctaaaaagtgacgccgaagctcaagaccgaagaaaccgccagtccagtcggctcggttcggtctgcggttctcgattttttttccatccctgccatgaacgaagtcgtccgtgttcttgcgatcgaataaccccctaattactttcaatggtatatttcctaaacgatccttagattgatgactaattaaataggtagtctcagatttgagcaaagacatgtacttgcatttctgacttggggctatcgttcatgcatgttgcaggtcgatcgattgagaatgtacttagaggcattatattagccaagtctatcaattggcgtgcgatctactgttgcttccaatgatcgtcgatcgagcagtagcccccaaaggcccacaacacccacacaa

SEQ ID NO: 12261 - DNA, 1222 bp, Oryza sativa
  unsure (1)..(1222): unsure at all n locations
cgcggatganattctgctcggtacccaaataaaataaaatgttaaaaataggcaagacccaaggtaagtctcctggaaaaaaatggggtcctcccctcttatctccctcctactcctctctctcactcagcgagtacagagagagattgccaccgccactccactacaagtgtactcctccgtccaaaaaaaaactaaacctagaaggggatgtgacattttctagtacaacgaatctggacaaagggctatccaaattcattatattaggagatgtcacatccttgcctagattgtgtttttttgggacagagggagtacacaagaaggggagtataggggagggcctccatggatcatctccgagtggtacatggccctccgttttatgctactgctaggagcatgcctcctagggtgtaacctccgccacttggaagccaaccccagctcgccaaccgtcaccagaggcatgccatcgaaccatgctgccagttggaatagagagggccaaggagggttggctcagtccggaggaagagtcactcaagttcgacggggtgatggcaagcgtggtgctcgagctcgagcgagatgttgccaaggacttaaaggctcggggagctgaggcaccttgtcatgatgtcgatggtgcaactcgacagaaggagtagcgcggggacagagcaactgcttggaggtggccatcaagtcaagggagtatagtatggtgtccagttcccactagcaccgttgtcaccctctcctccatcacatccaaagatgtcgttgttgtcctggttaaccaccgttcgagacttcgagctcaactaccaaaccgaacctcatcacttccctatctttgagaagatgccaccaccacacaggctgccttcacagtttggcgagggaaccgagagaaaaaagagtgggaagggaggagagatgtagtcacttacatgtggaccctatatttattttgttaatttctttgatcaacgaaaagccaccatagttgagggagtcttgcatcagctttaatagtggaagggatcgccaattttttcgggttttacggttatgtgatacaaatcaaatcagatttgcccaataattgagcgagtaaaaacgaactttttcctactttttgcatcacgcctgatgatgcgtttgtgatattgtgggcctcaaccaggtgcaagcactcccgtcctgagtccat

SEQ ID NO: 12262 - DNA, 1501 bp, Oryza sativa
gtggatctcacgtctagagatattttagtctatatgataatatcaaacatgatgataatagcatagatctaatgaatgggcaaaattaaagtagtatggatccaattaaccctttaattaatcgtcaaccaaattgtcgtctagtgtaagcgagggtagagcccatggagtgacgatgcaggtggtttccacgaggtaggtggggcccaccggtcggcctaacaaaagaagaaagagtcgaaagcgtgccacgcgcacaagctgccaagacggaaccatcatatcggtgcacatatcattggcggcaatgcgtagttgacacctggacggctcaacataaatccatgtactactggatgcatgtgtcgtcatcgtctttagtacagtatgtgaagaacaaattaaagccgatcgatccatttgttttgcttccatatgcatgagtttatccacaccacacgtacgttgtggtcccccctgcccactggtagctagctgacgtggagccacgtacgtacaattataattactgtgtatatatgcatgcgccaaggacaggtcattagcttcttgcattaccaattgtccttgggtggtactactacgtacgcggagtaatatttgttttagtatatcatgccatggttaatggtttgacgatattctcttctcatggtatcttatcttcgccttataataaatttattttgaatgtatctatattcatattataaaataaatttattttggaatgaagatagaagacgattgaaatatatatttgtatggctctttcattgtattaccttcatttgccactgattaattttacaagagttagatttgactttttgaattatttgctactaacttcaataacatatgaagccatagagagtactaagaacaatgtcattcttttttgaaaaaagataaatagtgaaactttgcaaataaatagtaatccggtgacaaaaaatgcaacgatcaaaggaggtagcaagtagtacaaccctatgtcaaactgaacttacgactaaatcgcttggacgctgaaatttcaagttatttaatctgacatgcatggttaagtgtcaaatgtggtccagtctttggtactcacatccacgccacctactaataactagttaattgtctattgtgcccctagttaattagctctcattaatcaattgctttgtagtaatccatccatgcacccacctctctttctcccgaacagcaagaagatgagccaagcccatggcgtctataaaagagagccctaccccctccatctcaaaaatttcaatccttcctcttccttagcttattagcttccttccttcactagtgccagttttcctcctacgtaatctaagctagccaggtcgtcatcttcttccttcagctcacgctgaccaaacaccatctgttattctgtttgtttgtttttttttaaaaaaagaaaaaaaatctagctaggcgagccgattgaagg

SEQ ID NO: 12263 - DNA, 1501 bp, Oryza sativa
aaggcatgtataataacaattaatagcatgttctctaagttattaataatatgattttacttacataaaaaagagaagacagagaaatatatttgttacgtgtgacaacgacagatttttagtgttgtgttacgtgtgaaaaaaaaacattcgtgacgcctccgacccttctttccctcacatcgtcgcacattctcaatccaatggtttgattgtgtgaacccaacttggggagggggtttggagaattattctccgacctggtgtgacctcccactaagccgtcgcggcgcttgccgcgcctctgacactccatactaccaaacgcctccggcaagccgttgtgttgcgctcgggtagcaaacaccacgagactcatgacgcttactatgtatctcgagataaaatttgatacctttagatactaaggctgtgttcgctcattagggttaggaacccatctcctttacacggaaaacggaacggtccattaggacatgattaattaagtatttagtaattttttttcaaaaatggattaatttgatctttttaagcaactttcgtatataaactttttgcaaaaatcacactgtttagcagtttgaaaagcgtgcgcgtggaaaacgagagagaggggttgggaactagaagttccgaacacagcctaagtatctcgagatacctctagttattagtgtaaacttttctagttaaaatctaattcctctatatactaagtatctcgagataagaaaaaggtgtaaaatttaggtaccgagatatcttctcaaggatcgtaaaatttcacttgtttcagagatgtcggtccatgatgattacaagcatgcgtgatgtatatcatattttactataaagttaatgcttaataactactaaatctcaatatccaagtgtgtcacctcatcatccactttaaattttattatttattgcttttgtcaggtgtgatgtaatatgcattagtacatttgtttgtacatttttctttatcgcattatattgtttgttacaacaatgtgtgcatttctgtcattttgtaaaattcagcagattatgtatggaagggaacaaataatataatgtacttacaggtacacatatgtgattacttgcaaacggaaatcctctagctggtacatcaagagaacaaacaaaatgaagagagaaaaagtgagacatgggctaagccatcgttggatgcacttaatataggcaaatagagtatgcatacattaagaatgtcttgccatttctgagtgtataattaatgtttatgtggtcacgtacttgcatctttttcttcccctcttgtccttttgcagtgttcaataattgcatgccaccgaaattcatccatgtaaaaaaaaaattaaataactaggcacaattaataattcaagctagacatggtaaacagacaagaacttgattcgatttgtgcaagtacatatacggaaatactactactgtccaattt

SEQ ID NO: 12264 - DNA, 1501 bp, Oryza sativa
atctctactacttagaaaatatacaatcaaagcagatatacaatccaacttaaaaacgtacatcgacacgtttggagcgacaaaaaaataaaaaaaaagttacatgcgatccggaaccaaaaaagcgtaaaaagcgtcgacgccccacgacccgcgtcccacgcgtccctcgaacgcgccgcctcctcgccgccgtcaccccttcctccgcgcgccctccatcgccgccccgcgccccctcctcgccgccctcgaccgccgccgcctccacgccgccctcgaccgccgccgcctccacgccgcccggcgcgccctcgaccgccgccgcctcctagccgccctcgaccgctgccgcctcctttacgccccgcgccccctccttgccgccctcgaccccgcgccgccctcgacctgcgccgcctcctcgaacaccgacgccccgcgccaccctcgaccgccgacgccccgcgtcatctgaaggtatgtatcccctcgtgccccaccatgacgcccgacgatatggccgccacatgttcgatgaaatgtccagtaagtagctcaatccgtggtgtgattttgagccagctgttatgattaacctggctctaggaaatctgctgataatatttattttctgaatcatctatgtgatgacgtagaccatgcctgcgcacctggccaactcctggtttctactccttgatttccatgtatatacagcttgagatggtttgattttcttttttgatcaagccatctgaatcgtcttgttctagaaacatccctatattgttccaattctgatttgtcaacgtggtttaatttttttaccgtgtattaaaccaaatgttaggtgtaggcaatgagctcaagtgttcgtttatcatcagttcatgtttcaagctttgtgaatcccttctttcatcacaaataccttaagtaataatttttgcaatcaagtagtaatatcccattttttatgactacgtggtttgtcatgtcatgctcataagtaagaatattaagtttctttgatttgtgattgttgaatgactatgtggtttgtcatgtcatgctcataagtaagaatattaagtttctttgatttgtgaatgttgaatgactatgattctgaacgtttacatcaaccgatgagaaaaaaactaccatcagcagcactgagattctgccttatggtttgtactggattgaactctaataaatttggacttgtgcatttcagggttccaatggatagcaactttggggcctcagggccgacatcgttgacaggattaggtgagtttttcaaaaaatataataataggttaatagctcaagctttgccctatatgtttatttgttccattcgtcgtcgtcgtcgtgtcatttaagccgccacgcccgatacacagtaaagacttcactgcacagccccctacccctgtgcctgcccatttgccctcgaccggagggtcgccctcccgccccgtcgtgctgc

SEQ ID NO: 12265 - DNA, 1501 bp, Oryza sativa
gaaattcctgaaacgattagtataggactagctaggatttcagttcattaataattagtaattattaagttaggtacaaataagcatgtacgtagtactatatttgtaggcaactaaggacacatatcatcgatcactctctcttttcactcgttaattagctggtgatatcagagctgaatgcaatcatatcgttgttgtcatgttgtggattagtccaacaacataccaaactcttgtaatatgatcacttgtggttgaagcaaaattaaatcacgtttcaacacctaatgaggcaaccaaaagattgttttgcttcagaaacaaataatttgatgccaaatccccatctatatatgaatttcatttttaaaagtttgtctttctacgagtaatatatatattgattcttaaacttgggtggagttgtcacttaggtcaactaaaattaaaatttcaaaattgcacgtttaaatgcatcagcttggtttaatgaaccacaacaagtccaaacctcgtttgacgggaactcactgttgacatggcgctccacgcaaacaacaattttgcattcgctctcctccgtgtcatagcgtggccccctccacatatagtactaccccaaagcaccccaaaccctctaaatctctacctccatcaccttctccccgatggttagagttttgacggcgagggtaatgtcgcccacccacttgccactctcccttgcaaccttcgcttcgggggagaatgggagggatttggggggattccgtgtaggggtctaaaagcaaaattaccgtcacgccatgacatggaggagggtggatgcaaaattattgcctacatggagtgctacatcatcgatcaacttggttcaaacggggtttggattgttgtggttcattaaaccaagatggtggaattgaacatacaatttttatgtttaggcacctctgctcaattttaaatactggccatgtatctctcttttcctaaataaggttaaaccctaataattttaaggaaaagtaaggttatatatactttttttttcaaaactcttacaaaggaagatctcaaccatctgatctagccgattggtagttaataaaagtcaaaatgaagtcacaatttgccacgtagtttttataaagagtttgcaagtttttttttttacatgtatcattttcatgtaagaaagagtaaagacagatgagtttttttttcatgataatcatttttttctctctaattactattattttctaaatctatttgcatatgaaactttgatgacataatttatcattatatttatattaatttattgaacactgatattggtatccaaaccatacctaaaagattcatttcttaagaagaaaaatatcaaggggttatttctaaatttatttgaaaaataaataaaaataacaaaaaaagttgtccatatataggccaccccctcgtctcccctgaagtgtccgtccatccccag

SEQ ID NO: 12266 - DNA, 1501 bp, Oryza sativa
tttattacttgtatctacagagaaattcctggtagaatggtttctacaccagccggctatgaactaaaagcaggggcatgaatggaacggtgaatttgtaaaaggggtgtaaaatgttgtggtgaaggaaaggacaaaggagagtacctcaatatgtgaactctggatcctgcacaatgtagagaacagtaacataagtaacattagtcacttttgactagcaagaagcaacctcgttaaaaactactctcagtaacaagaacaacaacgctaaaagctcctgatttaagaatgcatgttggatcaataacaagttttgttatctatcatacacttttaaactagtgctagcaatctccaatcagtaggttggttgcttaaagtcttcacacagcttcaagaattacatggaaagacaaaattaaaaacaaaagactaaatattgctcactgctagtgcacaacactaaaacgaatagaatgttgagccgacttggggtgtgcctacagtcaaaacaaggctgcatcctgacattatctgggttggtaaatggcgcaagaacacaagcaatcaagcagcagtccagtagtagcaagggtgacttgagttggaaggagaaagagggggtataaaaaagagaaagtggtttgggcaaaggatagctcttacgagtatacggcgaggttggctacgggcagtcgttgggaggatcgccggaggtgtcccaacatcggggcggcggcggcggcggaagggctcccgagtccgattcgattcgtgtgaggaaggggaaggagagactgatagtgatgggggtaattttgtgggccaggcccatcacaaagcccatgtaaagtaagcccaaagagggaggcgatggtcgggattgattggcccaagatatccatcggcatcggcgccggcgcctggtggtggttgcggagacggcggcggcggcgcacgactgggggaagggaggcgacgctgcgctcaaccgaaggagtccagggagctaggccgccagcgtgggcaagcacgcgcccgcgcgacgacgacatcttccacctcgagctcgctcgaggtaattagtagaaaaccaaaccaatcgattagcttgcataaattaatttcgcagctgtgcctgtgcttacttgcagctaatctgcctcgcatcagcgcacacgagtagtaacctcttgttcggtgtagtgtgtaattttattaggcattattactgtgcacatgggaatttagcatttcgctggagcattcatgtatatgactttttatgtaatgttcttggtccataaatccaatttgttgagatgtactagtaattgagtggagctttgatcgattgaaaggttggaaatctcaactagatggttggattgacgacatcatattcatgtggggaaagcaacgaactgaactgaacatccacttcgaagtgcactatatcactgctccctgtaaagaactgaagtttattcattctaga

SEQ ID NO: 12267 - DNA, 1501 bp, Oryza sativa
  unsure (1)..(1501): unsure at all n locations
tcgagcaggagacctcggcgcggtgctcgccatacgcgctggcgtcaggcnccgcgtggcacggcatcgtgcgcgcgcgaggcgtggcagcagacgacgtcgcgcggttcgggttcgtgaccgggtgcaagccccgcgtgagcccgccgataccgtcgagctacttcggcaactgcctgggggctgtgcttcgtgaaggccaagcgaagacacctcaccgcggcaagcgcatcggcggccatctggcgcgtgatcgcggggctcgccgagcaggggcgggcgctccgtgacgcccacggctgggtgcccggcgcgcgggagtacgcgccggcgcgcgcggttacggtggcgggttcaccgaagctgggcgtgtacgcgacggcggatctcggcgcgacgtgggggggtcggccccggaaggtgcagatagcgtcggtggagcggacgggcgcgctggcgctggcgaagagcggccgccgtggcgaccgggacggcggcggcatcgaggtcggggtggcgctgccgcgcgcggagatgcaggcgttccgcgcgttccacgtcgagctggtccggctgctagacgccactacccactagtgctgagtggtgacgcggcctcccccttgccgccagtgtaaaaaaatcgtgccattattccctctgcttcggtgtttctggaactgggaccattttgggaagcagaggtacggaaggtcctttgccttctgctgtttctgtttgccagttgccatgtgtccgtagtagactagtagtacggttcgtctactccctccgttattaaaaaaacaaatcatgagttttcgtgtccaacgtttgactgtttatcttatataaatttttttataattagtattttcattattgttagatgataaaacatgattaatactttatacgtgactgtctttttaatttttttcttaattttttacaaataagacggacgatcaaacactggacacggaaacctagagtttgtctttttttttggacggaagaagtattactctactactccattagtcccataatataatgtaggaacttaataccggatgtgatatttcatagtataatgaatctagacaccctcctgtccagatttgttgtactataaaatatcccatccggtattagattgctatattatgagacggaaggagtactagttactcccgttctagaatatattttaaagacctgcttgggagcaatcaaaaaaatattgacttgtaattttatttcgcccgtaattgtcgggcaccaaaaataaagtgaaattaaaacccgtgcattcatggtgtttgggaaggaacatcaagaagttcgaattctgatttgacgaaatagggtatcttacgaattcaatcaatggatcaaatcagcatgaccaatcgaggaatcaaatctgaacaaacaatttagaccaaaacatcaaacagaaatcgattggaaaaaaacaacaaaattgatccgatcc

SEQ ID NO: 12268 - DNA, 1501 bp, Oryza sativa
cgagctcgtggtcctcgccgccgcctccgcctcctccgctgccgccgcatctctggggtgagagccgccgcatctcccttcatgcatctcgatctctccgatctcgatctctctccgtcgccttcgacgccgccgcctttgacgccgcgcaacgccgccgccgcatgccaacgccacgccgccgccgccgtcgccacgccgccgccgccttcgccgccgcgcgcgcaatgccgccgccgccacgccacgccgccgtcgccatgccacgccacgccacgccaccgccgccacgccacgccgccgccgccacggccccacaacgccacgccgccgccgccacgccacgccgccgccgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatacatgtatatatatatacatgtatatatatatatatatatatatatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaatgtaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgtgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgaattagattgttaaaacataaatgtctcgtgacttagcagatgtt

SEQ ID NO: 12269 - DNA, 1501 bp, Oryza sativa
gatgtcgaatcgacaagcatcgggtcggcgacaggaaacgattgaggagagcgattcaagtggtatagaaggaagaaaaggagaaaaaaaaaagagaaaggtgaatgggcgggcggggcggggcggcgcgacaaagtcgcggggggatcgaggcgtcgctgccctctctggacgaccacaagatttggtgcttgcgagcccatgcaccagtgccttttgcttatgggaaaaaagtgcacttagactcctttaattgttcaccgaatctaattcgttacccttaactgtaaaaccgggtagaatgactccccgaattattaaaaccagtgcaatttgactcctccagtggttttggagagcggttttgcttacgtggcgctaatgtggcagtgctaacccggttttcattacacgtggcgcttatatagcatttagaattaaaaaaatatatgtggggcccatccgccattcaaacgcaaaatatatcatgggacccaccgacatatggaccacgtgtcatcctttttccttcccttcttcctcctccctctctctctctcccttctctctcttctctctcccccttttctcttccccctttcgaagcatcggtggcggcggcagccgggggctggagtggcgacggcagggtgcgggcgagggctggagcggcgacggcctcgccaccgcctgccccgtctccaagcagtcccgccgccactccccctctaggcccggccggtgctcggatccagcgcgaacccggatgttggaagcaagcagtaattatgcatgtgctacttaattgaatgtggaaatgtagatgaaatcgattttttttgactgaaatgaaatcgattgtgaaaatggatgaagaagcacacaaacctgtgagctgcagctgctgacgcagcgggcaatccgggagcagacagggacgacgagcttgtcgaagtggtgctggtcgaggatctcgacgatctcctcgagctcgtcggtaagcagcacctccttctggcagttggtcgccggccagtggcggaggaagatgtcccggacgacggatgctgccgtagtaggagagctggcggtggcatgtgtgcacccaccgcgtccggtgtagcggcagcagcacgcgcgccatgaacgcccggtgctcctccttgagcggcacgacgaagccattgatgatgctgccgcagatctcaagcagctcgccgacgccgcagtggcgctcgggctccgccggggacgtgccgtagacgaaccggagcagcgcgacggccatggtgcgctgcctaaacgcgcgctcgacggtgagcttggagtagagctggtggtagacggtcttgaggcggtcgcgctcgcgcgggtcctcggaggcgaagagcgccacgaggccggcgaggaagctccggtcgacgtggttacggagcgtcctggcgtccgcggcggcgaccgcggcggtgagcacgtcgtagacgaggtggaggtgcggcca

SEQ ID NO: 12270 - DNA, 1501 bp, Oryza sativa
agctgagcttcgcggacgagtggctcatctacgacggcgacgcggcgtcgccggcggcgccggggccgaagaggttcacggcgcggcgccacgtcagcctgcgccccaccaagtccctcgcccacctgtcgccggcgcgcgcgtcgtcgtccgccgccgccggcggcggatcggcgaccgcgccgagcggcgcctgccggtacgacgtggagggctcgtacgccgcccgctgcctcgacgtgttcgcctccgccagcgccggcgagcagcggcggcgcgtggcggcggtgtgcagtaaggaggccgccgtgggcccggacgtgttccggctggtggtggagccgggcttcgagccggcgctcgccatggccgtcgtcatcctcctcgaccagatgcacgcctcgtgaaagcttcgcgcgccctccccctgccgctgcacgaatctcaaagctccctgcaccacagctgtgtgccacaaggaacaaaaatctccttgtttcttgagagctcaagacacctcctctcttttttatgcttcaagattagcaaagttatgaatcactcatgagctgagatgatcaatctgcagctatagcagaagcattttttatgtaggggtgtgacgcttttatggtttcgggttcaggatttagggttaagaatcggacgatggatgggtatccagaggtgttctataagtgccaggttttcggattttaagttagtgaaaacaaaactgtgcacttaaggttggtactttggtagggcagatgatccaagatcttgtatggagtgtatatgaacatgtaaatcccagcccctttttgtttccttcccaaaggaaatttctggtccttaatacatacctctaattaataaaactttgagtttggtttctcctactatttatctcaatattcagaatatagttaatttaattaattactttcatttgttatcctacttttttttctgtgtaatttgattgcttcagctggatcgattagcaaagttgaagaagaaattgctctagaagattgtacactgttcgatttcttttgacatgaagcaactatgaggggagaaaatagcgtaacttgtgaagtatgtttggagaagtaattcttcctccttttggggctctgtttgtgcgtagttgaatctttaagctaagattgttgggttggtgagttaggaaagtggatgacttgacttgcccaaaggaacaaaaggaacaaaagaaacgcaaccattttttcctatatacgaaaaatagagatcgaaagaatcaagctttcttttctagctgctggctggttcactgcgtctgaaagagcacagaagaagattctgttaacatgaaaaatttgttaactagacaaaaatcaagagatgttcttggctttatgtatgttctgttgatgtagcaaaaaaaatagtaacaagtggccctgtttggatggggctagcccctgtcacatcggatgttcggacactattt

SEQ ID NO: 12271 - DNA, 1501 bp, Oryza sativa
ttctactattctactcaggcttcaacaaagccaaaagaccgttcttgaacattaataaaggttagaaactgtagtactaatcaattccacatgaacaaaactacaattaatttgctaagagttgaaacatcagttaatcaagaaaggtagattgaaccgaacgcctcacctagcaggtttcttctcggtagcaagacgcgtcccgctccatgggaacttccccacttcctctccggctctgtctttcaccttggtacctccattcctcttcttccccagcctcccggggttgccgtacaccaccttgccgcggccggccctggagaagcccaccttctcatcctccatccagtgcttccccttgccctccccttccacctcggcgccctccaccgccttcctcctggcggcggcggcgctggccttgcgctccctctcgccgaggacaagcccaatggggaagaggtcgggggagacggggagcggggcgcggagggtgacgtaggccttcttgtagtcgggcttggcggcgaggaaggggccccggcgcagcttcttgccctccatgttgagggtgcggacctcggcgacggagaagccgtacatggactcgaggcagcggcggatgtcgaccttggaggcggaggggacggtcttgacggcgaactcctggacggaggagagcggcgcgggagggagcatgagcttgagggggaggttggcgaagtggatcacgcggcgacccagccggctccccatggctggctggctggcgacggcggcggaaggttgggtgtggcggctgtggccgtgggtggccagcggcgggaggcgtagggttttaggatccggcgggtccgctgtctagttgcggtgtgactttagcccatatccaccgtccggctcatccgacggaggacgtttggctgtgtgttgtttcgaacgatgtttcatgcgtcgtgcaaaaaaatgtttcatcgataaaaataaggtacataaacttgctcggcgagtgtaaataggtataacaacttgtaaattgctcgttttaatacaatagcttgtctaatttatacgaacctagtacaaaacaacacacatgcaaaattgatctaatgtgtagtactaaataatcatagtgagacatatccacgctagcagttgtttgtacttgtgcagacctgagcacactagcttaattttaaacatatcagtcaacaacgatactatattacaatctcttgtaggctgcatgcactactgtaggatcaagatgtcgactagagggggggtgaataggggatttaaaactaaatgacacctaatcaaaactaacttaagttgctaggcttagtgagggtcaactctaactaagcaactaagttatgttttgcaaacctagggtgatagtggctcaattatatctctaggaaagtaaatcacactcctatgtcaatgtttagcaatcctagggtgaaatgatctctagtatgtctctaga

SEQ ID NO: 12272 - DNA, 1501 bp, Oryza sativa
accatcctctaccgagcggtgccccagtcgtaggcggtgagcgcgccacgctcctcatccaaaacgtagatggtctcgccgttgtccaggggcgacgccgccgcggggcccttccaaccggcgagcatgcggggcggcatgtccttccaacgatcggcacggaggtcgaacactaagcgctccttagcgttgcggctgcggaggttgaccatgcagaccttgccgccggagcagacggcctccgcggctgaaccgcccgtcgcgcagcggcaggatcggctcccacgcggcggtgggcggcgaggccgcggggtcccacaacgcgccagagcgggtgacggcagggtcgtagcctgcgcggacgcccccagtgacaaacacgcgaccgcgcgccgcgccggccgcagaccagctatccctgcgccgctggtcaccgacggaggtggaagaagggtagaaataagggtatttttgtctgttcgggtattatagtaagtaggcttcaggtgaaaccactcctatacggcatttgagcgaaacccgtttttggagttagcaatatgtaaattttctcgtcctgtcgccgcctttgcccctgccggctgccgcgccgggcaaaacaagatcgtcaagatctcctcgcggtctgctcctgctcagccttcctcgccgcgcttccaaaccctaatcctcctctaatatctctgcctcgccctcacaggtgccgccgccgattcatcgccgtcaccgatgccgcgcatctccgcattcagccgccgggcacatttctcgcgccgccccccatccccatgatccaaccgccatcgccaggaacatctcttccccgttgccgatctgatccgtccgcccccgacgtccatcgctggatttcctaaggtactccactgtttactactgttcatataggaatccgaatattgtttgtagtattgccttaagcagtgcacccgaatctgttgggaaatatcgtctgtcatcttttctgctatttacttgtgaatcggtgggattttcattgcagcaggacactatctactttaatccaccttttatacttgcatgtgtgcacatgaacataatacatgcacttcggtgtaaagatccacgtggtctcaattgagtattcaacttgaaattggtgaacggattaatctcagtggcttggtgcttgtctgttgaagctaactttgtgttaggttttcttttggtgatgaggagagcccattcttttctcttgctaaacaggccatcaaatactattttcttcaggactcattttttctcaatcactacatatcttttcttcttttgcagttcttgaaagttggagtggcaacttgaggcagtgattactttttatttttcagcccagacggaaaaaccaacctaagctaacaaggaagacgagagggccagaggggagggagggattcctcttccttgctgccgccatcgaaaccgctcttcttctctgctgcgg

SEQ ID NO: 12273 - DNA, 1501 bp, Oryza sativa
gcccatagtgagcgaactaaagtttgtaaaataatctgcttgtttgtttttgtatatttgatttgcaatttattgttgatgtgcatttgttttcagtttttttttttataaaaacatccatccatgttcttgggtgtttgctcctgtgttttccagatacatagatcgcagcccttctgcccaggtattttagttttgggttccattttgactccgcgtataccgccataaattcttcgctgtcaaagaattaactgctgccctgtgcatgtatgagattgactctcatttcggttggatattaattaatgtgcatggctcagaggagctaaaggattggctgatgagctatttagtccaatacaacaacaccaattccagacttacgttttgtttgatgtttatgcattggttatttgaatttgaatttatttcgtttgttgtaggatcattttggaaattctgagtcattatctaatggagcaccaggcctccaccttaatggtacgagagagtttaatggacagcaatttggaccaacccgggttcatagtgttggcgctatgctggatcactctgcagttaatgttggttccccatggatacagaccaaaacagatgatgctgactttcataggcatgccgagaatcgcttcatgccaaacatgggaaagatgaatgcttttgctagaagggaccttcagtccacctatctctctgactctgatctttcaaatgctttatctagggtgaacttgtctaatcatttagaatatgatgaaaggggccttgccaaagacctgcttgatgaaatggaaatgcgtaatcacgacaggcatttttcctctaagattgccaatgactgccgttctcctttatctggcaatgctttgtgtacgcttggttgtgagcacttggatgttcattcactaccttcatatggagatggtcttctacgcaggcagaacagtattatggatagtccctatgtttcaaggaataataaccatcacatgaagaatgtggatcgcctatctcttgctgatcaactagctttgatgcagctaagcaatcttgacgagaataattaccatagcaatgcagatatggtaaatataatcaaccccttgagaaacagacgcaacatcacagacttggacttaatcaggagtaggaaccatttccttgaagaacttattgcacagcgttgtttgcaggaagataatgtctttcagtcaaaatctggtccctcatataatgacaacatactatatcatgatggacctcgttttccatattcaagaatgcaaagatcagggtcccatgcttattcacatttgaggggcattccatatcttggtgatcagcaatcgcggatgttatcctctagtaggaggacacctggtagaaatatgggatcacaaatctaccaagataatcctgtagcaaactgcctggatctgtcttctttggatcttgcaaatagaagtggtgcttgtcc

SEQ ID NO: 12274 - DNA, 397 bp, Oryza sativa
attcctgcaccccgttcgaagctgaagcaaagcgtgtaaaaatttgcccgcttcgattttgcagatccgatacacggtaaaatgtacagaaggatttaacaaaaccgtacggttatcacgtggttatcacaattaccatacacggtaatcttttcagttttttaaccacgatatgtctcacggttaccacgtagtttatcgcggaggttttgtaaccgtaccaaaagcaataagagaaacctgatgtgttaaatcccatatgggattggtttattttggaacgtggcgttgagattggcgttcgatctgcgcgtaggtagagaagaatagaacctagttttgccggcaggcgcgccgcgtttcacgcgatgggacgcgcgccacgtcgccggcgtaa

SEQ ID NO: 12275 - DNA, 1501 bp, Oryza sativa
tcagcgtgccgggcaaccgcctcgtctccctgccaccgccgagcgagctgcgacgtgcactcttcaacaacgtggacgcgtggctcgccgttgccgccgagtcgaagaccttggcattgtggtgctcgtcgaggaggatgttctccggcttgatgttgcagtggacgatgcagtcgcgacacttctcgtggaggtaggtgatgccacgggcggtgccgacagtgacggcaaaccgcgtcggctacgacatcttgcagcccggcgcgtcggtgaagaggaaggcatcgagggagccgttcttcatgaactcgtaggtgagcaggcggtggcgtccctcggagcagaagctgatgaggcggacgaggttgaggtggtgcgtgctgctgatggtggccacctccatcctgaactgcttctccccctctcgatcccctccagctgcttcaccgccaccaccgtccggttcgccatcacgccgtggtacacggcgccgtacttcgggctgtgccggcacaacacacaccacaacgctcactcgcacagcaccagcccggacaccacgccgagcatcacccacctgcggacgccagacaccctgctctacagcgagccgccgccgccgaggggcaggttgggtatccccgggaagcagaccttgatgaacgacgtgctgggcagcgccacggaccggtacccgctgacgaagttggacaccttgaggaagcagaggctcgagccgccgtagagcgccatggaggcgacgcatgagctgccggagaggcagttgaggcggcaagcggtgatgccgacgaagaactgctctgtcgtgatctccagcagtaggtgaggaactgcgtgttgtcaagctggagcatggtggagttgcctgggcagttctggagctcgatcttgcgccggcatcaccctcatcgctgcgtcgacacctcgacaccctcgtcgccgcgtcgttgtttggcgacggcgcctctatgtcttcctcctctccgttgcaaatggtgggcggcgctagcgtagttcagctcaacggggtggctggggacggggatggcggcagcgtggctggggacggggatggcggcagcatggctggggacggggaaggtggcgcggcggctggggacggggacggcggtggcgtggcttggggacggggatcgtcgccgcatcactgtttggcgacggctccggcgccgtcgttgtgggcacgacccgatagaacgagatgacggagattatggcgaggaagacgaagggcaaatgggtctaacaaaatttttctacacttcaatctaacgctggtaactccaaacctgacggaagtgctatggggcgaagaaaaaccggtgcctgtgcttctgatcgaaagcgaaaaattcttgtgctattttttggtaccgcttttttcctgtgctatggatcgaattttctcaaaagtaaatgtcgaccttgtgcataaggcttttacctagcctgcctttct

SEQ ID NO: 12276 - DNA, 1501 bp, Oryza sativa
cttagtggcgatcgattgtatcctccgggatcttaagagacgcgacgacttcgttttagttaattcatttcttcgatctcgtcgcattttttacgcgtcagttctttctttatctgggtgttcagttccatcagctgttgggatatatatgaccggagaggcaaaaagttaatttggtagaatcatgctttagaggaaacggaatgtgaatatatgaaaggtttgattgtgcaagtttgagatgcagaataattaatgacctatagacgcgaactttctagttttgctacacagtttgagttcacattttataggtgctagctaggcgttaaacggtttgtaggaagttgttgagcggtatagctatagctcttttgttagtctagcggtggtcgataatgcttagtgacagctagtcggattgtagtggtggtgttttctttttccatagcttttcatggttataatgccataatttttttttcttgctatatgtgataaaatatcgcacatatgttattcatttgttttagaaaaatatgtttttattgagtaccctctaatgcgtgccaccctgaaatcattaaagtgataatgtgttaattttcgctttattctcaatttgcatttggctgtcgtgatcagtcaccagctagctgcagtgtcgttgcatttgctcaaattagccttatcaaggctacatgcatccttcgattctccaacgtgatcaaatctcttctcgatctgcattcctacacaagccattctatgcttagctagctagcttgttcagtgtaccaaggttgttacatctcaggtaccaattcaaagacaaagggattatatatatcactcgtacatagacagcaattgcttaattcactgacagtttctattctgtagtagtgtacacaaatgtcgtcctcttctatcgatgtggtacatcagatggttctagaagaaaccgaaatggccatacacatacacagtacttaacttgtcgtgctcgatcgcacaacactgcaccaattaatctttttttctccgttaattgtgatcaacaaaacatggaatatgcttcacatgcaagagagctacgtgaatatgatttttttttgcccctgtttgtgatgtgctagggaccaaaaaagaagcatgaaaggagtggtcataatacaatgttactgcttgtggaaatgtcatagcctcctagacgaatcacgtctcttgtccctacgtactgattattttgggtcacatcgagatttatgaatgaagtatattatgtggggttatatctatcgcatcagaagattattttgattaaaaaaatggaagttcttgaatatatgtaatcaaagagttttatttgaaaaaacagagactatttaatataagtacattggtggtgtttgaaactcatgaagatgaagattaagttttagcgcacgtaaaatgagaaagctattaatattcctcgcaaaaaaaaagagaaagctat

SEQ ID NO: 12277 - DNA, 1501 bp, Oryza sativa
tgaaataatatttaaaattgtatctccatacatgaagcggacaaataaataatgattttcttttacattatttatatcatgtagagcaaagcatttgagtggtcaacccttgcagatccaaatatcctttagtttgtgtatatatttaaggtggaatctagaaattgtttgtcttaatcaggggaaaggagctaattaggataagacacacaaaagaattctctgttagtttttcagtggtacacagattggagttggagcagaaatatcagcaaaagctccaaacttcacacacacacacacaaaaaaaaaatacatgttaagagagataatacaacaaaacttctctactatcatttcatatctgagatcaatcgtcatgcaatttagttaaagcttcaaccagttagataccattccctcatacagatcaggaactatgtttggtggaaatcaaaatttcaccagattcgcaaatttagcaaacattttatcaattgagtacacacagaaaaaaaaaaggtctaactccaagcattatatctcctatgaaatatgttttggcaacattgaatttattcgtaaataacagatttaaaaaatggtagaacatattgcacttttgtacaatgcatgcaaacaattgactgctgccgctttcacttcacgctccagaaaataattccttctaatcatactgcttgtaaacacttccttcgtaacaaaataactagttggtgaagagggcgcaaagtacagcacagagataaatgaattaccgaaatcgcagtcacattgacataaaaatcaatcagtgttgccaccaaccacctacacagagaaaaattacaacttcaagttaaggcgcttttggacaatagttctgacctccctactctgatgcaacacatagttcattcgttaagaacatacaaactctctcaaagccttgggcacaaactacaaacctagaggtctagagcataattggtgcacttaattatccaaagttgcatccatcgagaactacctatacttcctgtctttctgcagcaccattgtgcaggtcacagacaataacattggaataatacttaaaatagtactagtgactcccaacatttgctaatcattacgcctaaatttaaaacaaaaatccaaaagcttgaaatggtctactttagtaaaaaaagcaatagctgactaacaatcagtaactagcacatctgaaattagccagcactaccaaaattcgcggcagtaactagcacccaatcctcttccatggagggggaaggaaaacgaagtggtgtatcaacgcactcacggggtgagcagctcgaggcgaaacggcgagccgtcggtgacgcaggtgtacaccagggtgcccagcatgagagcgcccagcgccgcgaacaccgccctgtacacgcctatggatcccgccgccgccatggatgcgcccgctggccgccgcgcggtcgccgagggtatcaaacga

SEQ ID NO: 12278 - DNA, 1199 bp, Oryza sativa
ccgacctcgtccacccctccgtttcgctcgccgaccgccggaacgccgtcgaccccgtcgacccgagccggggggccgccttcctgcgctccggacgactttttcgtcgtcgccgtcgacctaaggtgagccggggaccgccgccccttttcccccttcccttcccctctctcgggcggcgctccgccgtgcctatgggcgccgccgccgaccataggggcgcgggcaccgacttccgccggctgcgccggcttggctgccctcgggcgcgccgagtggttgccgcgtggggcccggccgtcagccgcccgctccctcgggtgcggctgacgcgtgggacccacggcgccggccggtgtgagcccgggtgcacccggtccaccgtggaccatgaggctgccgcgtgggccccactcccgtggacccggtccgcgcgccccctcccctcggctgacgcaataaatccgttttaaaattaaaatttaagtgaagaaattcgcaaatattcatttaaagagcatataaacttcaaatgaccataacttggccatttgaactcggaattggaccgttcaagtctctaatttttccttaagaagtcaagaacccatttttgtgctttgttcctgctgttatatggagtttattagagtaaaagccttttcttttccgttggtcgtgtagacgatgcagcttcggaagatccgctcttcgtggaagttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattacgcaacattaggtggttttataactctagactttgggaatattctcaccacctggacactatggaatggttggattattgtggaattggattcacacctccccctctattcaaaacactcaaaatggttttaggttgggctcggggtgcatggttttgatagtagcacctcggccatataaggaccggt

SEQ ID NO: 12279 - DNA, 1501 bp, Oryza sativa
atatcttcatgagttcaatcgtctagctcgctatgctccagaagatgtgcgtactgacgaggaaaggcaggagaagttcttggaaggcttaaaggatgagctgtcagttatgttgatctctcatgactatgaggattttcaggagttggttgacaaagcaattcgactggaagacaagaagaacaggatggataaccgtaaaaggaaaatgactgttttccaggaggcacaaggtagtcgccagagacagcgtatcgagccactccaaattggtgaatctttttccgctggtcaaggacagtcgcaacagttgaacatcggtggtgagatcgaatcagagactaatgaaagcaatgaagtaaacatcgagcaagctaatcaaccggtgccagttcagcaggatcagtctcaagagaataacagtagtggaagggagcagcaggtatgtttcaactgttacaagccaggtcactttgcaagagagtgtccgaagtcaaagcatcagcagccgcaaggtcaggtcaacaacattgtcgtcacaggagccaatgcagtgccagttgcgtcttcaagagttgcgttctcaagggatacagctcagccaccagtttcaaagcagcagtagttttctttaaagccttagaataattatcggagttatggaataataagatagactgcagtttacctatgcctttttctttctagccgttccgaatctcgggacgagattctttgtaaggggggtagatttgtcacaccctgattttcctcttaggatttataaattatttaataaattattaatagaatttatattaaatgttctttaatttacaagtaaatttaaatgtgggaaataaaattttctaaatataaagcatggatggatttaatttttattaaattctccatggttaattatactctctggaattttctcggatttttcggagctcaattattaattttaatcatacaaagagaagttcagcaattatttaaatattaaattaatcatcaaatgatctaattataattgttaagtgattttcttgtttaaaaatccttaaattataaattgttgtttaaaaggaattattagaaatgattttaaaagcttaaaagagaagatctaattttaatttgctaaatctcaatataaaattgggttagataaaattttattaaatactatgcttgctcctctattttctagatttttctgggaattatttgagcaatggaagtatttttaataaatgaaacatcatttcacaatttatttttattgaaaaagttcaaaaagcccttccttagttgttgggccgaattcggcccaactctctttctctctccgcgcggccgaacaggcccatttggcccagccgagccggccgccctcctctctctcgtgtcaccgacatgtggggcccacatgtcggtagcatcttctacctccagccgccggcacaggccgagcccaagccgtcgcccgagc

SEQ ID NO: 12280 - DNA, 1501 bp, Oryza sativa
tttgagcatgtaaaaggatgctccctcactagaaaattctacggcatatagttttggggctcatagaccaaggaagccaactattttatcttaatacctccatttattcttgttgcatgcacggtattaatgcatcacctcactaaaatcatctaactgcatgcatgcatacaggcctctttaagcatgggcactgggtaaatcatcgacagggaaggaaggaaggaaggaagggtacaaggagatctgtgcgccaaccgccccctgttgaggtaaggtgaggtgaggatggcgatgatgaaccggacgcgggatctgctgatggaggggttcgagggcctcgtgcgggagggctccttcacctggggcctcccccgccgcggggcttcgccggtgggcgacggcgatgaccccgacagctcgtcctcctccggcaagcaggcctccgtctccggcctctcccccaaggccaacgccgtcgtctctcgatgcgcccggtaatgacctagacacatgggtgagacaattgccttctactgaaattttgcctcgccttcgggatttcttgggtttctagggaagggaaatgctctgggacgaagcattttgtttctgatatactaggttaattgaatggaaagccactgcgttggatgtgacaattcttagaaaatctgcaaataagtggttgttcggtggctttatcagcaaccaatattacattgcatatgtttgaagatcgattattataatatgtagtgctcaggatgtgcagtagggcctatgagttcgtgtttgatctgaatgggtttggtttatgatgtccaaagtccagacatgaactgttgtgtgcaatgtagttcgttgcgtccattgtatacttgttccaagggaattctaatatagaatcaaaaccatagctgtttaagatctccctaaactgggtttttgttaagatatctggatgttggtaaatgaataacttgtgtgagctaatatagtttatgtcctttgagaacgatctgtaattcttttattagcttgattggaaacatgttgatgagcatcctgcttcacggaaccaatatgatgttgtttgcatttgctactgttctgttaagctaataggcataattatgtaatactccatccgtcccaaaatatgaaattttatataattagtattttcattgttatttgatgataaaacatgaataatactttatgtgcgacttatctttttaaattttttcatatttttttcaaataaaacggacggtcaaaacttgtacacggaaatgcataaataaacttattttgggatggagggagtattagttattcaaaatctctatgtcatgtaaaatcaattcccttttcatgcaaaaacatatgtaataccagtttttctttaattaggtgctgaacttatgccttttgtgttaattacatttcagggtacttggtacttccacggatgagcttcgatatgactttgata

SEQ ID NO: 12281 - DNA, 1501 bp, Oryza sativa
atggtgtcagccttcgcgcagagcagccgcggcttggcgatgacgacggcaacgaggtccgcgcgggagagggagagggagaggccggtggagaggagggcgagcacggccatcatcgcggtcgggcgggcggagaagcgcgacgacgcacggtcggcccgccgccgagttccccggctccagatccgtcgccgccgccttccccatcgccggatccgccgccgtcgccttccctatcgccggatccgccgccgccgccttccccaccaccggatccgctgccaccgagccccccgccgccgctgtcgccgagcccaccgccgtcgacgtcgcccgagcccaccgccgccgcggtcgcccgagccgtccgccaccgccgtggcccgagccgtctaccgccgccgccgccgccgtcgtcgagcccgccgccgccgccgtcgcctagcccgctgccgtctctcgaggacgagcgcgcgagcagggcggcgagcgtgcgatggtgttcgctcgttcacgccgttcactcgtcccaggtgggatgagttggtccgccagttttggccggatcagttggtcccggatctgagaggaatattcctctctagggaccaacccatcccactcaaccttgaaccaaacacccctaaaaatgggttcatcccatcccatcccatcctatcccagcaaccaaacactaccttattgaacagctttgcagccttatcttttcgcttacgctcatgcttatcagccgaaatttaaatatttaatcttaaatttaaagttgattttggggtttttcatcaaagtttattttttagtcttttagatcgttaagaacatgtatataaaaattttattcacaaattatttttcatttgtaaatatgttgtttgacttatttaccgaataagcgaaacgatgaggccgttgatatgattgctaggttggagtgcttctctatctagtgcaagcttgcaaagtcaggtggcatccaaacaggaaaaaaaacgctaattgcagaagattatcaatgtattatagaaatggaattccatctatccaaattcttgtcagccaaacattgcaagaccaggagactttgcatgtatacatacctcgtggcttctaggaaaaatatcgcagtcgcataacgaaaatcgctcttgagaacggacggatagccacccagcaggacgacggtggcccaggtgaaggccaccgtgccgaaggcgttgcccacgctttcgatcaccgcgagcaagcggacgaagtagttcagccacttctccggtgccgcggcgaccgccttatgatcagcttgtcccgactccgatacctgtatccggtgctcctggacagcgctgccgtcgcccgtcggcggccatcatactgattaacttaggtaattagcgatcctgcaggaaccacaagctatagcctcagcacatttgtagagcaacccaaacaaagccgatactcctatatatgtaccaaaagt

SEQ ID NO: 12282 - DNA, 1501 bp, Oryza sativa
agagaaaaaaaatggtggcattagaatcagaataccattcatattgttacttgtttttttttttttgccggaatgaccgaaggaggtcattcaatgcaattaagataggaagaaaatattacaagaaaagttttacatcgacagctggctgtcgaggaaggatgtgcactagagcacacgccccgaaccatgtgccaaccgtccaaacacacgctacagagagggaagccaagcaccgaaccggccatcgctatgcgagaccgatcgccaccgggccaacaacaccattatgacacgaagactctaaaacgacgccctcacaagggtcgcgacgccgaaagacgccgtcgtcatccgtccaaaaactggacaaggttttcacccagagttccttgccgagggaggaggggtatctcaacaatgccctcaggatggttaccatgcctgaaggcgtagtcaccgttggcccaaagaaattaggctaagctttcgctcgaaaccccttaccgccgtggtccatcgcccaatccgaatccaccatctaaacatcggcggcacatggcttccaccacacccgaccgatgcccctccgcgattagcttccagtcctgccaacgacaagactgccaccacaccgcaccgacgccccaccgtcggccgacttcatcgaaccaccatccctgagagctggcctaggacccctccatgccaccacccgccggcctcctcgccagatctggctgaaggagaacctgggactgggtggcattgcttcggcatcctgagcttcccccgctgacaagtgacaacctgccgtctcaatccaacctagaaactccctgcaaagaaggggggagctccagaaagggcgagggtgccgaccagcaacgaagaagacgacccacagccgccagctccctttgcactaccatctgagcctacgccgatgccggaaatgctgccgctccggcttcggagcccccccacggtcgccgcgtcttgggctgccggccactaggcggccaagccgagcggccgtcgccgagccgccgctgccgcacctccgcaccgacctccgtgctgcacttcggccaccgcgccgacgcaggctctactccggccgatgcgtcgacatcgtgccaccgacacagccggcgcgccaccaccactggccgccgcgccaccagccaccacatgggcgcaagcgacactccggctgccgcgtcaccgacgtagccggcgcgctgacagcccgagccgccgccacgccggagccagaccgacgcccagccaccgcgttgccaccacgggccaccgcgccgccgcagtggccctgccacggtcgccacgccgtcgctcgagctcgcgccgtcgccgcaccgaccagattcgggggtgggagggccggatctaccgcctccacacgatgccctgccatcttcgcctccaaccgctgaggttgacgctgtcggctttgccccaacctcctcgcgccaaggag

SEQ ID NO: 12283 - DNA, 1501 bp, Oryza sativa
gaaatgtatggtaggtggatgtcagaagataaaacagagcaatagaaggattaataggataacatctacattgtaaggtcaagaactgtagatctaatgaaaagggctctgtaattttggaaaggaaggaaacatattagtatcgattacacacagtataaatagagagaaaattaaacatgttagcttatgacagggcagcattaatgttaatgtggcgagttctacacaaggctgccattgttgctagtttttgttgagcaaaggacattggtagggtggaagagcagcatggctatattagggctgaaggagtttggatctggcatgggagatctattttgtagtaagaaaaaaaaaccagtggtgttgtctagatgttgtttgttggtggggaagcagaaatgctgtgtatttggaaggtgcagagagagtgaaagagggatgatagtggtaggaggaagaactaacctccaaagtggcgctcagctggcggtgggagtagaatcgaccttggttgatggcgattttttttgctctttggccggtcgctttgtcttctctgtgctagggctagggtggttgaagaaggcaagaagaagggataaggtttgtctgacaaaaaggaagcgtcgagagcatcgcatgggctttgtgggccttcgtacggagaggaagtaaatacatgggctttttggacctctgttttgtctgcacatacttatattagtggctttggagcattggctgagctgctctttgttgtagtgccgtagggaaagttcggttgagagcggcggcggcggctttttcctctgatgcatttgcgcagatctgaagggattgtgctgaccgcgcttgctttgtgcgcggtgagtatcgacgaagttgtgcgaggtgggacggcttggtagaaagaaaggaaagcgcacaggtgagtacgatctttcagattcggtttgtctgccattgctgttgaccatgaggtttgttttgttggtaagattgtttgcaatgtttggttagtccgtgctggagttagacgcgagaggatgtgcctggcttggccgagtgagagcgtagaaatgtgtagcagaacatttactattgtttgtgataattcgttaaggtctgggctgatgatagtaggaagcaaatgctaaggtacatagcaatctatatggaagaggtgcatttgttagttcctacgaaaaaagtcactgtctttctgccagtagaacaaattaggtgtgtagggagtaatacttggtgtattgtttgcaatgatagcatgtttattttaggaagaggcaagatgtagtttgctataatcaatactttatgctttgtctagctcataagaaatgaagaaaaacttaaaggacaatgtcttccattctgtaagattggaatgcaatatttttggttgtttgggcttgttatgagactgatcatctgtagatgtgtttgtgtgtgttttctgcaataactcttctagttg

SEQ ID NO: 12284 - DNA, 1501 bp, Oryza sativa
acatacccctccgacttattaaaattttgaccggtaaatacacaagtgattaattagtcgttaactttctgccaacttggaatgatggaatggtttgcacctctcttttctctggtcttgcttttggataggcagatatctctactattaaaaaaattaaagatgttattgccggtactttggtacgtcatttgtgtatgagtcggttttcaaattcgttaacttttggaaatacatatccgtatttgagacgtttattaagtccgtttacatttggaaatacagaagaagagccgtataagaaatccctttaaaaaactcgaatgctaacttaagatgatcggactctaactgcagctcatgactttaagcgaattctcatggtgaatttcaccttaattaaaccgtataataataataagattaaaatagccttcacccgtcgcaacgcacatgcattttttctagtctatatatatgtctaatccttttaggaatggaaaagagattgaactaaaatccaaaccaatccaaggtgatctttgaatcataaatacagatttttaacccttgaagatgaagtgtagatttatggccagtaaccagtcaacgacattattgcttcattctatctctgacaacatggtaactgttcaaacaggagttaattaatgatttgttaatttacagaaaattaactcagtcacaacgtgaaaccatgacaattggaaaacacaaatttagtatatagcatgtgtacaatagggcaaattcaaattaaatgacatttctcaactcaatgatattggcaattctactgaagagatgtgtttcccaataattcagatagcttcctcttgagggagcaccaatgctagtgtgcttgatgtaggtggttaactgatagcctcatcattgctgattcgaggaataagtaaaataacatatttgcaaatgaaaaatagtctatgaataaaacttttatatacgtgttcttaacgatctaaaaacaaacgctgaaaaataaaccacaataaaaaaaaatcccaaaatcaactctaaatttatgattgaaaatttaaattttggctaataagtataggcataagcaaaaacatgaggccgtttgtcagtcttgttcacaaaagggtgtgatcactagcaaaggcacatgctccgtcatcgtcatacggtccattttgctgataaaaatggaagacatgatttccactgatttgatctacagaaatagaaagtagtacaaatatttgttgccattaagcagaacttctcccactgttcaaatctgagatcagcaagaggggcagaggagcaggggaatgtgtcctctggtctacccaagaacagagcaggagccagcgtgagatttcccctgcaccagaaagaccaatagaaaaaaaaaattcagcaaaacaaccaaacaaacttcacagtcatgtcgccaattatttcttgggaggaatcgtgtgatactcggata

SEQ ID NO: 12285 - DNA, 1501 bp, Oryza sativa
taaagtaatcaatgcaagcaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgatttcatatgaatttattatgaattttacaagattaaattccaattaaacctattaaagaaaagactattccaaattaattaaacaatttacaaatgatttataacggagacagaagattaaagcaacctccggaaaagattagattatattggtagatgacatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcatggtaaaaccccggtacgacaaacgatagaccggtaggaacctagggttgcacctacggctgcacaactcgactaaaagcagcggctaggtttaagcggcacacaactgcgacacggcggcactagggcgacttggcttggctaggcggcagctcagcggatacacaaagctagggttagggtgacggcacagccggtagcaaccatgcacggctagaacagcagggctatgagcaaaaacgcaaccggcacggctgcggctgtggcaaagcggcaagcagctgcagctaagcggctcagccggcacacgcgcagcagcggcacggcaagcagcagctacgacacagcgatgacgacacacacggagacgatgatgacgttagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggctttccggcgacgagaggcaacaaccgagggc

SEQ ID NO: 12286 - DNA, 1424 bp, Oryza sativa
tttcctggtcttgaaataagtactgcatcatcaagcgtgccacgcaatatctgctccggtaggccaaaatgccggtggccgtttctgtggccgcattagattcccacatggaaacaaagcacacatcacaacaagtgtcactcacaagaaatcgtgcaagatgcatccaatatattccatcaccatcctcacctcatctccttcgtccttgtttgcttccctcgcttcacctatcaacttcttcaccatgcttcacctaatcaaattagcagctactggcttcagagttctttttttctttgaacgaattagtcaatgtgatatgattctctagaaatatctcggttccgtttcttccattctcgcatccattttttcctgacggcccaattgttgattgtccagattagtaacagagtttaaaactttgtttcagaaaaaaaaatcatttatatatttttcttgctaggaagaaaaggtatcaaagttgtaacatctcgtgtccaacatttgcactcaatgactcttcatggactctttatggctgtgttaacctttggagcagagggttagggagtattttacccagaaacgttgatgatttagtctgggttcggcagctgtggattagaagaaaaactctttcgttgtgtgcgtgcatgcttcccaagcagttaaatggtacgtttttcataaaatatttatatagaaaagttattttaaataatcatattaatttattttttttaaatttaaaatagttaatactcaataatcatgtagtaatatttacattgttttgcgtattcttctcgatcttctcctctcatcttaaacacaacatatagtctattgttaacattctttgtaccttctttgattataaaatttatttgtaagtatgccgtatgttttgacgttatgcatctaactatggagacgtccaaagtgttctcagcgtagttctacgattttgatataattgactaattaaaacttacactccattaaaagtacagacataagctggtgtttttgacacgcccatgtgcacgagacgttttgttttagtcaggagaaaaacaattaaagaagattaatcggaggttaacacacaagaaaacgtcagtgcggcccccacgtaaacagagctccattgcttgggtttgtggctatataaagcagcttctcctcctccatttctccatccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgt

SEQ ID NO: 12287 - DNA, 1501 bp, Oryza sativa
acacctgaagaataggattatgagttcatcatccagtcaataattattcggtttcggaaaaagggggaaaaattcttcacttgatgaattgccaggtcagttacgtcatgaaattagtgagggttgtcttacaaaaataagttgaggaaaatataggcaactgcactatattcttcactttttggtccaagcgtctagttaccataataatatcatgttgtatgtctttattgtctgaaagtcaaatcaaaatcctaattcatctgaagctatacacaaaccgactggtgtgagtgtgacagcatgagttttaatagattgaactttatgcaaacaaaaaaaacttacaatactacactgtgcgatagcttcatcgaatctcttcagtttgattaggcatgcggccatgttgagatgacatggatttttcacagccaaggccatatctctgtatttcccgaacaattgaaacatgaagtcatctcccatgtatgcaatcgcctgtaaagaggaggagctagaggattacgattagagaatcatctcacaacagttgaagaaggacaactaaccatttcatattgctgcatggcctcctcaaacttcttttctttgaaatactcattgccctcaatcttcctcctgtccgctgcttcaatcctttcctctactgtcatgtcacttcgggctttcccctgcagttgtacacaatttgtaaggttccttagaacatccaaatcaccttgaaaaccataaataaaatgaaaccaaccaacaatagtctcagattactatcagaaataataaggataagcattatgttgggtggagatggtaagaaggatgtttccctacctctttgacatcatcaaacccaataagttcaacttcatataaaagatctgccattggagggacatttgggaatgaaaagctcccttctttcccatagcctagctcccagccaacatgcaacagtgcacgctccccacttctcatgttaccaacaccaatgcctaaaccagacatttgttttttctctgtcggtaaaaagagaaaaaggcttttattccatatgtgataatcactgataaatcccaggtatactctacatgctcaagagtgtccaaaagatatttgtaggaaagttatatagttaccctgtacctgtattgtatatttagtgaaccatcagaaaacagggggggaaatatattagtaataaaaatataactatttagtctttatgtccttgcaagttgtcaatcgccctcacacacacacacacacacccaaaaaaaaaactagaatatcaatagcaagttgaaagttgctgatcgatcaactgattttcaaaacccttattagaatcatagattatttgtggcactataagatcagaatggcataagagtaagctatttgatgtgtatcatctatagaaggcatgcatgcagtgtagaagaactagggataaaatgaagtatcattattttcacct

SEQ ID NO: 12288 - DNA, 1501 bp, Oryza sativa
cctgtaataacttgtttcagtttgttgttgcagtagaagtgaagtctcctagctgtctaagtgtgaacgcggcgcctgactctcacttggagcccgccactgatcgacgcggtgagccccggcacgaaccgtggcgcggcggcggcgccgccgctccggccattctcgccgacgacctcgacgtcgaacgccctcacgacggcgacgctggccgccttcatctcggtgacggcgagctccttgccgaggcacacgcgttggccggcctggaacaccgggtatttgtacgggttcgccgggacgaacgacgcgccggggccggtgagccaccgcgccggccggaacgcggcgtagtcggcgccccagatgtgcggcatccgccccatggcgtaggggtggtacatgacgcgcgcgtcgccgccgacgtaggtgccgtcggggagcacgtcggcggcggcgcagaacttggagtcgaactgcaccggcgggaacagccgcatgttctcgtgcagcacggcgtgggtgtagtggaggcccttgaggtgctcgtaggtgatggcggcgcccgtctcgccgccgtcgccggcctccgcctccgcgcgcatggcggcggcgacttcggggttcttggacaggagcatgaacagcgtggtgagcgcggtggacaccgtgtcccgcccggcgaggaggaagctgacgacgatgtcgcggaggaacttgtcgtccgcggcggcgtcgtcgacgccggtggaggccatgaaccgcgacaggaggtcgtggctgctgccgacgcccagcttctggcgctcccggatcatcgccgccgcgagctcgtcgacgaccttgatggccttcctgagctccctctccgacccgacgttgaggaaccgcttcgccctccacagcaacggcgacgccgctgcgccacgcatggcggagaggcgcgacgcggcgtcgaacgcgtcggcgagctcggacacgggcatttcccggtcgaggcagccggggtcgaggccgaaggagatcttgcagatgttgtcgaaggcgaagcggcggaacacgtcctgcagatcgagcacggcgccccggtcggcggcgtcggcgagcaccggcatgaggcgggcctccacctcctgggcgatgatcttgtaggcgtaggagcgcacggcgacgctgccgagctcgaggctggccatcttccgctggtggcgccacgcgtggccgtcgacgttgaagatgccgtcgccgaggaggtcgccgaggagcgcggcgaagggcctccccttggggaagttgtcgaaccgcgtcctgagcatgtgctcgacgttcgccgggttcgccgtgacggtgcagccgaggacgtggacgtggacggttcccgtcggcgagcggcggagcaggtgcgcgtaccagtcgccgaggttggtgaactccctcgcccacgaccccgtcaggtaggcgcggcacacatggcagctgcaccacggccaccgcctcgcca

SEQ ID NO: 12289 - DNA, 1501 bp, Oryza sativa
gagattgctacgtactggttcgagaacagcgagcgagtagaatcatctctcgaacaccaatggaagttgcggtgcgagagattgctacgtactggttcgagaaccagcgagcgagtagaatcatctctcgaacaccaatggaagtgctagagttggtttattacatgtgcgtctcatgtggccagcatgactcacacacccaacttgtagcatatccggatgtccgttcgcaatcatgtcgggtgatcaagctgaccgcgttcgcgaggaattgtccgttaacaaccttttctcgagtagtccagccatggccggtgctatgagataggtcgtcggtcttcgttggcaggttgggcgcgacgactctgcattcgtcgagatcgttctcgataatgcggtgtacttgaccacaacctactcgagtgctcaattgttcctgaaaaatattttctagaagacaagatatatagcagataatatcgagtattctctgctagcattatcaggatataaagagcagatgtaaatattaggtattatgtaaaccgtaaacaagcatgatttatacagaagaaaatagagcgagcctccagcattaaaccgttgtcggcctaacaccggaaacactcgcataatagatattgtataaaaaacatgctctaggtaaacataataaattatagatctaacaatattgtatgatctgaaaaataggtacgataaattgcatataaaataatgcgtacctgtgtagatatatgctggatatatctacgaaattagtagattaacttgaaaattaacctactaaatacctttggtttgcccagatggcatatacacatataactaaagtcaccatgcatgtatgccgtatggatgtgtgttgtctgatctttgaatctgagttgagccacgtgtgcatgtgcagttggtaggaaatcggtaattttgttgaccgtgtatcccttgacttacgtggcctcgcaagtctcttgtcacggcaagggataattagagtccgattcccacacagcatacgagcacacgtagtcgtctaggattcaggggatgagtcgtccgatttcctcggtgatggcgttgatctggcggctagatggtcaaccgatcggctctagtgaattttcagagcagacactgtgacccgaagatatagctggcgccgacgaagtagtgaactattgtcctccacggtcagctcaagtactccgattggtgaggtagatcaatttgttgacgatgatgatctcgatctcgtcgggggaacgtacttcgttcgggttagatctcccagagccgaagttgtcgagtaacttgttgtcggagaatccatctcttaaacccatctcgtcgaaaacctgaagcaccaaaatcccactacctggcgcgccactgtcgacgtttaatgttgcgactacggtatttggacagtatggggatcgttggtactagggtatacgcgagactgaggtaaaagaga

SEQ ID NO: 12290 - DNA, 1501 bp, Oryza sativa
ctttcgcacgcctcgccccgtcccgtcggaatgatgagagcctctaggcacttgtccctagatggagccggcgtgggaactcctggagttagcacgtcggtcccggctagattcataccaggcttcatcgcaaccattacaaggaagtcattttatgaagaagggctgacgtgtggcatgctaaactgacacgtggtagacaagaatgaccggtttgtgactggtctgacgccggtcacgtcatcagcaaacaaccgtgcttccacgttgcacctgcttccggcggagtggaggttggtatgacccatcccatcggaggctcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagaggggggactggagaaaagaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgctccgtcaatgtcctatacggaaacaacctacggatataggagggagttccggataaggaaagacaaccagagttctacatggaaacgacaaggactactcggattgtatccatattgatttccctagttctacttggacaaggggacacctatgggtataaatacaagcctccctaggaggacagggggacacacacgcccaccacgagacaatcaactcccaacacaatcaacatagaagcctacatacaccaagacaagccgccggatatcgacatcagagatacgcctggatcgaccctatctggtaccttcagaggccggccgtagggatctagcactgtctctgattccgtcgggtgcgagctcgaggaggaaggctaccctgttgtcgactacgagtcagaccttcagaccgccatgtcgacaacagttagataggctaccctacatattgtactggtgtgattatggtgaataaaaagcaacatcggctccggccaacaagatgtagggctattacctgatagctcaggggcccgaacctgtataaaaatccatgtcttcatctcttttacctcagtctcgcgtatatcctagcaccgatgatccacatactgtccaaataccgtagtcgagacatcaaacgtcgacagtggcgcgacaggtagggggattttggtgcttcaggatttcgacgagatgcgtttaagata

SEQ ID NO: 12291 - DNA, 735 bp, Oryza sativa
gctagtttaattttagtttcgccgcactattaagaggggtaatgacctagcaaagagatgattttaattgccacattaggtcattgcattttcatttgtgctctctttttcattacacaaattcactgggttcggcctgaccaggggcggtcagaccggccggctacatagtggcggtctgaccggcggcactttcccggtcagaccggcctcctggaggccgagatgatgctgctcgggatggccgatacagagccgacggagccgtagtcggtcagactgagccgatggcggtctgaccgagccgaggccggtctgaccgggcaccccatgtcggtctgaccagcctggccgatggggccctctgacagggctacaacggctagttttctagccgttgcagagtagcacggtctgaccggccgcatacctccggtcagaccggcagagcacagagttggggaatttcgcccccaacggctagttttggtgggtgggagtataaatactcccccaccagcagcaagggggctctcttggcacccaattcaattgcatacactccttgcacctctctcacactcacttgagctttgtgttcatccatctagtgtgttagatggttgtttagccaagagtcaagtgcatttgcttccattgtagagctagtgtggcacttgatcatctccacaccgggtcattgcttgttactcttggaggttgccgcctcctaga

SEQ ID NO: 12292 - DNA, 1501 bp, Oryza sativa
aattaatagataaattgccatgccgcatcctctttaaactcggtcacttagggataagcttcctttattagattgatttccttaaccaaatatagcaggaacccgactattggcgacttgataactcctatcggctgattccgagatgttgcggccgataatgattctaagccgatgacgtatttgccgattaccaaattttactgttaacacacgccctccccgcgatgccgccgcacgacgactccatattcctcctcggcgcggcccaccagccgccgcgccctcccgtcgtctccaatgccctcaccaagctcgaaatggtgatggcgccgagacgacgcaagaagcagcgtcactgcccgccgccccagcccggcggcctcccctcaagccgccgccgtactgcccaacgccctactgcccgccgccgtgacgctagtcacccatcgctgccgtttctggctttccgtgagagagagagagagggagcaagagagatatggaagggaaaggaggtgggagaacatatagaggagctgaccggtggagcccactttttttaattaacttttcactgagtagacaccgccacgtgtatgccacgtaagatcgaaaccgctctggattgcgctaggggggttattcgtctggtttgaaaagttctaggtataaaatgtctagttttgtactccctccatactcgtaaaggaagtcgtttaggacagcgacacggtctccaaaacacaactttaacttcttatttctataaaaatatttattgaaaagtgatatatgtatatttttatgaaagtatttttcaagacaaatctatacatataatttttacattttaaaactcaacaacttgagagttattcattatttatattcccaatgtttgacttaaatattgtcctaaacgacttcctttatgagtatggagtagtagttcgggggtgtaactcggccgacctcgatagtttggggggggtattttgtactttttcctaatcatcttttcgtccatattatacgttactctgggtttatcgtaaataactttttctatgtttgattaaatttataaaaaaatagtaatgtttgataatactaatatggtattgtaaatgtttctacgtttttatataaacttatttatactttaaaaagtttatttattacaaacccaaaataacttgtaacgtggaacctgtaggtacgaacaaggtagtagaggagcagagatcgatcggctaaactcccacgtgaaccagacgctgcaccaaaaacaattgcaaattgcatcttcccttccatgccggatttccccgatcccgctgaagtcgatcgtcctctttttgctggctttctgttgactgttattttatttatctctcgcctaaataagtacaggccggcccagccgatagatcggaccggccgatcgagcgattggctggctcacacgcgcgcgcgccgtgcgagcaggtgacagcct

SEQ ID NO: 12293 - DNA, 476 bp, Oryza sativa
aaaaaaaagctagcagattggcactttctgtcatgcatgggtgctgatgattatcttgtatctaatttaatcaatcccatggctgtgattgatcaggaatagtttgtgtgtgcagctatattgcctattggtgtccagggtcacacaccataagggcatgcatgtcagcagctggtcatgtgtgccttttcattcccttcttccttcctagcactatataaaccccctccaaccaggtgctaagctcatcaagccttcaagcaaagcaaactcaagtagtagctgattaccagctcttctctcttctcattgagaagagggaattaagttttgatctctgctttattgcctgatcatcctcttgttacttgcaagcaagaacagtagtgtactgtgcctcattgatctcctcccaccaaactctctctctctctctcatattccgagctagctagttaatcaagatcttgctgcaa

SEQ ID NO: 12294 - DNA, 1501 bp, Oryza sativa
cccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccag

SEQ ID NO: 12295 - DNA, 1501 bp, Oryza sativa
cgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtca

SEQ ID NO: 12296 - DNA, 1501 bp, Oryza sativa
gagctctagtatacgtacgaccgtatttacgtgcgtatacgtaattattaattgctcgcttctaataagtatttcttctttgcatctgcatacggccgcaacgtgtatgtatgtgtttgtggttaattggctttatttttatttattttttctttctttttttccgactgcagtgtcggtttgtttcatgtactgtactctgtatatattcatgtactgtgtgagatatatatgtgacactgtgtgcataagtatgtgtgtacggcatgcgtatatatatatacgtatgtttgtgctcagttaatgtatgtatgtgtgattgcatcatattgtaattaatcagtttgtaattaaattcaagtgtaatttcttctaatttaaatatacactaaaagttactccagatcataaaatgggggactgcagggccgagcgcagccaagcctgcaatttttaattttcttcataagttctgatcataaatggacttttagtccgatcctatgctgttaaagcacaccttgctatatgccaaattttgtctctgcttgaatatgccgtccagtgatttgtagttttaccaaggacaacggttatagtattatttcgtccaatgttagatatgattgatgaggccaagtgcaagcagcgcttgaaatttttttatacaacctaatttaagctagtatgattatcatcacattacatcaaccacaaactatatacatgtgataaaaaaaaccacaaactatatattaatgctaaaactaattacatcttacatagtgttttcgttctagacaatcagtgtatatttaataggcatttatggttacctctgttgagacttccaattatgattttacccacttttccaactttgtaactttgctctcattttttgactgaagcttgttcctgtcatttcattaaaatgacttaatggtgttaaaattcatttcaagcttatgctagcttgtcctcacattttcatttaaaaattgaattcatattaaaaaaaggggcaaaagtcatgataaaatgcaagggcatgtgtgaaattattagttaaaaatgataggaaaatcataaaattaaaaaaccagtggtaaattaaaatcatgaccgaaatttctttttttttaaaaaaaaggaagaacgtaattgtcccatatatatgggccattccaattaattaatcagactaagatattgactacaactcattgactacagtacatatctgcatttttttttactacttgcagctagatcaagtttgttaattaaggatagtgtctgctaccttccaggtttccggccaaaattaacagccaaatgccaccgttttttataccctgttgaaaaatgaccttgcatatgtaacaattaattacttggatccagctagctgagattaatcacttttaccagattgacacaacagtgaacgtgcatgtaaattaaaactgcatatatatatatatatatatatatatat

SEQ ID NO: 12297 - DNA, 1501 bp, Oryza sativa; identical to SEQ ID NO: 12294

SEQ ID NO: 12298 - DNA, 1501 bp, Oryza sativa
acgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtc

SEQ ID NO: 12299 - DNA, 1501 bp, Oryza sativa
aattttctgttctttcggatagcgagagcctaatggtctgtgcgttggatgaaatgatggccccggttaggccaggccaggccacggtatctggccccatcacgcacgtctttctcggtccttctcaaatcgtttttgcatgcgtagctagttgtcgccaatctacgagcacgaggctagcagtgggttcataggcggtccaatgataaacgggcacgaaactatataggtctgtttggacaacttctgacagcggtagggccggtagccggtagcttcttttaaaatttttcagttgcgaagctttctcaaccgtctagatttttatttaaattttgagaatatatagttatataatttagaaaatgaacttaaccttttcatatccttaccggtagctttttaaaattttatgatcttccaaacatatccacagtgacttgaacagtttttacgcgttcacgaaaaataaaaaaaaaaactgtactagtacgtcaattagacaatcattaatttgccatcttgttactgtactccagtcgtgatcgtgatgctgtttgctccagtcgatatcaacctttccagtgaatatgttcttcctacgatttgagaattctttttggatcgacgggtttcaagatatacatgccagttagtactacgtattatataactttttgaaatatcagataaactaaagtttgtttttttcggaaggggatctcttctctgtgaaacggtgctaatgcatggtttgtgagaacggagaagagatggtcctccttgtgataattttcctcccaatttttgtgttgcatgcaatgataagctgtggaaatgcaactggtgacgtgtcaatggaatgagtcagagtggtgaattaagttccttttgattttgatttttcgagttgctccttgttagataaatgtgcaagtggctctcatatgcaaaaggggtatagttaaggagaggattaaaaaaacgtgttacctataaatgcacctttaccaggtcaagaaaataaaacgaccgtcctctgattgtgtgttgcatcatcaatgaactcaccatggaagacgaaaggtattaagtatttttaaaattaatcatgggacaattggaggaagatatacctagttaaattccaacgtccaatgacatgtctcatctgtgcaggacatgtctcatctgtgcagtttgtgctcctccaattgtagtaccatctagtggagccattgggtgttattgtatcacacaaatgaccttggatgagcacagatgacattacattattattcggtatgaaacttttttataaactcgagggcttcccgtgagatttgcagatgtttcacgtgaaattgttcagtttttgcataatacaatactgttacgagttctagcctggctataaaaagacgtgcatgcgtgtgtgggtgtgtggtggagtgagtaaaaagtgaagtgtatgtatcgtgtgcgtccgtttatactttaa

SEQ ID NO: 12300 - DNA, 1501 bp, Oryza sativa
ctatcagtatacgtacgtacgtaccgtctgcgagctctagtatacgtacgaccgtatttacgtgcgtatacgtaattattaattgctcgcttctaataagtatttcttctttgcatctgcatacggccgcaacgtgtatgtatgtgtttgtggttaattggctttatttttatttattttttctttctttttttccgactgcagtgtcggtttgtttcatgtactgtactctgtatatattcatgtactgtgtgagatatatatgtgacactgtgtgcataagtatgtgtgtacggcatgcgtatatatatatacgtatgtttgtgctcagttaatgtatgtatgtgtgattgcatcatattgtaattaatcagtttgtaattaaattcaagtgtaatttcttctaatttaaatatacactaaaagttactccagatcataaaatgggggactgcagggccgagcgcagccaagcctgcaatttttaattttcttcataagttctgatcataaatggacttttagtccgatcctatgctgttaaagcacaccttgctatatgccaaattttgtctctgcttgaatatgccgtccagtgatttgtagttttaccaaggacaacggttatagtattatttcgtccaatgttagatatgattgatgaggccaagtgcaagcagcgcttgaaatttttttatacaacctaatttaagctagtatgattatcatcacattacatcaaccacaaactatatacatgtgataaaaaaaaccacaaactatatattaatgctaaaactaattacatcttacatagtgttttcgttctagacaatcagtgtatatttaataggcatttatggttacctctgttgagacttccaattatgattttacccacttttccaactttgtaactttgctctcattttttgactgaagcttgttcctgtcatttcattaaaatgacttaatggtgttaaaattcatttcaagcttatgctagcttgtcctcacattttcatttaaaaattgaattcatattaaaaaaaggggcaaaagtcatgataaaatgcaagggcatgtgtgaaattattagttaaaaatgataggaaaatcataaaattaaaaaaccagtggtaaattaaaatcatgaccgaaatttctttttttttaaaaaaaaggaagaacgtaattgtcccatatatatgggccattccaattaattaatcagactaagatattgactacaactcattgactacagtacatatctgcatttttttttactacttgcagctagatcaagtttgttaattaaggatagtgtctgctaccttccaggtttccggccaaaattaacagccaaatgccaccgttttttataccctgttgaaaaatgaccttgcatatgtaacaattaattacttggatccagctagctgagattaatcacttttaccagattgacacaacagtgaacgtgcatgtaaattaaaac

SEQ ID NO: 12301 - DNA, 1501 bp, Oryza sativa
cggcaaaagaacctggccagaacagtacaactgtaactaataaaacaaggctgccaacaagtacaatagatcctgttaaaaacggttacagcaaaaggagaaatctctagttaatttctgaaagtttactactccctccaggctgataatacttgtcgttttggataagggtgtagtcaaactttataatctttgattataaatcatttttaaaatatttgtcttttaaatatggtgactatatgtatagattagtcttaaaaagtactttaatataatcgtatatttgttaacaattttatacatattataatgaaaaataatggtcaaagttgttttttagagaccgtgcccttatccaaaacgaaaagtattatcaaaccggtatgaaacaaagaaatcagcaatcagggcgatttggccgtatcagtaataagtaaatggaatatatgttccgctcaaaaaaaaatagaaatcagcagtcaggcgagacgcaaaattccttcttgatcttctaacctccagactccagaggcgtattggattcagattggaagatttttgcattaacgttgtttccaaataagccagaagaccaaaatgatctgagagttgaacgcggcacgttgatgatctgcgtcatgacatcgacctcactccacgattaaccaaattccatttcatggcatcggtagcgctgtactaaccacccgtcagccaacaagtctatagttgacgagacctcatgggaagtcctagttacatacctcatttttcgttaagaaacattaaaaaaacaaaataacttagtacaggtagcttaacacaaaatagtttagagcaaatagctggcctacaatatatatgtttttttaaaacacagtataacgttcacacactcacctctataaacacatatttggaaaactgagacaacacatatgatttttgcacgggctattaaaatagattattttacatagaacaaatagcttagaataaatgatccaaactatttgaaaaaaaagaagatcgagcgtgggagtaaataacatgtgacaaaaatctggtgaagaaaaaaaaaagaacaatctgtcgccgagacctattttcttccgtcaaaagccgaaaagataaactatcgctacaaaactgaactctcgatagagatcgagaaaagtcgacggcagcgaaacctcgcggcatatgcagatatgcttttgtccttgccatggcgaagtaatctcatgctcttgctcagcactcagcaggtggaataagttcactttaggtccctctatttgtcggttggtccgattttcgtctcttggccgcaaaaccggatacgacccattccccaacttacgaaaaccggacaaacgagatcccttggcagtatagaggacggtttttgccgacgtggcgcctacgtggctcctttaactagatcttcatcccacatagtgttaaggtggcgcttacgtggcaattttatcccaaa

SEQ ID NO: 12302 - DNA, 1501 bp, Oryza sativa
cacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccaga

SEQ ID NO: 12303 - DNA, 1501 bp, Oryza sativa; identical to SEQ ID NO: 12295

SEQ ID NO: 12304 - DNA, 1501 bp, Oryza sativa
attgaattagacaatgtattggatgtgagtcaagagcttcgatgcttcattccctcgaaaggatacgatatgcttgagcgaacaattaataatgaaagatacatgcatatcgtcatcttgatataaataatattttagagagatatatatcgttcaatgacccaaaatttacaattgtttttgtttgcatccatgaatcaatatatcaattgattccacggatattgaaaaggacacgtagtcgtaaatgtgtattatagatttattggctcattttaaagtacaaacttgcaaaaaaaaaataaaatccttggatgatgtcgcatgggttatttgggtgctcctcatcactaaggacaccaaagaaaacatattttttaatctgattttgggggcctgtctgtcattttcaaatgcatttgttgcgaagcaaacaagcaaagagaaagtggaaatttgctcttacccctgcaaaacatgtatcctacctagccgcatcctccgatcgaacaagacaaagcaaatgctccacccacagttccacacgcaacggccagaacaagatcacgtatgccatggcattgccatgcctctgcttagcgcttacgcttcccggctgctggtgatcgatcgagctgggccgttcgctgcatgtgttcacacgggccacctccactgcaaccaatggtaaaatcccacgtcatcgtaaccaaggtgcgacccacacctccacgtcatcatctccagctcgtgtaggtttcgtacgtgcgcgtagaaaaaacgcaccccatattcctaatccagacagcacacaggtctcctcccgaagatggcgtccgttcgatcacgcggtggttcggatcggacggctcggaaacaccggacgcgtagccccttagtcggcgcggacgcgacacggacatcctacggcgcgcataaatcgctacgcgcacacgaccctaccactctatggttttccttttgggtcccacatgtcattggaccacaggcaagaacgctcctctccctccccctctgccgcggcggtcaaaaccagcacgcgccgaaatcccgtacttcccactgacacgtaggccccactgtcattgaccgttacaactcaggaaaaaaaaggggaaccccacccaccagaaacgcagcccccagcaatgataagtgggcccagaggaaatgtggggcccacgggtcagtgggacgtggccgtgccgtgcggggggcgaaaggtacggtcgctgaggagaggctggcgtgggcggtggagcgcttcccacagccctcggcggccgccacgtgtgggccgcagccgcatctcttctctctctactctcccaccctccacctcccgctgcttctcctgttcgtctcctttctcagtaactgcacccacctccacacctacacgcacacagacaaacaaagccaaaccccccgcctcgcctacatctcgcgctctccgccccccgcccgcctccactctgca

SEQ ID NO: 12305 - DNA, 1501 bp, Oryza sativa
cgacgaacacacgcttgctcgtgaaggttgcgtcacgtctgacgaaatgaaagaaaaatagagatttgtgcatctgtagaattgtagaaatggagtggcaatacacagtggttggagttggactgaattactgtacttgatcttgatcgatcgatcaatttggtttcttttggattcacccgagttcatctgtaagacagaaaaaaatccttgcaaaaaggaggacgaataattagagagaggttaactctattccctgctgcactgcaggatgcagacagtacacttgatactgaaagaaccttcagaaccaactgatgaaaacgccagcgtatagccccacgcttagcttctaatctagctgacgataagtctcgatttcgatttggatgattaacaaaacatcacatcggtttggatcttaaatgtaagattgattttgatcgaacttaacagcttatagtttatactgcaacgaaaactgaagaaagcaagcttgctcgctacagtagtaggaactaaatttaatcaggccttggcccaaagaagatttagcacataaatgttggcccaaatatcttactcaggccgtgcttactcagtacactccggttgtaatggggttcggtgactaaaaccacggaggaacgggccgttagattcggcccatctctcaccaggtcgaaaggccccaccgcacagtcacacaacgccgttaggaaaaagtctactccgactcccttcagaaggaggccactctaattcgtaccccttaactagaaaactggatcagatgactccttaactattgaaaccagtgcaatttgactccctcagaggttttggagggcgattttgctgacgtggcggtgttaatctagtcttcatcccacgtgacacttatgtggcattagaattaacaaaaatatctgtaggacccatctgtcattcacactcaaatatattgtgggacccacaaccatcctctctctccaacccctcttcctcccccctctctctctcccttatcccaacatgtgaggggggacctcaccaggagactgcgcatggggaaggagctcgctggccagtcgtgcgctggggaggatctcgctgggaggtcgtgctctgagaggagtcgtcagttgggcacgcgcagaggagaatcttcccaactaagcacgcgtgtgggaggagttcacgatgtcattgtgggtgaggttcctcacataccaagcaacgcaattcgtgtcactctctgttgccgcctcctcaccgacggctgtggcccttccaccaaagttttcctcacctctctgtgcccctttcgtcacccttccccacatccgactcccaccaccgactctgtctctatcacccggtagcgttgtcgacgtcccacgtccatgttgcttgggagcttagtgacgccgctcgcgatgctcctgtccatctccgtcgcgggagacccttgctgcttgggagcatgaccccaagctcc

SEQ ID NO: 12306 - DNA, 1501 bp, Oryza sativa
  unsure (1)..(1501): unsure at all n locations
acggcaaaagaacctggccagaacagtacaactgtaactaataaaacaaggctgccaacaagtacaatagatcctgttaaaaacggttacagcaaaaggagaaatctctagttaatttctgaaagtttactactccctccaggctgataatacttgtcgttttggataagggtgtagtcaaactttataatctttgattataaatcatttttaaaatatttgtcttttaaatatggtgactatatgtatagattagtcttaaaaagtactttaatataatcgtatatttgttaacaattttatacatattataatgaaaaataatggtcaaagttgttttttagagaccgtgcccttatccaaaacgaaaagtattatcaaaccggtatgaaacaaagaaatcagcaatcagggcgatttggccgtatcagtaataagtaaatggaatatatgttccgctcaaaaaaaaatagaaatcagcagtcaggcgagacgcaaaattccttcttgatcttctaacctccagactccagaggcgtattggattcagattggaagatttttgcattaacgttgtttccaaataagccagaagaccaaaatgatctgagagttgaacgcggcacgttgatgatctgcgtcatgacatcgacctcactccacgattaaccaaattccatttcatggcatcggtagcgctgtactaaccacccgtcagccaacaagtctatagttgacgagacctcatgggaagtcctagttacatacctcatttttcgttaagaaacattaaaaaaacaaaataacttagtacaggtagcttaacacaaaatagtttagagcaaatagctggcctacaatatatatgtttttttaaaacacagtataacgttcacacactcacctctataaacacatatttggaaaactgagacaacacatatgatttttgcacgggctattaaaatagattattttacatagaacaaatagcttagaataaatgatccaaactatttgaaaaaaaagaagatcgagcgtgggagtaaataacatgtgacaaaaattggtgaagaaaaaaaaaagaacaatctgtcgccgagacctattttcttccgtcaaaagccgaaaagataaactatcgctacaaaactgaactctcgatagagatcgagaaaagtcgacggcagcgaaacctcgcggcatatgcagatatgcttttgtccttgccatggcgaagtaatctcatgctcttgctcagcactcagcaggtggaataagttcactttaggtccctctatttgtcggttggtccgattttcgtctcttggccgcaaaaccggatacgacccattccccaacttacgaaaaccggacaaacgagatcccttggcagtatagaggacggtttttgccgacgtggcgcctacgtggcttatttaactagatcttcatcccacatagtgttaaggtggcgcttacgtggcaattttatcccana

SEQ ID NO: 12307 - DNA, 1501 bp, Oryza sativa
caattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcaggatgtgacacaaagtgtgtttcctggttttgtggataggacaccaggaccttgtcacttcggaagtcatcttcgtcagctcgcggttcatgtcggaacgacaaggtttggccgcattagaatccttctcgagctcggatgtcgtcgatgttccgttctccgcctcggcgggaggatctttcgacatggagtcgtcttggtttgtagccattgcgttctcgtttctagtcattggcggaccggttgagatcggcattgtggtgtaaaccgggaagacgatttcgccgacttgagtccacaccagcatcgttgaagcagggaatacttggctgaggttggtgttgacgctattgtcgacgaggctggatgacatagtagtggaaccttgagtaccaagtccccctacctggcgcgccactgtcgacgggtgatacccgtagaccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccagcgagatcatagtcgagttggttcgactagatccctagcggtttggctccttgcaggctccgacttcgtaggctgtgagggttgtgttggctctgagattcgatgcctcaggccctccccagggggtcccttttatatcacaggttaggcggtttccaagtagaactcggaaacatcgaaccttacacgatacattgacgacccagtcttgtccgagtagaactccttccatttgtaaactccgtgaggggtttccttaatatatgcggagagtatccgtatacgcgtgggtataccataccgatatgagacgtatatcaaagggtaaagggtatacctaacccgtaaccctgacacatgtttgtggagtgatatatttcatattaatctatgttgttatttttttcaaatatatttataactatttaaatgatttacaaataacaggggatgtcctctcgtgggatgaaaatcatgtgttacatgagacaaaacgtatgcacatgtataaaattggcccattaccatcgtgactttggaatgggccgggccggattacccgtgacgtgctttacggcacgccaacttccgggttgttgattaccgttgagaagt

SEQ ID NO: 12308 - DNA, 1501 bp, Oryza sativa
gttcaatccaccataatctcggacctcataccacgattcttcatataaattagcaacagggagggagggaggaggagatgttggacctggtcggaggacgaggcgaggacgcgggcctgcaggtcgcagacaaagctcgcgaaggcggggtccttggagttcgggagcagcacctcggcggcggtgatcacggccttgacgcgctccaggttgacgacgatggcgcgctcgcgacccaggatcgtggaagggtacgacagcagcgggtccagcacccgcaggtcgcgcgccggcagccccgtccgcgccatcaccgcgtgcttcccggcctcctccacccgcgcctgccccgacgccggcacgaccagccactcccggctcgccgcggccgccgccgccgccgctttccgcctcccgccgccgccgccgccgccgcccgccgccgccgagggcctcatcctctctataccctagggttagggtttcgatcgacggaaaccgtggaaaggggggatgagttcgcgggagccggatgtcgggagatgcggcattcggcggtggttggctcaggagagacggattcgtggggagtaatacgcgatttagacaagggtgtttttggaaaattacaggatcgctggaaattgtggagatcagagtaagagtaagggtgtttttgcaaagtttttttgacatgagagttgaaagccatcattagccgttggattaatgcgggccagctgcatatgaggcgggaagagaagtgacgctaccatggggttggcattccttcggggtgatacggcaaactttgcatctgcttcatgtagagcatccatacgtgaccaaccgctggattcttagtttaagtctgtagaaattaaaaggagaacatggagataacaatagcatgtttgttattggtgctgattttctgaattcatttgttaccgaaataggtgcagtacgatgttagttacttgtaagatatggggggggatggaatctagctgttggtcacgtatggatgctccaaataaagcaacggcaaagtttgccgtatcaccctgaaggcagacgatgccaacccgccacaatgcatcccaaacagctaggccttcacttcagcgacgtgggcgaaaaccaatcgacgcaccgggccatcacgctggcaggaatttttttttgcaaatgcgtagaagattgcaaattaatattaatatattagatgatgccccacgctttgctgcggtatatatatcagataatggagaaatgatgaaatgatttggattgaaatattataaaaataatttgagaataatgatttagcatgtgaatgttttgttttagaatgaaataaattgtagatataattaatatgtgcttgcacgttgagtttgtgtgcataatgggtttatatggcatgcttgcatgtagattttataggagtgctaataaatactatgtttgcatattgagctttaggtgtttagtggac

SEQ ID NO: 12309 - DNA, 1501 bp, Oryza sativa; identical to SEQ ID NO: 12302

SEQ ID NO: 12310 - DNA, 1501 bp, Oryza sativa; identical to SEQ ID NO: 12295

SEQ ID NO: 12311 - DNA, 1501 bp, Oryza sativa
ataggcataatgaggatagcagggaaaaagtatactttgactccctcaagtatggcccgagtatgattcatgaccttcaaccacaaaactgggtatatggactctaactatcaaaaccgatacaaactatatcttttggtggttttggaagcggttttggttcaagtggtgcctacgtggcggtgttgacccggtctttgtcccacgtgtgtcgacgtgtcgcttatgttgtattagaataaaaaactaaaagcaaaaaaatatgtgggacctatatgtcattcacaaataaatattatgggacacagtgacatatgtaccccacatgtcatcatatctctcattcccatcttcccccttctcgctctccttatcgttacgtcaccctacactgggatgacgctccccattgtcacctccgtagacgatgaagtggccacggcgggggtcgacgtcgtcaacgctgagtcgtctctgctgccggtggaatcgccgaatgacggcttgaggacgagcaagaagggacggcaaggccggagccaagaaaaatagagaggaaaagtggcaagttgggcgcgtaagagatgcggagggaggggaatgttggtgtggcggtggcgagcaagggacggaggtcggcggggtcacccgcggtgagggaggcaacaacggcctccaccgccatcactccggcaccctcatgtccaccgccgacggtcgtcgccgcccgtcgccgctctagtcctcgctcgccctcccgcccgccactgccactcctgctcccgcccaccgctgccagcgtctcgttgcagaacgggtacccccttgctcgccgccgcaggaagaggaagaggaggaagaggggggaggaagaggaaggagagagaagagaggagaggaagaagggaaggaggaagaggacatgtgtcccactttttttttgtatgaatgatatgtcggtcccacatatattttttactctaatgccacataagcgacacatgagacgaaaaccgggtcaacaccgccatataggcgccacgtcagccaaaaccgcttccaaaaccactcaaggatatagtttgcattggatttgatagttgaaggagtcgatatacctggttttatggttggaggtcatgaatcatactcgtgtcatagttgagggagtcaaagtatactttttccggatagcagccaaggtctgctaggattcttggtgggcttcgaaacttgagtcctcggggctcaggctatagcccacgcagccttgaggcctctttcctctcccgaccctgacgtggttcactttgagtatcgcggcgccgccgtgctcgcgattaacccagccgtcgcagctgcagtctccgccgccgccatggcggctcgtgcgctgctctcccgcctccgcttcgctcctctcagccaccaccaccaccgccacctcggccgcgctctctccgccgccgccaccgccgatccaccacccgacgagtcgccc

SEQ ID NO: 12312 - DNA, 1501 bp, Oryza sativa
agattcccgtgcgcgacacggtggttgcgcgggtggtgtacgtgttctgtggtggggaggtgcgacgttgcacggtgaggtccggggacacgtagtaaggggaggtacgtacagtacgatgtatcatatcatatcggtcggggtggaggcgaggcgaggtgaggcgatgatgatgatgacgacgacgacgacgctgatttgatttgaaacgtcgaccccatgcgcgcgcggcgtcgtgtgtggtggtggttgtgggccgtgtggacgggagcagtgtgtgtgtgtgccgtcctttcgcggtggacgtaccgtgtacgtgctcgcgttttcgtggtgatccgacccggtgaagtgaaaccattggcagcgacttctcctccgggctgcttctctactagtctggtcttgttgtgcacacagtactgactcctttctttttcccaacagacatagtttaggatttagggggctgaaatttcgaaagtaaacatcgacacatcgttactgccattttttacataccgaatcgtaatcttgcatgtattaatgagtcaagatgatgagattcagtttcatacgatactcaaaaacttaggagtgtttgagaacggacagggcaataaaagaggtacaaccgactcgtactttgcataaaaacaagacctggaaagtactaaaaaaacaatcaactttacaatagaaaccgaacaaaaatcaaagacagcttcacggatcctcatgcacgatgtgcaatcaactgcctctcagttcctcagacacgaagtactttctcacgcaaggactcaagaggtcgatctttgtgatggtctttgggtttcagacttgtcagttgtactcacctcgctgtagggagagaaggctaaaaatgggcttgttgtgccattgatgggctcaacagcgatgacttgaccagaagaatcatccccaagcccagcccagccacacacggctcaatcacgaccgtccaaaaaacgccgcgaccaccgaaacccaatccgacggtctgggtcccctcctatcgtggccacgcacgtcgcgcgcagcactggtgttccggtgtgctccgctcacccacccgatttccaaacccagcggcgccgcacgctgaccgcgtcacacgctttcccaatccccacgaacgcgacgacgcatccgaaaaaaaaaggaaaaaaaaaaagaaggcgaaaaggcgatatcgcccgagagagtccaaccccctccccgactcgtacgcgaaagctcgaggccgcgcggcgccgtcgcgcgggttaggtttttatttttttttacttttggttctccgatcgtcggagaagctttccggcgatgctctcggtgcgctgcggaggcggaggcggtggcgccgccgccgtggaggagcacggcgcggtgcgccaccatcgccctctcaccccgcgccagcagcagcagctgcgcacggtggtcgaatccctccggctcgaccccctcgaaggttcgt

SEQ ID NO: 12313 - DNA, 1501 bp, Oryza sativa
taaccccaacgattatggcctacacttttccaaaatgaaatggtctcaccctccaggcattcgcaatgctgttgaagcactctgggcaattcggctggattgcaacagcctcctcgttcttcgcgatgcacatgtcaaactctcgtagctaaaccaaatccccaaatcagtataacacccacgccagcaccggataaccacggcacccaaaattccgaggagaacctggtaatagacggcgccgagcagcaggaggttctccaagagcctcgggttcgccctgtacacggcattgcagtgctccagcgccgctttgtaatcccctgctctgtaactctgccgcgcgatctcgaggcgcgcgccctcgtcaactgaaacccaccaaaaccgcgacgggttaacaaccccacgacgaaaatgaaaatctcggcgcaatcgaatcacggaacagcgagatgaatctcgatcaatcatcagagaggggaagagaaggccaggggttcctgatcgacacgaacgaaacgaaccttcgagggggtcgagccggagggattcgaccaccgtgcgcagctgctgctgctggcgcggggtgagagggcgatggtggcgcaccgcgccgtgctcctccacggcggcggcgccaccgcctccgcctccgcagcgcaccgagagcatcgccggaaagcttctccgacgatcggagaaccaaaagtaaaaaaaaataaaaacctaacccgcgcgacggcgccgcgcggcctcgagctttcgcgtacgagtcggggagggggttggactctctcgggcgatatcgccttttcgccttctttttttttttcctttttttttcggatgcgtcgtcgcgttcgtggggattgggaaagcgtgtgacgcggtcagcgtgcggcgccgctgggtttggaaatcgggtgggtgagcggagcacaccggaacaccagtgctgcgcgcgacgtgcgtggccacgataggaggggacccagaccgtcggattgggtttcggtggtcgcggcgttttttggacggtcgtgattgagccgtgtgtggctgggctgggcttggggatgattcttctggtcaagtcatcgctgttgagcccatcaatggcacaacaagcccatttttagccttctctccctacagcgaggtgagtacaactgacaagtctgaaacccaaagaccatcacaaagatcgacctcttgagtccttgcgtgagaaagtacttcgtgtctgaggaactgagaggcagttgattgcacatcgtgcatgaggatccgtgaagctgtctttgatttttgttcggtttctattgtaaagttgattgtttttttagtactttccaggtcttgtttttatgcaaagtacgagtcggttgtacctcttttattgccctgtccgttctcaaacactcctaagtttttgagtatcgtatgaaactgaatctcatcatcttgactcattaatacatgcaagattacgattcgg

SEQ ID NO: 12314 - DNA, 1501 bp, Oryza sativa
acttcccaaacaaacatctgataaatttagcctaaattcagaacattatcttcaatttatgctagatgagagataagagaagggaaaccgtaccggaggaggacaggtagaccgtacgccgatttctgccattgaggaaatggttgtgtcagctagcaacaccgtcgggcaagtcgctgaggaagaattgaaagatccactccccgcccgccatctgtgctagcagtgagccaccgagtcgaccttgatgccgaagaagaaggcgacgctgcgatgccatgcggcacgccgatgctgaggacgggatggggagtatgtgatgctattcaagcttgttgtacgtgcagccacagtgaagaacataaaggggaacaaacaaattgggaagagatgcggatgcggagaggacgacgacgagcggatgccgagaagtggaagggggcaacgcggatggctcggcgagcagtaaaaccacgtctcggtaagggttggccgcgcaacctagaaggcagaaaacaaaaatcaaaatcaatgagcataggcatggtcagaagaacatcgacatcacaatggtgaaatccagagcgaagcacaactgaaaaagatcaaagcatacgggatgatgcgactagggaaagtaccgtctccacaaaaaacaggaactaagaggaagaagtaaggaacagaaccagcttcgaatgaaagaaagaaaggagcgatgcaggtaccctcgatctgctcctcatgggggtctccgcgcgtatttttagtggagcagccaaccctgtcattcccgtacaccatgacagagcactaccatggatgagagaggggctgctgggcattggagccttggaggtgtcgctgtctcgctgatggccgacacgcggcggtgccgattcgctgaagcggagcggacgagaaacacagccttcgctcaatcctagccggacatgggttggagaatgggcacgcgtcaagacggtagcggtggctcgcggatggctgagcatacagccaaaccacgacgacgcaaggccgcgccaccgatgccacgatggccagtaaaaggccgtcggtcgctgggccaaacaatcagctggcccatggtagcaggaccactgtaacgaaacaacgtgtccacaccgtattggatgcgcctctccaaatcgctaggagagcagctaatctagcacctttaaggcctccttcaatggttgagctagtgcactagctcatgcttgtccacctcatacaagagatagcaaaaagcctacctttttaataggttgtctcatagcacattgttcaaaatgctttgggttccacaacccctctcatattttgtttaggagcttagctcttgaagaagagatagtgcactctctctccttatcttctctctcttctacatcatacaaaagctgatgtggagatttatgagctagctgactcatccttgttggaggaggcctaagatagctaatccagcacctttaag

SEQ ID NO: 12315 - DNA, 1501 bp, Oryza sativa
taaagatgtccatttttagtcccgattcaaataactgggtttaaagataaatctttagtacctattggtgttacaaaccggaactaaagttttttttccttttttttcattgtatttttgttgtcagcatattgatttcacgccgaactcaccaacgtcacaaattcacagctaaactcaccaacatcacaaaattcacggatcaaaatgactacacgaattcatagaacattgacattactaattcacatgctcaacaaacaacacaagtccacacatcacaaaaccaacaatccgcacatcgacatcagcgttgccgacgacccctccgcccgctcggccgccgcctatgccaccctcccttccacctgcccgcccgggcaccgcctcccttccaccgaggagtgtgcggttgaatttttttttcaatctttggtcctggttggtataaataaccgggactaaatgttaatctttagttccggttggtgggactaaagatagtaaggcctgatgactttttaaaccggaactaaaaatgttatcaaccaggactaagatcaaaaaattcccttcagctttttaacagggactataaagataatcttagtcccggttcttattcgaaccgttttttagcgatccaacaaagattaattctctagtagtgtattagttgcctgaaaacatgcgtatgtgtgtaagaagtgaagatagaagagtgacagatcaaaataaatcaaagaacaatacacctctgtcccaagtacagtcgtagcatataacttcgcaaattacaaacttaatgagaagtaaattaatctcatacgtactcatatcagtttcgtttggaaaagcagattgtgatagaggaacaagaacccctcatgtcgcgttaggcatgcatcggccggcgatttgtcttggattcttatgattctgcctttctcctttttggatttttgtccatgtattatattctctctcagagttcagacctgcaggtcgacagtcaatgcgtatttgtactcttcgacgtttttgtttttcctcgccgctcgctcctggcacacatatacatccaatcaggacgttagatgcatggcacggtgcaatatggccaaattaagcgtgcatccgcccatcatgcatagtcaacacattattcttctacttatggtcaggaaaccatcgtattcgccgtagtacatagagagatcctctgaatgaagagactggttattgttctagctgtgagttcacgccaaaattgaaagtttggttgaaattgaaacgatgtgacagaaaagttagaagtttatgtgtgtagaaaagttttgatgtgatgaaaaaattggaagtttgaagaaatatttcggaactaaacacggcgctagtactattaaaattttgaaatgaaggcaagggcataagtcataattgagtactagttggtaatttagagtactcagcagatatataattaatgtactttctcctt

SEQ ID NO: 12316 - DNA, 1501 bp, Oryza sativa
gggccgagccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctga

SEQ ID NO: 12317 - DNA, 1501 bp, Oryza sativa
tgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgag

SEQ ID NO: 12318 - DNA, 1501 bp, Oryza sativa
ctttttttaaaaaaaaaaactggtcatgatacttccaagtcttgtgacaacgctgcacgaaaaaagaacgccatgaccacgaatttaggttggactttggagggagcgggcagagcaggcgaaagccaaacctcgcgtctgtcccatggcgtggcgggttctcctaccagcgttgggtagtacttcctccgtattaggttacacaagtcgtttaaatttgttgtcaaaattaaactatttcaaatttaattaagctcatagaaaaaaatagaaacattttcaacccaagacaaaatatattatgaaaagatattcaattatcgatttgacgaatcgaatttggtgtcgtaaatattatactatatttgtctacaaacttatttaatcttgaagcagcttgactttgatcaaagtcaaaacgatttataatctggatggagtagtaagggcatgctcaatgtataaggtctacttggataataaggtaggacccggtattagttatagtgtttgctacaatgtatatgataagagaagacattagcctgggtcccactggtcccactcaattgcatggcatgtgagagagaagatgagagagagaagagaaagtattgctattttattcttatgggtgggcattatgcatatgggtagctcatgttaaagactactatatggactactatcacaatgttgtcatggttatggataccacatacctaataatagttgactaaatctcggcatgacccaccacataccatgtcctatacggaaaccgacttcagatatggagggagttccggataaggaaagacaactagagttctacatggaaacgacaaggactactcggattgtatccatattggtttccctagttctacttggacaagaggacacctatgggtataaatacaagcccccctaggaggacaggggggacacccaccatgagacgatcaacacgatcaccacgatcgggacgaccacctcatcaacgcccaacacaatccacatacaagcctatatacgccaagacacgctgccggatatcgacttcagggataggcatggctattcccctacggtatctccggataccgtcaggagatacgaaagcgctatctctgatctcgccgggcacggattcgaggaggaagactaccttgttgtcgactatgagtcagactttcagaccaacatgtcgataacagttagataggctgcccacatattgtactggtgtgattatggtgaataagagcaataccggcttcggccaacaggatgtagggttattacctgacaactcaggggcccgaacctgtataaaaatccctgtctccatctcttttacctcagtctcgcatatatcctagcaccaacgatccccatactgtccaaataccgtagtcgagacatcaaacgtcgacagtggcacgccaggtagggggattttggtgctctaggatttcgacgagatgggttcaaacga

SEQ ID NO: 12319 - DNA, 993 bp, Oryza sativa
ctaccccatacacgcggagcgaaaacccacgaggggtcagggcgcctcggccctcgggcccgaggggggtgcagcccgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacagtagcccccggcgttatgccagggcgatcgccctccttaagggaagcggtcgggcgtgacgccactcctaaggcctggtgacaggtgggaccggtctccacaattgggcagaaaaccaaacggtcacaaatcacgcacatcggcagtggtaattcggctgtcaacaatgagcggtctcttcaagactgccacattactcgagtagcacacgaatctggacatggcgattcgtttcatctgaagatatggtaacgtcgcttcggttggcgagcgtaattaacgcgcgcacgatatgatctacctcgaccgccacaaccgcatatccacctcatgcgccgcaagcgggcgaatgggattagtggaagcgtgggcgcgagaaacgagggggcgaaatagtgggcgcgagaaacgaggagccgggcatagcgttggcaagggtataaaggcactgaggaagggacttgtttccttcctttcgccattattccccttgtctttgctgcttgcgccctaactcctcctttcctgcgccctaccctcgccacacgcgctcgctcttaatcttctcttcctccggcgccatggcacggggctccgctctgctcgatggtagcgtgctgccgccctcccgcatcgtgagcgagaggcaggctgggctgccgcgccgcttcatgccggaatcggccaccggccgggagatagtcacgctgggcgagggacgcccggcgccagactgtcacgtcctgataaattcatcccgaattaaaaatcattcgct

SEQ ID NO: 12320 - DNA, 1501 bp, Oryza sativa
agcgtatcccgtgtggcgtttctgaactctgatgggggtttcagtcgcaatccaatccaatccaatccaaaggaaggcgacctcgccggttaccacttcggttggggttcgtttcgtttcgtcggagagaagtgttatacagcttcagagttaggaagccaatgtactccagtagagtagtagtgcatgtgtgaagtattgtcgtcctacatggacgagctgtgcaaaattgcactctgaactctgaaccagaaaaatacgtggagaactagagaacatgcaaacgtagcaggtggtgcggacatcgtcttgtttgaaatcagagaaggatttgagtcttctgaaggtaacagaacatgctgtccgtttttatgttgggtcaaaacgcataaaaaccgaaggtgcgagaaacaacaaaaaaattccgttgccgggactcgaacccgggtctctcgggtgagagccgagtatcctaaccagctagactacaacggatgcttgctctaatagatttcataattttattaaaagttaacattttgcaaggtattcctataactatgaggataattattggggcagtgtgagccttctctaatcccgccatctatgtcatcttcatatgattgctttcctgcatgatatgattaataatcgctgaaacaaaatacaaattgtacaagcaactctctcattttacaaaatcacaactccatcattttctttacggctgataagatataaaaaataaataaattgagtgaagcagctaaggataattgatgagaaacttttatatgttgttagcaatttaaaaagacaatcctgaaaaagtaaactacgaaacttcttaaaatcaactctaaaattaagttttaaaattcaaattttcgctaagaccgatggaccataagtaaccgatgtagtaccgttagtatttgtgtgctgaatacacataccaaacgaggccgattcgaaattacatgcaagcacctccgttccatgcatcagctaattttagaattcaaaatttcaaattcaatctgttctaatacgcaagaatgcccaatactgccacacacagtgatacaggcatctccgtccaaacctcacggccgttgatccgacgccgcgccgcgacgccacgtagcccccgtgccgcctcccttgggccttggcccaggtggcgcgctccctcgacacaaatctccggcctcccgcttcggccgccatgatccaacctcccccaatctctctctctctctctctctcgctcccctccgcaacgcgcgacctcacacgtccccctcttcccgctcttcctcctcctccccctcctcgcctccacttccacctcgaaatccctcctccaattccagcgccccgtccccgtacgcttcgtcgatcggcggtggatgcgggtgggggtggtggtggtagggaaggggcgatcgatcgagcatggccaaggcgtgggagaaggtggcgacggcggcggggt

SEQ ID NO: 12321 - DNA, 1501 bp, Oryza sativa
ttttcagacgacagatcaggcaagttgtcaggcaagtgtgtgcacaaatcagccccaggccaaggcaggcaggcacgagagcgtgctatagctacttgtaagattcatgcatgctacccatcgactacgttacaacttgcaacactgttcgtacggccgcgtctcatatccagccaagggaccccttccccccacccccacactactctcaacatttcggccttgttgcttggattcaatccgggccaggaatgataaatgtagtaaaaaatttatgatagatacaatgggagaccgggatttatttcgggccgaaaaccaatttatttatgataggaataataaaagatcaggaatcaatccactagtcaagaggtgtggaactaattctggtctcttagagcaagtttaatagtacagtcgactactagctccaatttatctatagtcaatctaatagttcattcatacaatagttacatactacactattaatacatggtcccacctgttatacacacaatgcgtctttgagtccgtgctacagctggctacaaatctgtagcccgctgctcttctctcttctcatttatctccttaaaatatgtttgcagctggcttataacctgctattgtacctgcttttattgtccctatcatgagtaaattggttctcggcccagaataaatttcgatttcgatctcttattatatctatcataaattttttaatatacttttcatttcccgccgcgtaacactgtgcaactgtgcactgtgcaaccgaacagggccttcaggggcgttgcactgtgcaactgccactgcgctgcttgcattgtctctctctctctctctctctctctacacgcgcgcgatcgagtggtattaaactcactagctcagtgcggcatgtgtgcgtgggcgtgggccgcagcgagcgcgagccacccatgtgcatgcatgtgcattgtctcctctcgatcgatctctcctcctagccaatactcctctcctagtcctcctagtcctagctaaccttcttcttcttcttcctctctttccctatagctaagccaatataatggagacatgggctcccctctcctctcgtgatgatagttagatagctctatctctctatttctctctctttccctttctctccaactcacattccagagatcttatccaatgaacctagctacatacatgtacgaaaagatcatcatcatgatcaacgagtagatagtacgtgcacgcataattgatgcgtatgcatgccaatgcctacttatatgtccatgttgctccttcgattctgatacactccctcccatccatttccatttctctcgttgtaggattaattcttgctccatttcaactttgctgcaacacgtacacctaccatagctagcagctgtttgagcttgcttggtcaccaccatgccttcagctagagtgcaagctggcggcggcggcaacggcggcgccggcg

SEQ ID NO: 12322 - DNA, 1501 bp, Oryza sativa
cgatacgatagtatgcgactcattggaccaaccgaccgttggacaatatcatccacaagtacatttgtaaaaattaaaatgcaccggaggataatagtttaattaatctgcaaatcaaacaggttaattaagcgagacgatggatctctctccctctacgcaggattgggcccaacaaacgaattggagatgatgtacgcgcaaacgtaccaggtcactgtttgtgcgctcgaagtcgagcaccttgacggcgacgatctcgtcgaggggcttgcagagcgatcggtacacgatggcgctgaccccctgcccgatctcctcgtacagctcgtagtcctccacgcggatcgggtacttgcgcctctcccccgacccacccaaccccgccgccgtcgccaccttctcccacgccttggccatgctcgatcgatcgccccttccctaccaccaccacccccacccgcatccaccgccgatcgacgaagcgtacggggacggggcgctggaattggaggagggatttcgaggtggaagtggaggcgaggagggggaggaggaggaagagcgggaagagggggacgtgtgaggtcgcgcgttgcggaggggagcgagagagagagagagagagagattgggggaggttggatcatggcggccgaagcgggaggccggagatttgtgtcgagggagcgcgccacctgggccaaggcccaagggaggcggcacgggggctacgtggcgtcgcggcgcggcgtcggatcaacggccgtgaggtttggacggagatgcctgtatcactgtgtgtggcagtattgggcattcttgcgtattagaacagattgaatttgaaattttgaattctaaaattagctgatgcatggaacggaggtgcttgcatgtaatttcgaatcggcctcgtttggtatgtgtattcagcacacaaatactaacggtactacatcggttacttatggtccatcggtcttagcgaaaatttgaattttaaaacttaattttagagttgattttaagaagtttcgtagtttactttttcaggattgtctttttaaattgctaacaacatataaaagtttctcatcaattatccttagctgcttcactcaatttatttattttttatatcttatcagccgtaaagaaaatgatggagttgtgattttgtaaaatgagagagttgcttgtacaatttgtattttgtttcagcgattattaatcatatcatgcaggaaagcaatcatatgaagatgacatagatggcgggattagagaaggctcacactgccccaataattatcctcatagttataggaataccttgcaaaatgttaacttttaataaaattatgaaatctattagagcaagcatccgttgtagtctagctggttaggatactcggctctcacccgagagacccgggttcgagtcccggcaacggaatttttttgttgtttctcgcaccttcggtttttatgcgttttg

SEQ ID NO: 12323 - DNA, 1501 bp, Oryza sativa
ataggtttcagattagcaaagcagtacactttttccgtcgttgtcctcttttattcctcgcgccattgcactctgcacgctgcgctgcagcagagcagcgggttttgttgcttccctcccattagatgggtgggggcccgacctggccattagcaacagcgagcgcactagtcctccactgcccaaagtaaagtgctccatgtcaacaggtgaggccgtccgggagatgatcagatgaatcacaattaacttctacttgtatttttattgctatcatgaaacttgtcacgactcaccaccgcacgaggcctctgatggatgcaattactgtagatatgtttatgttaatccttgtgtacgtcaaataaatcggcagtacgccagtacgtagtagggcaatgacaacggacagtccaaaccgacgtcgaatactctatagtatcccggtcgacgggtcgagagcccgaaacggtgcaggcacagcacatttggtttcaggccttttcaggttgcagatgcctcgactctactacacgcgtgtcagcgtcttgtttgcctttgcctgggttggcgcgacacagaatcggagatgccaccggccaattgatcctggactcgtgcaacccgatacaaaatgccacgggaagctcgggtttgccgaaaattcacgggaccttgctccactggtcgcacatcccgatttcacaccggaatagtagccgttttactcgtttttcccctatcctgacgtagtgcaagatcatcatttctactgcaatgtgcagagagcaactcatgctcgggttgcaaatattaattcaaaacgatgaatcatcaacggattctcttcaatttatttgctctaccagatttacaattaacagagtttggaatacaaatatttttttattaatcaaatcctgataattagaagcgcagctcatgagggtagatctcaagaacaaaacacattcttattccctatgcaataaagaaaggcagttcgggtacagctcagaacgacgagaggccaccgaccgcgttgacgggcccacccatgtggtccaacgtgggtttaggtgggccccaccccgacaatcccgccccacctccatccacagccacagacaggtggtcccacctgacgccataaagcaacccggccccaccgcccagtgccagcgacgcgggccagctggcgaccacctcacgcccttcgaggcgccactcgcttttccccttctctctctctctgcttatcttatcacattagaaaaaggcccacggttggctcatatttacaggagactgccactgcttctcctccttcctatttcttctcgcattctctccctcgtctccgggagaaaattttgcgggcggcgaaacaaactagtaatcgattcgaaatttaaacgcattgttgttttattgtttgattagtttagctcaagaaagattcatagctcagctatgaccagccagattacacacaaaaaat

SEQ ID NO: 12324 - DNA, 1501 bp, Oryza sativa
ccgaacatgtataaacccctattatctcattgttctcgaggaatccgatctcactgagttctcgaatctcacccgctgcctccggccaaaccaacaaagtggggcctcactgtcccccgctagcggagttcaccctccaacaatggggcttggggaaggatttgcgcgcagggtttgggtttggagaatgattcgcgcgtgactagggagatagaaaggaaacggatgcgttgggtttgatagcagtggtgggtaatttacataaattttttaagtgcagtgggtcttcgtgtccgttgcacaggattctggaacgtcaattttcttatcttcttttttttttaagaagaaagatattcattacttagcttggatcggtcaaagactcaagcgtcgtaactttctgaagtgagatatacggagtactatttacatacgcaaatccgagcgatggcgactggcgagaggtggtgagctaaggtatctatccgtacctgcgccgcgcaattgactttcccggccgcgcaccgcacgtcgtggctgcgtttcgtttctcggtctcgcgcgcgtggtgtcacgtcttgacccgccgctccgacgatctcgcgcgtacgtacgtacgtacgcgacgacgactgaatggcaacagcagcagccgtacgttgccgtcgccgtcacgcacggcgcgacacttttgccctcacctcctacgcctacacgtagtacatacatacatacacgactaaaatacacgtacgtagtacgtaccacgagactaggacgtctctcacctaatgggccggcgcgcctaccgtcatcaaggcctgaaaagcataagttcatgtatatatatgggctctctcatcgaggcccgattcagccgaggccgaggcgacacatcgtaacgggccggaaaccttattgggcttcgtccttgggcttagaaaatccagtttccttcttccaattccggccagccttaacacacaaaacagctagcgcccgttgtattgcagccgtggactggacacgctggaggaagcatcaaaaccagtattttacgcagaagtaaacgcccagaacgcccaacttgcccaggactttcgtcatgctgcagatgtcaccacctataatacactgcccggatgaacattccaaacccccaaccatatctcatcgtaaaatttgcagctcgtataggacagtaaacgaagaaaccatcgtcgtacgtcgtccatgtctgacgcccctcccatggccgagaaaccaactgtaagtatgccaatgtctgcactttttccctctcttagactgtgtttagttccacgctaaaattagaagtttgactaaaatcgaaagcttaaagtaaaaggtcggaagtttatgtgtgtaggaaagtttcgatgtgatgaaaaaattggaattttgaagaaaaaattggaactaaaccaggccttattcgattcttgcatctctcgctgatctgatgagtatttgcaga

SEQ ID NO: 12325 - DNA, 1501 bp, Oryza sativa
gtctaagtacatcttcgtactgccagggtgaatggaataaggactttcgtgagcttcctgaagtatcagctgtttaagttccctgtcgtctggaacgcatatccgatttccgttccatagggttccgtgttcatcctctgtgaaaccagcggctttaccctgtttcatattcttgaggagtccatgcatatccggatcattcttctgagcctcgcggatttgatcgagcaaggtgggcttggcttccagcgtagccaagaatccacgaccaactatgcttaggttcaaggcttccatctgttgattaagttcgggtggaatgccacggacgtcaagagtgttgcaatggctttttcgacttagagcgtcggcgaccacgttggccttaccaggatgatagtgaattcccacatcataatccttgatgagttctaaccatctcctctaccgaagattcagatccgactgggtgaagatgtatttcaaactcttatgatcagtatatatttcacagcgattcccaatgagatagtgccgccagatttttagagcatgaactaccgcggctaactccaaatcatgggtagggtagttgccttcatgaggccgtagctgccttgaggcataggccaccacatgaccttcctgcatgagcacgcaccccaatccttggcgcgaagcgtcacagtacaccatgaagtccttgcgagtatccggtcagactaaaactggcgaggaaaccaacctttccttgagagtttggaatgccttctcgcattgcgggctccacacaaatttctcttctttcttcaacaactgtgtcatgggtcgagcgattttggagaagttctcgatgaacctccggtagtatcctgccaaacccaagaagctgcgaatttgagtgactgtcttgggttgcttccaatcaatgacggcggtcactgtttcggggtccacagcgactcctttagcagatatcacgtgccctaagaatttgacttcggacaaccaaaactcacacttgctaagtttggcatacaattgatgttcccgcaactttcccaacaccagacggagatggtgctgatggtcttcctctgattgtgagtacaccagaatgtcgttaatgaaaaccacaacaaacttatccaggtattccatgaacactttgttcactaagttcatgaagaaggcaggagcattggttaaaccgaacgacatcaccgtgaattcatacagtccgtatcgcgtggtgaatgcggtcttcgggatatcttcttcacgaatacgtaattggtgatatccggaacgaagatcaatcttggagaatacagtggcacctttaagctgatcgaacagatcatcgatccggggaagagggtacttgtttttgatagtaacttcattgagagctctgtagtcaacgcacatcctctttgtcttgtctttcttctccacaaaaatcacaggagcaccccagggggaagtactcggccgtata

SEQ ID NO: 12326 - DNA, 1501 bp, Oryza sativa
ctaaccatatggcctacacgccagcgacaccaaagccatagaccaactgcattgacaatgcatcgcccaccgtcaaacacaccgaaaattcacaaacgcaattgaacgacaccgcacaaattatcacggataaaggccgcacgatctagggcctgtttggttggtgccacattttgccacacttgaggtatgttagtttgaccaaatgtggctagtgtttggtttgtttctataactttagcataccacactttctactcttttggtcccactagtcatagaccattttcttagccaaagtttgccacaagtgtggccatcaaattttgagccacacaatttgcatcttgccacacctttggtaaaaaaaactatggtaaattgaggtgggcatccaaacagcccctaaatcaaacggatagggtggcaagcagccacaaaagcccaccaaactcaccaggatcctagtcgtggttgacatgtgaggagtcaacagcatccatggcagcggcaaaccgtggtggggaagagcagaaaacatcaatgctttgggctcctgcatgtaaattctcccatcgccgccaagctgctactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggtgtggacgccattgatgagccaccggatccgctggcaaagaaatcgcggctgccgcatccaacacccacagcctccccttcgagtctgcgtcagcggcggcgtagcaaggagagcaccggcagtgagggcgctgcgaggacaccacccatccacaacatcgatccccttcgagcggagaatggcagcaacgtagggaggacacccggcggcggccacggcactgggaggacacccagcggcggccacggccaagccaaatccaggcgccgcgcaggagagagcgagagagatgagaggggcatggcggctgggagttttttccttttttttttacgcgcctgggattctcgcgaaggggagagagagagagaaagaaaaggaaattttgcgaaaatgcccttcagtttctaggattcagggcgcagtccttttttcctctttttgtctcctttgtattgaatttcgtaggatgcaaagggcctaaacgcaatattttaaaccgagaaaagaacagagaggacgtataacaaaatatctataaaagagagggcttttctgtaaaatttgcagaggcgacgcggacgcatgaaaggccgtgaaatccatccgctctccagcgcgcgtccacgcgtcgcgaccccgtgatggccacggcagcgcaaaacgctgagggcgctgcatttcccagttggtttgaagactttagatagtcgaacaaacaggcgacaaatcgaattttc

SEQ ID NO: 12327 - DNA, 1501 bp, Oryza sativa
atggtcaccgtggttgcctcctctcccacctcacctcgccagcctccttcgctcccgacgcttccctctacccagcgccgccatgtcgctcgtcgtcggccgtcggacctcctcctctccgcaccggacagccagcccacccaaatgacgacaagaaaaacgagaaagggtagaaagggagagaagaggataagagagagggtaatgccgtggtcaccttgatatgtggggttcacgtgggttccatggtgactcagtcgtcatgtcggacaaaaccaggatcaatgttgtctaaggacctggaatgatctagttttgtaagttgagggatcttatacatctggtttttttagttgagtgacgattttgtaattcggtgacaagatgagggacctcggacgtactttttccgtacgaggacaccttgtctccatatggcccatcaaaagcccatcaccgtcgttctcttccttcttcccaccaacgcatcctccctattcttccccaacgttcaagttcaaagttcaaacaagcagccatggctaccaagaaacctccaatcatgctgtttaactattaaaactggtagacagcaggctagtattaatcacacataatcatattaaaaaatataatgcagaaattatcagtgatcgaggttccagccgtctaatttcccgaacagattttcttctcttcagtttcgtcctcataacaatcatcgtctccttcttgttcttcttcttcttcttcctcctcatggtcggcagcataggcgcagccgcaggtgcaggggttgtcgtcgtcgtcgatctcgcactagacgtagccatgggcggcgagctcggccttgacccactcctgctgctccttgtggtaccggtccatctcccgcttggccaccgcgtcgtcggcgtccacccgccgcagcctctccttgagcgcgtcgctgatctgcaggcggccgatgtccacgtcgtagcgcggcggccgggctggctccggcgaccacgacaggatgaggtcgatctgctcctgtggcatcctccacttcctcagcttcttctcctccttcttctcttcgccgacgttgttgacctcgtcgacggccatctccgtcgtcgcggcggtggttcgatcgatgctggattaatcttggattgcttggggattttttttttctgccataaataggggcagaaaggtctccatgttcttcttggtttcctttgcgaattcggatggaataagttcacttcatgaccctcaaaagtgatcgaaatctaatccatgacctcaaattacaaaaccggatatcttgacccccaaactcttaatacccgtgcaattttactcccagtgcggttttggagagcggtttcgctgacgtggcgcctacgtggcagcattgactcggtcttctttccacgtggtgttgacgtggcgctgaggtggcattagaaataaaaaaaatatgcgtgggacccatctgtcattcaca

SEQ ID NO: 12328 - DNA, 1501 bp, Oryza sativa
cttcatcgtttggcttattcatatatttacataaaaaaaataatttgtgaatacaacttttatatacgtattcttaacgatccaaaagtagaggctaaaaaataaacttaggtgaaaaaaatcccaaaaccaactctaaattaaatgttaaaaatttaaattttggctgataagcaaaagatggggctggaagtgcgaccatgtcgcacacacgggccacggcctcctgacctcaacaagggaaagcggagatgggccgatggctactcgtcacggcccataaaagctcgcttgttttgggccccatatattgggccgggcatcctcagatttctttttctcagagaaaattctgaccggagaatctctcgatcaacagccaacgtggtaactcaccgtgcaggccggaccgccagcagaattcctaattcccgcgtatgcgccgtcaacgcgtacttccggcccacacacgtgtttctttttctcttttttttttggcgcagttaatgtttgcagtgtcataattgtaaatcccccatttgctaccgccatgtttcttcctttttttttcacagttcgatgtcgcacgggtaggagaaaaaatcataattagtttactagtaatttttaaatcttaacttaaaaattttcagatttggtcttgaaagttttcaaatctcgagttgaaagttttcaaacctcgagttaaaaatttttaaatctcaagttgaaagttttcaaaattttcaaatctgaacttgaaagttttcaaatctcgagttgaaagttttcgaatctcgagttaaaaattttcaaatcttaagctgaaagttttcaaaattttcaaacctggactttaaagttttcgaatatcaacttgtcaagttgaaagtttcaaatctgagttaaaagttttcaaaatttgactttaaaatttgaatcttaaatcaaaagtttcaaatttagtttaaatttttgtcaatctgttaataaaaaaatctaaaaaaaagataaaatctttaaaaaaattcctaattactgttattaatgttaactaatagagatagttaagtgggaagtgcgcgctagcggcacactcgcctgctagccactgccactgccacagtgcaggttgcatgacttgcatcccaaaaacaaacaattaaccaaaaacaaaaaatcaaagcagtatagggagatggtgaggcagctttcggcttggacacttggacgtatacaccaccgactggctccgtccatgcttggctgctctgcgccgttgcctctctcatctctgaagatttgaagaggatgcaggcaatgcagctcgagacgaagccaaaaacagcgcctatgcaatccaagcacggactctctgtaaaataatacacactcacactactagtagtatactaccactacggtatactactatgagacgacgacgatggtaaaatatcataattcgataacgtactactcaaagtcaccaggttttttc

SEQ ID NO: 12329 - DNA, 1501 bp, Oryza sativa
tgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtacaacctcatccagctttatcccaagaaatggaatcattagttgacagcaacagccttcaccatattccgaacccaaagatcatcctcaagaaaaggagcatctgaagcagcaccttgacaaattaaagcttgacgcatttacccttgattacaatatatgttttttactggtggcatgccaggatatggtctctgttttttttcagaagcaatatggtctccaagcttgctttctttccatcgcagaaaccgcgacgtggatggttttttcctccagatttttaacggccccagtgagcttttctagacctagtttccattaattagcgttttgaggcacttgtgggcggttaaatcacaggaggtgtgtaccgatgtgcataaaccaatagtagcttcttcttttttcttttttttttccggttggtgttttcttctccttctggaggaatgtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcagagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaa

SEQ ID NO: 12330 - DNA, 1501 bp, Oryza sativa
cacgagggccttcgaccaaatctgccgaaaccaccagattagcaaagcgccgactaaaatcacaaggggtcgcttggaggtgaagccataggatgaagctgtaaggcgaagtcgaagaatggaagccataaggttcgtcatcaagtctctctgttgggtgaagccatggcgcgaagcagaaggggttcgcccaatggggctcgtcttcaacaaaagggctaggaggtgttgcggcccaagaaggctcacacaaaactttagggctatgtaataggggatccaaaaaaatttcatcattaatacattgcttttaccatccaatcatttcattgagagaagttattgtcatttcgacaacaatatagatactaatcctgatttttaaaactatagataaataaaattgttgtgtccttatgaattcaaaataaagtttacatataactttcgttaaaacaaagtttacttatattaatttaataaaattgaaaaacctatgtatttaatatatgtttaaaatttaaatatttaaaatattaatagcaatatatagcgcgtacttggcgtatagtacaccttggctgtgtttagttcagcgcaaagtttagattttggttaaaattaaagatgatataactaatatgtgtatatgacatattgatgtaatgaaaaataactaaactaaactttgattcaaagtttagaattatcggctgaccatccaaccaccaaaataatgccacaccagcatcgggctacagttcagaacgtcgcaatcagcgcctcggataaaaaaaaaaacctttcggcgctgccgaccttgtgagcccacccaaaactcgaatatacagtacgatattcacacgtctcccccacccaccccaatcaatcatgctaagctcaaacaaccgatctgcaactttgcagatttgaagattcatctcaccaaacaagaacatgatggagtattttacatctgaaaccaaaagcacaagcaaaagagagtccaatagtaacacaacaccctatctaaagcaaagaacattactacagctggaaaaattactacttcctcccttctataatactatgaaagatttttgagggatggcgaatctggacgaaagatttttgagggatggcgaatctggacacacagaatattattacagctgcaagtggcaacaaaaacaccctgctaggctgcttcgtcgtcgtcccggggacacacagctagctacatgacggagcaggcgttggggttctcgtcgctgaaggcagcggtgtagcggacctcggtggaggaggcgcgggcgagcggtgcggcggaggggtcggacaccacgttgcgcacgtaccccgcgggggccttcttgtcgtaggcgcccggtgcgtaggggtgcgccaccgtgtcgtacggcacgtatggccatggctccacccgcttcccggtcttgtacgccacgcgccgcatcaccttcccggcgtccacgtaccccgt

SEQ ID NO: 12331 - DNA, 1501 bp, Oryza sativa
tttgttaagatttattgtattgggatgtatcacatccacctaaaattctttatattatgggacagagggagtagaataaatgtaaaaggaagtagtttttttaatttagtatctattaaaattaattattaaatattcaattatcaagatgatacgtaattagtagtaataatttaattaataatatttttttaattaagtctttctagttttattgaaaatttggcatagcccagctagaactggacggtaaaacgagccttttacactaagacagaaaaccccataagtaacggttatgaactagctatggtcggtacgtttgctccaatcctatacatgtcggtttattaaaaaaaacgcaacgctggcttccacgccggtggccgccacccaatgccgcattggtggaggggggaggggggcggaggtcccttgggtgagagggagccgacgagatctgatgaccacgccgccaccttgccacccggccgccaccccacgccatgctagaggaggagaaggggaaggggggaggtcccctaggagagagagggctagcaagatccaggcctcctccaccaccaccgccatctcgccgcacttgaggacggggctgataagatctatctgtcagccaccgcaccggccgcaccctgcccgatcggtcggctttctccatcgccacgctgccctagaggaggagagaaggggggagggcccccgggttaggagagggccgccgccgctccaccagagagaggaaggcaaagggagaggagggacgagagatgcatggatggcaagcgggatggatagataagataagggtgctgtgggtggtcaaacatatacggattaagttttttttaacaggtgtcagtttttttaaaaaaatcagcatccatattcattttatagatgtcagttctattaaaaatatgcatctatagtgcatgtattgagttttttttaaacagaatcgatatctatagtgcttaaatatgccggttctatatttttttcatcgtgggaaggtgagaaaaagatcatagatgtcgattttaaataaattggctcttataataccggtccctatgaagattttttaagtagtgttatccgttgttgattaatgctaaagaatctcaaggtcacacagttcactggtaaaagttcggtctccttatttcactccactgtaaatatgctatggtacagcagctggaaggtcgctccgtgtaattccctggttctaccccttctttttacgtcaaaaataattgcttttggctttagaacgcacccgggagcccgggcgggacacatgagctagcagcagggtcgcacgaaacgaaacgcacgtacgtttttggcgtgtgcggcagccatggcaggcagcagccaacacgtgcgctgcgagaaacagggaaaacgcggcgtgtccacatgcgatccagcgaaacaggaactgcgcgaaaatacaggcgggtccccggtc

SEQ ID NO: 12332 - DNA, 1501 bp, Oryza sativa
ggaggcggaggcggcagaggcgacggaggggagtggcgacagaggcggaggctgaccgggcgcgcggggacacgcggcgggtgcctcctcatcgtgggcgcatggggacacgtggtgggacaccaccgccaccgcgggctcctcctcgtcgtgggcgcgcggtggtcggcggcgcgcgaggactaggtggtagggcggcggggcaaggcagtggaggaggcgagcggcagcgggagttcgcgctgctcgaggtgaggcgaggcggcggcgcggggtgacggcgcgcgaacgaggctcgaggcgacgacggcgacgggcgacgaacgacggcgcgcggcacgggcagggctcgaggggagatggcgacggcgcgcggcgcgagcgacgacgacaagcgacgcgattggtcccatctgttcctccgcttcatcgcgggcgcggccgcgggctggggctggttgtcgcgcatggcgtcgcccgccgcgctcgcctcctccttcgccgccactgccgcctcgcctcgcctcgagctcccaccgccgctcgcgtcgcctcgagcagcgcgagctcccggcgccaggacgggcatggctggagatggactgaattttcccatggagaaaggtccggggtcttcccgactagcaacacaagctgcgagctagccggtccgggtttgagcctcacccccttcttaattcaaaatcaatctagtcctttctagattggtctcatttgtgttcgcgaaaaaattttccatggacgaaaatgcccctctctaatgatgtttgtcatgtaaactggagtaacttttaatccgagccatttatgcacttcaattttcgtgcgttcttttctttagaagcatagaagcacgactcgctgcgatcgatcgtcaattttgaaggcatatttttaatacacctaaaacgagaaacctcattaacatatgattaattaagcattaacaattaaaattttaaaaatagtttatttgaatttttcaaacaacttctattattatcttaaaaaaacgtaccgcttaaaaatcatgctaatgaaaaaaaaagagaaagttaaaatttggagttgagaaaaaaaacttggccttaatcaataatcacaaatttctgtgtgcagtgcccaccaacaccaaagcccaccaattttcgccgtctttgcaagcaaacgcacgcaagcgaccgcgtcctggcttgccccaccgcacccgacgccgcgcaacgcgaccccaaccccaacccggcgtcgtcaccgcgcaccaattccaccaaaaattctctcgtcagagagcgcgcgccacctttcgccgtccacccatcgcccccaacgcttctttgaaaaaccgaaacgccagttcaactcccagcacggaaaccgcccaccaactttcgccgcatggccgccggtcgccggggcggcgtctgagagggcgcccgcgcggcgcgcggcgcgggtcggaagcggaggagggcgatcgaga

SEQ ID NO: 12333 - DNA, 1501 bp, Oryza sativa
aagctgacgtcgtggagcataccttcaatgtaatcattctctctctctctctacaaacaaaatccgcattgaattgttcatttgtcctttgcacaacaaaaaaatagtgccatgaaaactattacacacacgagtatatttttaataggaatttaatacgtataagggtttgtagttggcatccatccctcagagcttgtgttagcaggtgcactcacaagtgtgtgcatgtcatgtactcatgtacatacttagtgtagtgacgtgtgtatcttctatgtagtcgggaaaaaaaggagaaagtttgcacaaccaaggaacgtcacgaacgtgtaattgttttatagtcggtttaataacaaatatatggaaaaaatatttaatcaagtaatgtatcaaggagaagcaacaaagacaagtgataagtttaagtgatcatattttccttttttatatattttggaattatttttctagcatcttttttaatattaagatacatttttcaataacatctgatattttgtactccctcagtcccagaatgtaagaagaagttttagggttggaaacagttattaagaaagtaagtagaagtgagtggtggagggttgtgattgaatgagtagtgaaggtaggtggggaaaatgaatgatggagggttgtgattagttaggaaaagaatgttagtggagaagttgttatattttgggacaaatcctgagagctaaaagttattatattttgagacggagggagtaacagctagtagatgacatcacaccacaagttgccaaaacaaaatttctacaactaatatttattactaccagggtttttaaaaccgtgcggttaccatgcacggtaaccttttcagtttttgaaaccacggtatgtctcgcgattatcacgcggttttcacgcggtaaccgccttaccgcgggagtgcagtaactgcgccaaaaacggtaaggggaaccatgattactacctctgatcaataatattttatgtttaaaattagatttaattaaactttcaaaacttttacaatcaatatcttctaaaatgcttagttgtaaaaaatgtggagtttaccttgaaaagtactacaaagatagcacaaacttactataattccgtcccaaaatataacgactttacgtggtttaaactttctaattcaaagttgatgatcacaatttcaaaagtttgctcgaatatgtcctaaatgagagagaagatttaaactttctcgacaagcgggtagcgcggttgtatgcgagcgtccaagaaaattgtcagcttggcagcttgccacctcatatctaatattctcgtaccacacactagaaacccattatttctctgtcaattctcaagtcttgcctatggtactaaaccccagtcttaacagtcatgctcatgatattgtttctatatgatttttgtcaggtcgctacactatctcttccccgtatatgtcagccagggaatacga

SEQ ID NO: 12334 - DNA, 984 bp, Oryza sativa
gaatctcagctgttggatttattttggagggctgagatctacgctatatcacctttaacatgcttatcctatgtcaccatctgaatccgctttttcaattcatacctcctgacttgtcagtgttttgcttgaaacacagaattgtggccgccaatccaaccaatgaagccgtggctacaacaacagagccaccaccaacggcgaaacccatctgtatcgcgtaacgagatgagagacatatgagctgcgagtgaacaaaagaaaagattttcgatttgagaaccgggtgagatgagagacgaacggagtggaaagagtgagctgctggcctccccgcccgagtgaggatacccagcgaggactccgcctgcgcacgggggatcccgcgtggcgagaaccccctccggcttcgggtgagaaggtaaccgatggcccggagcgacatggccgcgaccggagaagctccccttcttcctcctcctccgcccgcctccaatctcgcctagtcgccgagattcgattctagggttttctctctcgtgacttcccttcccgatcgacgtacgcacactacagttacggcccagtttgtaaggcccgcatatagatcccagcccaatagggctcaactataatgggcccgttccaatcgaacgagtaccacgcgtgcgtgtgggccctgtcgtcgagaaccaccgtcactacctgcacctgcacgggcccgataataataataaaaaagaaaaaggaaaaaaaaaagagaaaaatccaactaggcggagccattcgccccgcacgaactccgaggcgcacgaccaaatgcgcgccgccgccgccggccgcagcgtccgcctcctctaggagcgacggccaccaccgccgtatgagcctgtagcccggcgccgaggtccgcgagcttttgctttggggggtgggagctaagctttgctcccccctgtgcgtgcgggcgggggggagcgggga

SEQ ID NO: 12335 - DNA, 1501 bp, Oryza sativa
ccagcaagaacagaagccggccacacgatctgctcctcgggcccaaacctcacatccatgtccaccgctgccaaatcactctgcccttcgatctcctccttcctcgatctcggcggctggccgttcggtcgagacgatgaaaagctccccaaatcaacagaagccagaggatccaatccttgcagcaagcgtttgcaagtcctcgaagagaggcgccccgggcttaaatgggcagagctcgatcgccatggatgggagtcgtgcgcggcgacggtgaccgagggagacggtggacgacgaagcgagctaaccgattgagtcgtccgcgtacaacaccctctcttcgtttttttttctccttccttcaaaaaatcttctcgcgtcagccgccgtcgcgccggaccgatcgacaacttagacctgactccactgggtcccttgactggtctataatactgttttttttttttttaccaacggctacaacgaatgtcaatgggaaaatatatatatatatatatatatacacacacacacacacatatatatatatatatatatatatatatatatatatatatatatatatatatatatatatatatatatattcgaaatctagaaaactgcctttgaatttaaatatgaacgtctaagatttattcatgtcaccaaacaataaaaattttactcgcaaattcaatcatgagtaaaaatgttgggagtaaaatttttacccttgatgatatggacaaatatcgggccttcattttttaatccaacgatagtttctaggttttcaccacatatataatttgtacttcctccatttcaagttataagtcgttttgactttggttaaagtcaaaatgtttcaagttttatcaaatttgtagaaaaaaagagtaacattttcaacccgaaacaaatttattttgaaaatataatcaattattgatttgatgaaactaatttggtattgtaaatattattatatttatctataaacttagtcaaacttaaagtagtttgactttgaccaaagttaaacgacttatctatactaatataaaaaggaggagttgtacccctccaatcctacatgccaaatcacccggatcaatccctaccgtccgtccgtcatctaatctaatctcatccatccatccggtgaaatcacccagaccgcatctaatccatccatcgtccatcgcccgcgcaatccccgccaccacatcctccccacgctaacagaggcaccgcgcgaacaacacatctgccctatgcgctcactatgctgtcacaccctaatccggcaccgccgtacaacggcacctgacaggagcgtgtcgtaggaataacggcgcgaaccacttcctacgaaaccgcgatctcagtaccagtcccaggacatagtgctggtacccacggtgacaaatatgaatcattgcaaatccttaaaataaatagaggacttatttaccttaacttaggttgcagc

SEQ ID NO: 12336 - DNA, 1501 bp, Oryza sativa
cacaaatcgcagtactgacaatgtgatactagctagcttgaggtgtccagaaatattccagactgcgtatatgcgtgtaggaaaccaaaactgtactgcgtctcgatctcaggctcatgcagtccacgttttcaatccatccaggtatgttcacgctaaaattaaaagtttggttcaaattgaaacgatgtgatggaaaagttaggagtttgtgtgtgtaaaaaagttttgatgtgatggaaaagttaaaaatttaaagaaaaattttggatccaaactcggcccaacttaccatcaggcaagtccttcggtaattgatttccaaggagaaatcgcccgaaggtctcaagagctagagaggacaatttcacgatggacgtcagtcagttaaccatcgacaacgcaccacattctctgaacatggcaagcaattttacgccctactgaaattccactgaggtaccaacgggggtaggatctctgacttcttctcatgttcacctccgtccatgtcccaatcgggtctgaatgatttctccaggctaataattaacctcaccatggatatcctatcaccaaactgaattatcacgttagctaagaaacctactatgaccaagagaacgtgctccgaatcacaaaagaactctacacaaaccatataaccgtcctaaaatatagcactatattatcaatattttttaatgtagattcgtagtgctatactgcgttaaactctggttttatattgttacattttgttgctagacgcactgacaaacagaaggagagaatagtggccagaagcgtcagagctaggcgcctcggatcggccggtgaatcgaacagctccggccctggcttagccgtgagccatctggccttccctcctctcctgccgctgcaggagacagacagagagagagagagagagaggtgagccctcgcgtcacgtaccccacagccgcgcttgtcgccgtgctccgctctctcgtgaccgtcgaatggtagccgctactgcaatgcaacctgtgcagcagcctgtatcacacagcttttcttttgttgtcattagtcattaccaagccagagttttctttctgtacttggggtggagtaagctgagccgttgattgagccgtgcaggacaccggaaagcgtgatacgtagcgtgttggtttggaccccacctgtccgcgacacgaaacgtggggccccgtgcggcggacgctatcggtggtgaggcaggagaacgagaggccgggatcgcacgaaaatccgtgggtttcagatgagcgccctcgcacgccgcacatcctatatcctctccctctcctccccaaccccaacctcgcgcttcactttccaacgagcgaagccgtcgtcgaggcgtccgtctcctcctcctccttctcctactgctgctgctgctgcttaaacccctcagggctccgggccgacgctccatttgtggctgttgggtttggagcttcaggcgcaa

SEQ ID NO: 12337 - DNA, 1501 bp, Oryza sativa
gcataccatcgacaataatgagcaacctaacaacgaagacatacaccggccggccggagacgatcccatccgacgacactgaagaactgaaagcacaacctaaagctacgtacatgcagaatggtcgacagacagacaactcgacacacacccatcaagcggacaaacgcctctggccccagcctctgacatgcgggccccacacggccacccccgtgaacacggggggacggcgacgttacgtgacaactgggccacaccggcccacgtacggggccccattcgacgtggacaacgtcgtccctgacaggtcagctcccatgcaatcacacccacggaacaccagacacgcacaccccggcgacggcgacgacagccgccgccgcgtgtggccgcacggcgcgtccggcgttcgacgcggcgcagatgatccgaaccccaagcaagcaaaacaccttcttgtttcccccacgcaagcgtctgatccgccccggatcttctgcaaacgcgtcggccggcggccacacgtatcaacatcgtttgcctgctctgagcgattaattagcagtacgtatacttgtaattactactgctcgattactcttaatggtgagtgagtttgatggctacgtatgtgtgctatcgcacacgccatgtacaccagtattgtacgcttaacgcgttaattactcgctgattgacactaacatgacataataaatatatatgctgatatcaaggtatatattaatgcatcttgacgtttactaatttatttccttctgcaaggcgatatgcaattgtacagtacccctgctgatgatctgagcacatcatttaagctaagcaaccaattaagtgatcgaccaaccaatctgtacacattgtcactgtactgcagtactgacgacgtcccagctgcttaaaaacctgaagagctaatttctgaagtagtctgaaccctgaagagatggaaagaagggacaccgtagcaacccgtcggccgtatcgtgtgttcataagtatatacctgcaattcacctgaatacctgatggaccagtggacgatcgatcagggagaaaagatgcttcatggctttgcattgcatgtaccgtacgtagctgggccagatagatatagatggatggatgtgaatggatgtgtgtacatgttgctagttgagtttgtgagtagtcgacgtcgaccatagcagcatgcatgtacgtgagtatgtatgcaaacactgttagctagcagtgatagatggatgcgatcgataaagagatgcaaaggttttgaagctttaatgccaccctttctgtcccttaaaaagcttacctcgctcgcccattctacttccattctcttcacaccatcacatgtagtgcgtgtactcctagagcttagctagagctagcttcctctcgttgatagcttgatacatctctctcgattcgtagagagtttggttggttgatagctagctcgacggcgcggcca

SEQ ID NO: 12338 - DNA, 1501 bp, Oryza sativa
gcgaggtgggaggcgaggacgagggaggagtcccagagccatgagccggtgagcgcgcgccccgtggccgggtcgtgcgtgccgtcgcgctcagccacggccagcgtgcgcccggccacggctacgtgcagcgcggcgtccataatctcggtggctaccacctccatcatctccatggcattctaaccttcatatgcttcttctaatcttaattagatggggctcgttgtactactaataataattgtatgctgaagaagtcttgctttacaacttgatgattcgatgtgcaaccgaacgaatttattccttgtttttgtgttagtggctcctgccgaatcagtacaccattgggcagttgggggcttggggcaggtacggtggacgccgcctcgcctggtccgctggttttccatagaagcttctcatgtctgagcggctgagcagctgatcagcccctcgacggctcgacccacaggataaaccaactgctgctaggaatgctcggatacccaagaagaaaacctgaaatcgcttgtgaaacaaggtcacaccaaggcaaaacatacgcgcgtactcgtgccgctccccacaagaaacgaagccgaccacgtcgcggccttgcgcccaagtcgtacgtgcagtgcagccatccggtatccatccgccgcgcgctcgcttgccttctcttctcaccgggccgcgcgcgcgcgcgcatgagcttggtttccaaggtggtgcacgattgcacgtacgccgccggtgtgcgtgcggtttcgagtgtcgacgccgcgagggccacacgccgcacgcacatcaccgcgcggccgctgcggatggcaaacgcgacggcgacgatgggtaggcggcccaccgaaaccaccggcctttttgcacggccttggccgcagcatctctggttgggccgaggcctgggactgcgagtggagtacttgtactttcatcttcgcggacagtagccgccaacaggtagtactagagcccacgacggagcggccccgttgcaaagaccggacggggcggcgtgtctctctctgcttggattctctgacgttgcctacttgcctcctgggagcacgtccgtcgggtaggcactggagcgtgtcgccgacactttcgacactacccacatgcttgcttgcagctatacgcctactgtacagttcacctgtatacgactagtgactactgccactgtgccacatgctgctaaggaactgtcaaacggagctatccattagccaatccgccatacacaacaacaaaaacaccaaaagtccacaacagagatgcatgcatacatgatatacccatcttagagccttaaatatttgtcccaagaaaattaacagccactcatacatcctaactgaatgaatgaatgaacatgtgcaaatgacaccaacagtatgcacgtaaccggagccgccgtgacgaactgacgacctagccagttgaccatgcataccatcgacaataa

SEQ ID NO: 12339 - DNA, 1501 bp, Oryza sativa
caacaaagaagcaaaacccagctcaggttgcacgaagatggattcagaagatcaagagtgaaggggggcaaggactcatgggggaagaaggccagcctagtgggaacagctggcgtgacagttgccaaatggccccccacgaaattagctgtcaaagctaaattcagcaatgcggccggccatccttccttccttccttctcttttgtccattcccccattcccctccccctctgaaaattccaagaaggccaacgattttttgctttgctgcgatcgcgacactctcgtgtagtacattcaccagtagttcgcgcatggaattcagagtgaaatccgggtctaaatttgatttaaccctgattgcaacgtgctaacgaacggacggacgcgtcgaaaaactacaaaatagacgtcagttttttctacgagcagagcggaataatatcctaccagaccaccagcacaacacaatgccgtcctccaactccaagatttcgatccctctggaaggtcgtggacgaagaacaattcaattcttcggaagcaaaaagtctgcggcaaccattacgaacacgcgttaggttcgtcgtataagtaccactcctgctgccgtccagttgcaattgcgttttctcctttattactcctatttttctctctttgtccgttgcttttgcggcgtggggtgacgcggggtacgcgcgtggttaaccgcctttgcatttcctccttcgactggacgcacgccgaggccgtgaccgtgaccggcgccagatggagggaggggaaggggaagctcgtgggagtcgtagtgattctgtgcttgggttggatgttgggggttgaacgaaccgtagaaagtggtagaacgcgttgccattttggacattgccaatgcaacacgaatgatcggtcgttgtggaatactacgcatttttggttaggaaaacacggtacgatgtcagatgctcgtctagtcgtgtgatactgggattaggcaagttgtgcattgcaatttgtacgttgccaacacgagtgatcggtcgctgtggaatacgcattttggttaggaaaacatgtcagaaactcggtatacccgattttgcggttgagtgacagtcatgagaaagagacgaggaggtaaaatagacttgttattttgcagtgtacaaatactcaatcagttgcatacttgcaatgggctaatggtcaccagcccattcatcctcgtatcactgggttattaggcctgccaagttgacagatgccaaggctggctatttgggccatttcgtccacccggcgcccgcagccgcaagcgcatcgccaacgccgtgccgtggccgagccaccaccaagcggcaaccagacgaggcttcaccggcaccgcatcgcttcactccgctctcacagtctcacgcacgcacgccagcaggcggcacgcaacgcctcgcttcacggcctcggctagagagacgcgtgcacgcgaacgcagatga

SEQ ID NO: 12340 - DNA, 1501 bp, Oryza sativa
  unsure (1)..(1501): unsure at all n locations
cgccgccgatgatccccgccgggcagccatgtgttctaccctacccacccaccagcagccgattgcacctgccactgcggttcttccctcaactgtagagtggtcagcggagatggccggcagacggcaggggggcaaccttgcctggggaccgcgcctggcgccgtgcttggagacgacggtcacgtggttggtcgccgtgatgaagcggcttctcgacttcaacccctgcgccccactggagtcccagcagtacacggggcaaggccccggtacattgttcacccctcgcacatgacttgtttgttgaattgcctgagtggaaatcttacgcttacctgacctgcgctatgtgtttctttgatgattgagttggtacatgtgttctcctatttcatcatactttgtttcaaacttatactccatcccattttgcaaatgagatatgatgatgacatgatgtacagatgaaagaacgagctataagctggactgctagagagctggatggagaaggtcaaagcgcacaacaaggaggagctcttgcgcaagcagagctctttgctgggcactgatggtaaaccggaacaaagtattctcgaggcaactatttgaactcattggaaaatttgtcaaccgtttttctcttgacaaacttcggccaacgaacgcatcgccagcccagcaaaaagaatgaactgtcaagcattctaaaatcttaaaaagcccccccaaaccccccacctcttttacacccccctcttaaatatttggggggggcccccttttttttttttaaatatctagggctgttangtcccacttttttcttcaaactttcaactttttccatcacaattcaaactttttctacccacaccaaactttcaacttttttcgtcccattcatttcagatgggattgaggcctncaatntgacggtaactaaacacantccttaatatgtggtagagatgctacagtcaatanggtattaaagatttgattggaatgaaaggttttttgaaaaggtaaatgttagtcttctgtttttgcgtgcaagggtactgaggatttcagcttattgaagaaccaaaacttcatcatgaaagcaatatttttttagctttgtaaatcctaattgtagcaacagaaaaatgcactctatacgagagtatagaagatatttgcttcaaaacaatcttgatcacatatgaattcattttatcttttaaagtcactgattccttagcttagtagcccgttcatacccaggctaagatttaaagtggattttagtgcagaacatactaacataagacagccccactgactatttgcatagatacacattgttgatgtgttcctgcgtatttctgcctactgcaatcctttgtttttctcaccgggccggcctacttccatctccacttgggcatgttcttttacattgctgatttatcactttatttttgtactttgattatagtgaacttcatga

SEQ ID NO: 12341 - DNA, 1501 bp, Oryza sativa
gagcagaattatctctcgaacaccaatggaagtgctagagttggtttattgcaagtgtatctcatgtggctagtatgactcacgtacccaacttatagcatatccggatgtccgttcgcaatcatgtcgggtgatcaggccgacgacgttcgcgaggaattatccgttaacaaccttttctcgagtagtctagccatggcagatgctatgagatagggcgtcggtctttgttggtaggttgggtgcgataactccgcatttgtcgaaaatgttctcgataatggagtgtactcgaccataacctactcgagtgctcaattgttcctgaaaaatattttttagaaggcaagatatatagcagataatatcgagtatgtactcaaaaaactgcatggatcttctagtattatcaggatacaacaagcagatgcaaatattaagcattatgtaaaccgtgaacaagcatgatttatacagaagaaaacagagtgagcccccagcgttagaccgtagttggtttaacgtcggaaacatccgcgcaatagatattgtataaaaaacatgctctaggtaaacgtaataaattatagatctgacaatgctgtatcatctgaataggtacgataaattgcatataaaatattgcgtacctttgtagatacatgccggatgtatctacgaaattagtagaccatttttaaaaaatcaatctactaaatacctgatcacgggcggccgttgatttatctgaataatcaacacgttgcaatttagacagccatgttggtcttctttgcaggtacacgtcggccaactaatgcatgcatgcctaagcacgtactgagtccatgcatatgcatgtgtacacgtcaggagcaagcatattagttggatctttgtcttgttgttttctcgataccttggtagacatccgtgatcaataatccctggaacacatgatgtcgggatggatgttctcagtatgcgtcaggggtccaaaatttggatcctaatcggggtgtgagaacgatccaaatcccaaaagaatccagtgaatagatcgagatgttgattttggttcctcgatggccgggtttctgagcaggcagcagcattaccgaggttaccaaaaatcagttgatgatgtcgcttccgaagagatggagatcggagacctcctagttgataatatcaagtcactgttctctgtggcggtgacgtcttgaagtttggtcgatctcgagagatcgagttgttgacgacgatggttccgatctcgtcgagagacatactctggtcgggttagatctccccacagcgaagtcgtcgagtagcttgttgtcggagaatctgtcttttgaacccatctcgttgaaatcctagagcaccaaaatccccctacctggcgcgccactgtcgacgtttgatgtctcgactatggtatttggacagtatggggaacgttggtgctaggatatacacaagactgaggtaaaagaga

SEQ ID NO: 12342 - DNA, 1501 bp, Oryza sativa
gagcagaattatctctcgaacaccaatggaagtgctagagttggtttattgcaagtgtatctcatgtggctagtatgactcacgtacccaacttatagcatatccggatgtccgttcgcaatcatgtcgggtgatcaggccgacgacgttcgcgaggaattatccgttaacaaccttttctcgagtagtctagccatggcagatgctatgagataggtcgtcggtctttgttggtaggttgggtgcgataactccgcatttgtcgaaaatgttctcgataatggagtgtactcgaccataacctactcgagtgctcaattgttcctgaaaaatattttttagaaggcaagatatatagcagataatatcgagtatgtactcaaaaaactgcatggatcttctagtattatcaggatacaacaagcagatgcaaatattaagcattatgtaaaccgtgaacaagcatgatttatacagaagaaaacagagtgagcccccagcgttagaccgtagttggtttaacgtcggaaacatccgcgcaatagatattgtataaaaaacatgctctaggtaaacgtaataaattatagatctgacaatgctgtatcatctgaataggtacgataaattgcatataaaatattgcgtacctttgtagatacatgccggatgtatctacgaaattagtagaccatttttaaaaaatcaatctactaaatacctgatcacgggcggccgttgatttatctgaataatcaacacgttgcaatttagacagccatgttggtcttctttgcaggtacacgtcggccaactaatgcatgcatgcctaagcacgtactgagtccatgcatatgcatgtgtacacgtcaggagcaagcatattagttggatctttgtcttgttgttttctcgataccttggtagacatccgtgatcaataatccctggaacacatgatgtcgggatggatgttctcagtatgcgtcaggggtccaaaatttggatcctaatcggggtgtgagaacgatccaaatcccaaaagaatccagtgaatagatcgagatgttgattttggttcctcgatggccgggtttctgagcaggcagcagcattaccgaggttaccaaaaatcagttgatgatgtcgcttccgaagagatggagatcggagacctcctagttgataatatcaagtcactgttctctgtggcggtgacgtcttgaagtttggtcgatctcgagagatcgagttgttgacgacgatggttccgatctcgtcgagagacatactctggtcgggttagatctccccacagcgaagtcgtcgagtagcttgttgtcggagaatctgtcttttgaacccatctcgttgaaatcctagagcaccaaaatccccctacctggcgcgccactgtcgacgtttgatgtctcgactatggtatttggacagtatggggaacgttggtgctaggatatacacaagactgaggtaaaagaga

SEQ ID NO: 12343 - DNA, 1501 bp, Oryza sativa
ggcattgttatgccaccatcaattaattacgagtagatgatgcgtggtgtctctttcctttgaactttggtgtccttttcaccaattatattgctcgttttggttcagtaaatacattgtttatttcataacagaacggttaatgttaacagcatttttacttacttactctgaaccacatgccggcgaaggggttctcggtgttcaggtgcgacattgaagcagatgcacgttggtgacgtcgactgcttactgccctgagtcaccccgaagcgtaaggtttcatataccgctccttctcaaatggatacaaatatgaactatgagtacgcggactggatggtaggcccatcatagcaaacaaaaagtttgattatgacagaaggacatttgtagaaaataagaaagataacatatagttgttgtgatctatgcaggaaggcatcgatgaatacataagaaagctagcagcgattctttacaactctccatccaacaaattttgaatcatgcacaggccatctccgaagaaatctaagatgttcagctttgtattgggaggatattctttcattaaattctgagatgttcatttatcattgagatgttttattttggagattcttagtttgtcttgtcggatgttcatttcgaataagctaggtgttaattttttaatattaaactctatctgttatttattaaatgatactcaatctcgttattcaacgatgtcagatgcggggacttattctttcttttgtaaaaaaaataatgttctgctataatatatgcgcgcggtcgattgaaaaaccatgattttttatgataagtactttctgcgagtttaaagaaacatctcgtaccacgacgaagcacctttgtgcttctgcactgcaaatcttacgtaaagaagctgctcaatgcaacatcttacatcctgtcaaactgtcaaatgtgtaagctaatgttgtatcaaaatcggatgctacggagaacaaaatgatgtgtcagtatcattttttcttggggacgacatgttccccctggaactgttcctatggtttgcttcgctcctgaatcagcatcttctggaggcctgatggctgaggatgccaaatctcccaccaccaatcctttttggtggcttcgagactccgaatagagctatcgcaattcgaagttggaactagaaaaatatggacagaatgagtcctccagcagcatgtgcattcttattgatctggtaggctctgcatgaaaaaacaaccagtttcagcagcagcagcagcagcattacagtttcagcagcaccagcagcaccagcagttcagtttcattccagcaacaacagtgcagttctagcagcagcacaatttcgaatagtagcagtatcattccagcatcaacaatagcatcattccagcaaacagcaccattaaagcatcacacaagcatcacaaaatgaagtcaccattccagttgcagatcatttaatcct

SEQ ID NO: 12344 - DNA, 1501 bp, Oryza sativa
atgtgtgtgctctggtcagtaggttcgagactttgggttgactgataaagtgctaatgcagccatgatgcgagatgatggaatattttactatcttcatcacaaaatatataaaagattttctacaatagtaaaaaaatacttggatcgtcttctatttaagagtttggtaggataacattagcattggttatttttcagttacgttagatagggtggtatgactaaaagttcatattaaaaaatagtctactttaaaattagatatttaaaagttcaaaaacaatacaaattctcagattaagtcgattccaagcggaattttaatacaaattctcatatgaatgttgttgtgttagtatacgtatccgtgatgtatttgaacaaataccaagttaggcatctagaataaattattatgttttactaaatacaaatatgtagtacatattgtggacactcgagtttgctaaccgtgtttaacacgtaaggttaaacaatatcatcgtcgaaaatagagaaaaatgagaacaaaacaaaataaaatagcgaaagaatactgagatatttacccccagtatagagaagaacaaatttatattaaaattatgaaattttaatgattcattaatctcaagatatatcagctcaatcttccgaaggtactcgtagacatggatgtacgtgtgtacgaagcgtacacacgttaaaataacttatattgtgggagtgagtttgcaggtgccatgagcttctacgttttaattgcattccccgtaaaagatagtagtaccaatgtttcataatcagcatccttcctagcgtagttgtgaaaaaaaaagggaaaacaaaaaggagatcgttgtgcggtgcctcgacgagacgacgatatttccccttcccctcgtcgtcgcctccgactccgactccgactcctcgtgagctcgccccgccgcctgcgccgccgatcccgcgaggcgcgccgccgccgttcgtcctgctgcttccgccgcatcccggtgagcatccattcatcctcttcctcatcgctgtgtacccactcactttttttttccctccaattttgcgttgaaccctttggttgttcctcttctagacctcggaggaagcttttctcttaatttgccttgaaaacttgacacgaatagtagtttgcttgttccccaaattttgcgttgaacccttgttgtttctcttctagacctcggaggaagcttttctcttaatttgccttgaaacttgatacgaatagtagtttggttgttccccaaatagtttgggggttcagtttattagatccgcccctgttttagcataattttgatggtatactttactatatgcgtatttaggcgctaatcagttttttgttttgattctagataccgtgggagcactgaagaaaactgagaaatggatgtttttcagcgattctactgtttcgtaaagcaaccctactgttagtgttggttgtttgaaga

SEQ ID NO: 12345 - DNA, 1501 bp, Oryza sativa
gccgcgctcgtcttcttggacctgcatgtaccaaagttgggcgccctcgaggaggttgtgggaggccatccaaaccttctcctcttgcatgattcgctgttgcaggaagaaggattcgcagcggttgatgaagattagcgggtcgctcttgccgtcgtagtgcgggaagtcgggtcgccagtgcttgggcggccggtctggcggctgatcgccaaagccggggcgggcgccggacgtagatgaactggtggtggtggcgagcgcagcgatcgccttggcgttggccgcgatggaggcggcgttggccttgatcgactcgtgcatcagcgccatgtccttggagagggcctcgatggaggccttgaggtcgtcacccatgtggtgggccgagcaggacgcgactgagggtgaggacgcaggggaggcggcggcagcaggtgggaaattgggcggagcgacagcagggccggcggctggagtggtggtggagtcgtagatgggatcggtggtggctggggcagaggtggagtcggcaacggaagacgaagatcgacgtgaccgcgataccaggttgtcaagggcgttgatccctagggtagctggcccctggctacggagttcgtagccacggtccgtcttctccggcgaggtttgcccctccgccgcaggcttgagagttacgagagaagggaagaattgggacaataaccaaattgcttaatttctggaatgtgccgattacagagatatatggcctaaggcccaactaaccaaagagctaattgctcctaaatgcaagggctaataacaggaaactaattatcctttccatcctagccactgaccgtggcctgatctgccgcagccgcgcgttccgcagctcggcgaacgtctcgcgctctgcggcgtcgcacatacgtgcgcccccacatgacatgaccaccagcataacattactgctaatatattatgcacatatgcttccttcaaaaatattatgcacaacacaaaagtagttgcagacttgcagtaaatgcaaagttcactagctcaattgaagcatatttctccccgggaaaacaaccaaactgcaagggccatctaacaaacacagggaggatacaccatcatcgaattcaaatgtacatatctcgtggcagaataagcccacttaagagcctcattggtcagcctaataagccaaagcaaaagctaaaatttaaaatttcgaacttaattttagagttaattttaagatatttttaatgtaactttgattttaagttgctacgaacaaatacataaaaactttacctataaattaatttgtattccctagtaaactgttttggtttattagaaaatatgggtaaccgatgaggctctaagtttcgaaatttcacccgaaatttccgttgacccttaacaattacaagaagacagacatgtaatactgccacacagatcttcgtaagatcgtaagagacataactttgcagcg

SEQ ID NO: 12346 - DNA, 1501 bp, Oryza sativa
tatggtgatccagacgtgcacgtacatcgactcgctgcagcaaaaacgttcccaaaagagttcacgagtcaggcccacactgatagtcttcgcgcgcgtcctccgcacgtctcttcgcgatcctccctttcgcgcagcggcgcatcgcatatgggcgcgcggtccaccggacgacgaaaggaaagcgaatccaccgcgacattgcgccgcggctaatgatcaactgcgccgcagccgcccccacattggccactacgcgcacacgcacgcagcttgtctcgtctagtctaggcttcctccactttttatcgcacgtcgtcgcacgaccaatctgcctatgtttttgtttgaaacgtcccgcacggggcggccacgccgtcgcatgcacgtcacgggcgcctggcgcggtggcgctctcccggcagccgacgcgcctcgtcccgtgcgcgcgtgccatggttggcggttggcaacgccgcacgctcccacgctggccacgcagctagtaaaatcgagatgggcctaaacttcccgcccgcgtgtgtccgggactccgggtccctgatgccggcctgttccgtgggtggacgagaagctccgacgagaagtgtactctccctttgagcatgagcccgcgacgagagctccgcatgtctttctctgctctgctcccacgttgcgacattgtctcttggatgcagcctaacgagctcttgtcgacgatgggcttagagcaagttcaatagtatagctcactactagctataaatcatctataaccaatataatagtcaatttatacaataattgtttattgtattattaatatatggtcccacaatgtcatacaaatattacgttttgaagttcgtgctgcagctagctacagatctgtagccagctgctcttctctcttttcttttaactctttaaaatatgttttatagctggtttatagacagctattgtacctgctcttaccaccatacctgttagcgcccgccatgtttattttcctcctgatagtcatcatggtggttctttctcgaactagattcggctccaatgtacgagcaggctggcacgacgactagctgtggtctgtggaggaggagtgtactgaggaaggtgggagggagagaaggcagcggagggtggcacggttcataaaaccgatggaatttcatgaaaaccagttgacttttgtgaaactgttaggtctgaatttatgaaaaccggtcggtattagctagttttccgtacggcgttgactaaaaatcgttggtttttatcgtttttgatcggatttggtaaaccagtgaagagcgatttttttacttcgaaatcgaaaagttaaagcctagaggagtacctaagacgacaagggggtgagcgacagtgagggagatattaattattttaaaaacatattcctatatctttcaaaaaaaaattctcttctccttaaaaaacttttaaagaaataaaaaagaatccatct

SEQ ID NO: 12347 - DNA, 1501 bp, Oryza sativa
tgctacttcataatatgatatttcgaaatttttgttcaattttgaacactttttgttccatggataattgcgtgagttaattaaaaaaattatacagtgataatggagtctaactagagggcgatggtatattatactccctccgtcctaaattataggcgtcctccttttaagaaaaatcaagctcagtaacttttaactaacaatcatactaaatatatatacgctaagtattatacatgttacttcctccgtttcacaatgtaagtcattctatcattgcccacattcatatagatattaatgaatctaggcacatatatatgtctagattcattaacatcaatatgaatgtgggaaatgctagaatgacttacattgtaaaacggatgaagtatatcactagatttatattttaaagtagtttcatgtgatgctaattttatattcgttggcaacaaaatatagagtaaattaatggttagagtatgtcagtaaagaccatgtaagaaaaatacatgccttataatttgagacggatggaatagaagttaagcaaaatacgatatcatattatataacgagtcaaaatcagtgacacaatgaattctctttgaaaaataatatagtcgaatcgttttttttattttagtcataatagaacttttttttacctaaacatgattgggggactttgagagaagataggaagaggggataatgtcactagccaaaacacatggggggaggggaagttgcttacatccatggtatgttttgataatatactattattattaattttgttcttcactgtaatacgatgtaaaactaaaaaattaacatatattactatttcattattcacttttcttcttattttctcgatcttttttattttcaatgacaatattgctagaggtccgcggagccgataaccatgtgggggtatttcaatgaagctaattttgcatagtagatattgctaactattatctataaacttagtcaaatttgtttaagcttgacagtcaaagtgactcataatatgaaatagaggggtagttgcatgcctatgcattacaatatgatctatagataaaaatatgatttagtttatttctaatccatttttatgagatgttggctttttttatttctttaaagaagttatttagggtatagttttttgaaaagtgaggtcaattttttaagggagaaggagcattaatacttagatggattcttttttatttctttaaaagttttttaaggagaagagaatttttttttgaaagatataggaatatgtttttaaaataattaatatctccctcactgtcgctcacccccttgtcgtcttaggtactcctctaggctttaacttttcgatttcgaagtaaaaaaatcgctcttcactggtttaccaaatccgatcaaaaacgataaaaaccaacgatttttagtcaacgccgtacggaaaactagctaataccgaccg

SEQ ID NO: 12348 - DNA, 1501 bp, Oryza sativa
cgcctgaccgtattatttcgagacaatttcgggtcaaaaattcgggtacccggaagtttttacgggtagcgggtttgaatacgggtattttctatcggatatgagatcgggtttgggaggacggtatccgacggatacgagttatccagcaaaaatatgggttttacccggttaaatatccggataatacctagataacatgtctagcccaataaagcactagtggccaaaaggcccactagtacaatgaccaccatcaaccagtaaaccatgcctaacaacccaataaccaaaaatactaattactgttcactaatcccattgagcaatgatgccgagactacgagcgccaccggtgcgccacctgctgcgtccgctgagccgcggccaccgccgctacatgcctttgctgccagagccgatcctcatctcttcaggaacaggaagttagcagctcatcacatgtcaggccgagtttagttccaaattttttcttcaaactttcaatttttccatcacatcaaaactttcttacacggctacacacaaactttcaaattttccatcacatcgttccaatttcaaccaaactttcaatttttccagttaaaaatcaattgttcattgtcgtattgcccgtacatcttaagccctaataatatagtcgcattatggttatatggggttggttgaatatatagctattatctatatagtatagatgatcgttgctttgacttgatatccgaaaagatattcgtaaccgatagtggtcgtatccgtcttggtacgtattcgtctcatatttgtgcccgatattatccgtgcttgtatccgtattcgatactatccgtatccaacccgattccgattataaaatgtgggttcggatatgggaagagtgagatccgaccgaacccgacccgatttcaccactactcatatataactagagatatgcaattatataaggagagcatgttcatatacactgtaactgtttacaaccgctgatcaaattcagttgtacgtgagttaaacaattgagtcgtatgcatatcagttttcccgcataatactacatgtccatcgatgaacatttctacattagtcagaaaaaaacgcacaatttaagggattgtcttccctggatatttctgaatacaaacaattcccgttatttcccaacactttcacgtacatttcacattacctacgacagattttgccacagatacatcagcgcactcgctccttaaaacccattgcaagtctttttataaccgttataacagttatcaaataatcctaatatgttagtgttgactactccatagccagaaaagcttaaattttaagatgcaggtaccactaatcgggtaatggcagaggtatactaattgcgttttttttcctattctccttttgttttgacgagcccaaaggtagttatgtttttgccaaacattgcaccaaacatcagatcacgagtagaaaacta

SEQ ID NO: 12349 - DNA, 1501 bp, Oryza sativa
atacatagcccctcccagtcacatcatctttaaaccattttacatccatcaaatgctagagattgactactttatatttttcaaatgtgtgaaattccaacgcttattacaacttcttagtttaaacaacatcagtgtggtccagcacaaatattgtcatagttatccaagaatgctgcattaaaatattaattaatttcttatacgcatgtaacgtatgtacgaagtaacgttactatgaaaagagaatacttaagatccttaaataagttttgaaaatatagtactccctccgtaaaaaaaaagacaaacactgttttccgtgcccaacgtttgactgcccgtcttatttaaaaaaattatgaaaaaaaaattaaaaagacaggtcacgcataaaatattaatcatgttttatcatctaacaacaataaaaatacgaattataaaaaaattcatataagacggacagtcaaagttggacacggaaacccagggtttgcctttttttttgggacggagggagtacacatttagtgttactgtggcactcaattataccacctcgaggatcgtgaaaggattaatctagaatcattactattatattaattcatccaatagcgaagccacctctcaacaacttttgggtgacgagctgggctcgttggtgaacacatttttcttttgcataaattaggcatatatatttttttaagaaaatactcaatgtactggttagttttgtcttggctctgaaacttttatagctcctccacaatattcatcggaattaaagtgtaattttctctgctacattaaaagtgcaatcgtttttcttccatctcctttccactatatgtagtagccctcttcacgtgtgcggaaccatagtagatctagtattttatctttagtccatctaccgagccaatcacctattatatttgtctaacctagctcgggttttattttcaattcaccgatacagccaagctctaattatataattctaattatataatgtttgtctattataaaatatagacaaaaaaaacaggagagaaacaatccattatgtcaagctacctggacggcctcggcctcatagggggacatagaggctatagagctcagcatcacatcaccccccgcggaaaccaccaagttaacccagccgtccggccggcgtgtgggcatcgcctaggtgatcaggtcaatccggccgtttcatacgcgcgactccgcgagcgcgcacgagactccgagagccaacccaacgaacaaacccaacccaacccaaccaaccccccacacgcctccctccctcccgcctcctctttatataccccactccgtgtcaaaccatccattccaccaccaagtcctccctcctcacctcacccgcactctctcccgcgaaaagacttcttctctcgtcgttgttgttgtcgttgttgttgcactcgcgcgcggcggcgcggtgccagagatgaggaggatg

SEQ ID NO: 12350 - DNA, 492 bp, Oryza sativa
agtacatatattttggtagtttagtttcacaataccacagctatcgatgaatggattcacccgtgagatgacgtggttattccatctaggatgagaacgtggcatcctattaatttcgtgcgatggctggtaataggatgtcatgtcctcgtcctaggtgaaacagccacgtcatctcgcgggtgaatctattcatcgaagtgtggttttgtgaaactacacaaccaaaatgtatgtacttaagttccaagtgtcaaagtgtgtgtggttttctgcaacttggaccacaaaacgtgtagttttgtgaaatttactctataaagagtaatgcctgattccagtagtgatttttgtacacacatttttgttctgtttccaattgaagtgattgatagttgctgtcttgtacttttttatgtttatactgttcagtgtagaaaaactgactataatttattgatggtttaacactttgctttacttaatagcttg

SEQ ID NO: 12351 - DNA, 1501 bp, Oryza sativa
caacccaatatatagatgtactcatagagttagattacgtgtcatctgtttataggagagtgtgtgacttcggtaatactaagatatgcagatatggtctttataggtgctcatagaggtaaaatgcgcatgcatattcatagagctgagtatgtgcatttgtttatatatgtgagtgtgacttcgataatatcaagatgcgtcaatccattcgttgtagttgatcataaagataaagcgtgcgcgtttgtatgtctactcaggagcggagctagagtatatgaggggaacccgataagaatttttttaagctatatatcacctattttcactatgtgtgcactcttctcaatacaaacttagatatctaaatcatcttaaactctatctaaaatagagtaaaataagcaaatgatatattctccatttcgttatagctctaccctgtacctactctgtataccatgttgagaaagaaaaagagatgccaatgtaagcggattaaaactccacattttcagcgaagtggatgtaaaacccagaagatccaaacatgccagaaagggggaacaagtacagtcgtaccataacaaccacgagagcgaaagttgcagtcatccacatggacgtgccccctgttcgtcacccacaagacacaccaccaccaccatcaccttcacgccaaagcctccctctcccatctctccctctctctccctcccctgcgcccatagctcgcagctttgcagcagccaagccaagaagccaactcaacccatcagaacggcagaaaccccagccgcggcgttggttaaaccacagcaaagcgtcgttgatgcccccgcgcggacgcctcgcctcggcgccatgacgacgaccaccaccactcgcctcctcctcgctgccattctcctcgcggtggccgccgccgacgatgacggtgggtggccgcgtgccgttcccttttgctctgctcgcctgcgtgcgttggcgagggagggagggagagggaaggatgatggattatagtggggagggagggggttgggtttgggtggcttcgtgttttggtgtttttttagtgctgcgagtgcgcgccttttggtctttgtttatgtcttgctccctattggccggcgccgcctaagaatggcctaatactagattaatcccagcctcctgttcgtagcatctcttcttctgttcttcttccctatccaggggacagttgctgtactttttttttgttttgttttttaaatgcggctttatttttgaactatttttttttctgttttgtttcgttcatggataaggtttctatattgttcttggagatcaaatgctcatttctgaaatgccgccgctgtttgtggaagtttagggagtgttttttttttgtgtggggtttttggttatcgagttttggatccggaaatggttttaaattattttggaagttattctccgattcctcctccgaaaccagattcctgtttcc

SEQ ID NO: 12352 - DNA, 1501 bp, Oryza sativa
aatagtgggccccacatgtcagtccaactcacccctcctcttcttcctcctcactccccacctcccatctcctctcctctcctctcctcaggcgacggagaggcagcggcacacggtggcggtgcggtcggacagtggtgcctatgcggaggagctccgacgagcgacggcggcgccggtgcagcggggcgcggctgagcggcggcttggtgcgagcgtggccgtgcggcggcgccggccccggcgcgggcacagcgcgggtcgcggcctcaatggtgcggaagggcaacggtgccgatgtggaggagctcggccgagcgacggcggcgccgatgcggtggggcgcatggccggaggagccgcgccgcccgagcagccgcgagcgccactccacggcgaccggcgccataggaagaagaagagaaccgaggaaagaagaagaaaatgttgccaccaaaatttatcccaggaaagcaacacaaaaattcacctgctgctgcgtctaactcatgcggcaacgctgctgcggagatgcacacgcagcagcagccagcagctgctccgacgcagcgtcaccaccagccggccggagggacgacgatgacgatgacagctgcctgcaatagatcgggaggagcaaaacgaagagaaggaaaaacagcgtaaaagaaatacgataaaaatttggtgtcgattgattccgtgttgttctttccaaccgcgccccaccgcatcggcgctgtcgtcgctcggtcgagctcctccgcatcggcaccgctgcccggccgcacccccgagggcgcgacccgcgctgtgccctcaccggggccggcaccaccgcacggccacgctcgcgccgagcctccactcagccgcgccccgccgcatcggcgccggcgtcgctcaggcgagctcctccgcataggcaccgttgtccgggcgcatcgctgctgcctctccgtcgcctgatgacagaggagaggagaggagagagagatgaagagaggggagatgggggagagaggatgaagaagaggggtgagttggactgacatgtggggcccatgtgggtcccaccattttttattattttctgtgtgagactgacatgtgggtcccacgggtcttattattttttcggatcgaattgctacgtaagcgccacgtcagatgaatactgagtcaaattagccacgtaggcgccacgtcagccaaaaccgccctcaaaatcgtcgagggacctattctacaccggttttgatagttgagtgacccgttgtgtgacggaaacccgttgtgcgccctcagatgaacttattccccacggataatcccggcatggaaaggataccggcccacagaaaaatatgttttcggttaagcccagtctggattttaacccggcccatcccggtgttttccctgcgccccggcccgggaataaatcatctactcccgaggcgtggaaaaaaacctcgagaggaggcggcggcgcaacgaa

SEQ ID NO: 12353 - DNA, 1501 bp, Oryza sativa
ccctatactatttccaatttcaaattttggggtttctcaagcgaaaaatggatccaacaaatatccaaaccagctcccagaaattttcagaccctaatcccatgttttccgttctccacaaatagagaagacctccctcttttcagatggttcgtacgttgtatacttgtctgttgtaaaccgaactattggatggcagtatgggtgcactcggggggaacccgagacgtatgtttcctcctgatatagcacaagcgtagttgctgtataatctattctataccactgaatttgttcgagttcaacgatttgctattgacattgtctttttctataatataccggcgactttaacaattgttctacgatatgccagggctggaccttattttcaaaaatatccttagagacatacaaaataaacaattgatttatcttattagaagcttcaaaaaaaatatgatttttgtatgtggcctccttatacaacatgaaagtttgtatacaaattttaatttttttggtatatttatttttttaaaaaaaaaatattttttcgtggcatacgagagaaaatttgcttatacaagagtgatagcataaaaatatctaatttagtatgtgaaagatgatttatattaaaaaataataataataaatacttttatataccatataaaagataagttataaattttttaaaaaaagaaatgtaaaaaacttgaaactcctgtacaaatttccatgttgcgtaaggaggccacataaggatattttgggagataaatcaattgttaacctagtatgttcataaggatattttgggtatttttgaaaagaatgcctaacccaatagcgtattataaaacaattgataaagtcaccgatatattatagaaagagacaatgtcaatgtcaaatcgttgtactcgaacaaacttaatgatttagaatagattatctcataaataaagcatctgaactctgaagcgaaattgctgtcaaatttgtttgcttaatttgttcacgtttgccatgcacagaatcattctttcgacacgcagaatgcatgcaaggattgcaggagggttttgatgcaaattaagtgcttgttcggttgggccgggaacggccgggatcggggcccaatccccacagataggaataagttcatatgaggtcccttaacttgtcaacgaatccgatttccgtccctcatccagaaaaccagacacaacgggtccctcggcggttttgagggcggttttggctgacgtgacgcctacgtggctaattgactcggtcttcatccgacgtggcactgacgtggtgcttacgtggcaattcgatcccaaaaaataataaaacccgtgggacccacatatcagtctcacacagaaaataataaaaaaaatagtgggccccacatgtcagtccaactcacccctcctcttcttcctcctcactccccacctcccatctcctctcctctcctctcctc

SEQ ID NO: 12354 - DNA, 1501 bp, Oryza sativa
gtaaagcaataagatgttataggcatcacattttaattactgaagcggttctattatgccaaatgtcaagtttagtagtgaagcttggtgtgaaaaattctataggctcagtaattttaaatgaaaatagatattgaaatgaaagtgactctgcttgtaagatgacaaaaactgctcaaatagaagcatcacatgatgtccttcagcatcaactgctgcatatcaggagatccactagattttcacttcagctagctgtaactgcctagctcccgctttgcagcctcaattacaagcatattatatggtattgaatcttttttcacctatcctaaagccaaattgtgaacttgcaatggcagtaccatatgcagtactacttaaaatgcttgcacccaaataatcaaaattttggaatcctaaactaggataaatagatcatcatgcttaacagagaaaagatgcacaaatggatggacggtttccaggagaagcttaacagcggggcaaatttcctggaggagatgaacagcgtagtgagtttagtgaagaagcagcggatcaacgaccccagcatgatgaactggtcgctgcagctcaaggacgctatcgacgaggtggagtttacaagaacagcaagaacaacaagaatagtcaaagaatcgccttgtgctctcctccgcctcttcttctccgagggcgccacggcggtggcgcagtgggcgagggcgatgggcggcggcggcggcagagtggatgcgccgacgctatgctgcgaccgggagcggtgttcgacgggatggcggcgacgacaggaaagggagaagagaaggaaaccctaaccctagatttggaagaggaggggagaggaggaaaggcagcgtgctcaccggaaagaaggtggcggccggatgagagagccgtgctgtcgccgtcgccgtcgccttcgggtcgcgccgcccgccgcgcgccgcgtcttcgttgcgccgccgcctcctctcgaggtttttttccacgcctcgggagtagatgatttattcccgggccggggcgcagggaaaacaccgggatgggccgggttaaaatccagactgggcttaaccgaaaacatatttttctgtgggccggtatcctttccatgccgggattatccgtggggaataagttcatctgagggcgcacaacgggtttccgtcacacaacgggtcactcaactatcaaaaccggtgtagaataggtccctcgacgattttgagggcggttttggctgacgtggcgcctacgtggctaatttgactcagtattcatctgacgtggcgcttacgtagcaattcgatccgaaaaaataataagacccgtgggacccacatgtcagtctcacacagaaaataataaaaaatggtgggacccacatgggccccacatgtcagtccaactcacccctcttcttcatcctctctcccccatctcccctctcttcatctctctctcctctcctctc

SEQ ID NO: 12355 - DNA, 1501 bp, Oryza sativa
gagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcaccatctctccctccctttctttcaacttgacttctcttcattaatggacggagatttgtatcgctgccatccgaatcaccttctgacgggacggcccatacctacctccactttcaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgtattacacgcggcgtgacgcgttcgtccaaaccgcaataaatgcggttaggtgagcgccgctgtgctcacctaacccatacacgcggcgcaaaatccacaaggggtcggggcgccccaaccctcggggccaaggcgggagcggtccgaccccctcggggagacaaagaggagggcgaacacaccaccctcgggcccgacccccccccccccggtgggtgccaggccacgtgggcgattgtgtctgcctcaagcctctagtcacgatactcccggtcccatgtcatcgacagtagcccccggcgttatgccggggcgattaccctcctcgagggaagcggtcgggcgtgacgccacttcctaaggcctggtgacaggtgggaccggtctccacagttgggcagaaacccatcagtcgcaaatcacgcacatcggcaacggttactcggctgtcaataatgaacggtctcttcaagactgccacattactcgagtaacgtgtgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggattagtggaagagtgggcgcgagaaacgagggggcaagatagtgggcgcgagaaacgaggagccgggcacagcgttggcaagggtataaagttgccgaggaagagatttgcttcctttctttcgccattattccccttgtcttcgccgcttgcgccctaactccttgtttcctgtgccctacctccgccacacgcgctcgctctcaaacatctcttcttccggcgtca

SEQ ID NO: 12356 - DNA, 1501 bp, Oryza sativa
agctcaattctttctgttgtcctgctactgcagagtaggcgatacttcctccttggtataaatgctacatcaactttaagtcacaaggaaagctttttcttgatcaaggattgacactaaaactctagtactattttgcttcaaaggtattaatgattgatttttcaggtatattataagaatatacaattatctttttaaaagtgaatatacaatgaaacttaactctgctaataacgatgaattaactactccatttagtatggccgaaataaaacatgatgccttttagatagaactaatgaattaaataaggctgctaggctatgggtttcgaattgaattttatccagtgttctggtcttctgggatatcatctgtcaagagttatatatgctctccttgttgactttatatggtttgggtgtcagttgtacagatcttacgtgttatgtgtgctgttgtgaataactgaacagttgggctggttcgctgtaaggaagatctccaggccagcgtggagctacttcaacagacaccagtgtgtcactgaaggccgatagcgtctttgtatggatgacagagggatagtcatagagagttgtcagtgttgatggacctctgaagttctgattatctgtcatcatgtagaaagatagtgttttggttttaaacatcatctgttctatctttttgttggttatcttgtgttttgcgttttggttatcaaatttagcagcagatctaccagctttagtttcaggttctggatcgaggtaataacaaaccatcagggcttggattctcagccatgttgttcctacttgtattccgtgaagctgtgggcagaatgtacttccagttaatggacttcaccaatgtgagcctgattcatgggatgaatctactgaagattagataaagacaagtacgggtcgttgggggattgtaattcagaaaataactgaacttgcaagaaacctcaatggataatttgcattgtggttgtatcaaaactagctgggaattccgtgtactcacattgtttgtatcttcagtaccttgccatctcaagtgtcttttttttttcaggatctgttttttggagagatttgatgttgttcttgaaaaaattagatacagtaaaaatctactgatagcagcgagccgcgagcgacgtgtctcccgccctctccagccaatggcctgcggcgattcaagtggggcccagtttccagcgtcacagaggcgcctacgtgggggctcccacgtcagcacttgcatggcccacatgtcagtgtaaccatcgcgtcgtcatccccgtgcgcttgactctgctctcgtcttcctcctcctcgatctcccagatccaaaccgaacccaaccaagcggccgcggcgctctaaaacctctcccgctccacgcgcggggcgcatgaaaccctagcgagaggcgccagatctcccgcatccggatcgccgccatggccgccgccaccgcg

SEQ ID NO: 12357 - DNA, 1501 bp, Oryza sativa
aaatcgtagtaaggaattttgatcatttggaacgatttctcaacttgaaataaacgtggatctctgagtggtcattatgattaggatgagctcgttctggtcgatattgatatctgtcatacacgtaagtgtcagaaaatgttactgagatcatgagtcccagtcgagcttgcgttttcactcagcttttccatgtgtccctctatcctgggagccgccgttaatttaggcagtagaaatattgtaacacaaacaatcttaattcatggacatgaagaaattaaaaaaagaaaaaaaagacatgcatatgcgatgtctgtaccacagatgaaattaagatggagatttcattggtgtcatcattatgtacttgtcgagagacacatgcgtgcactgtttcgatgttggcgatgtacttatccagacgagtacctcttaaagagataacacaagttcaaatagcatcgcggttggcacacggtcactctacggccttacgcgcccatgaggcttgaaaatgttttcttgtcctatcgagcattaatgttcatcacaagttggagagactggatcgactgatctatactacctgtgtaggagatgtttggttttctactcgaacagctagctagctagatggacaacaacgacagtagtatatctctcaagtctcaactacggccaattccatttgtggtagataggggtcattaattcagaagccatatgaaaccagacgtcctggaggagagtgagttactgacattgacaacttttcacgtagtatctctctgaaacaactccaatgaaattaccctttttccatatcactactacaacaagcaggcgaaaaatcgctgaatgcatgcatggaattccgtaaaaagaaaaggtctacaaaagcctgcagaaaaagagaggaggggaaaaaaaagctactgtagcagccatggagtgtatgtagagatcgacatgatctcaaaactgcagcactcagctggctatctcaattagctagctttcgatccagcaatcaagcatgcatgtggatcccagctatcgacgcagcgcgcgccatcgatcgaacacgtacgtacgcgcgcccacgattattataaccgcgctgtcaaaaagataccaccatatcgatcgacaggcggagaaacggagagaaacgaacgaattgaagcagcttgctgccatgccatgccatccatagaacatcgatcgatcgatctacaaacgatggtagcagcagtaccaccgcgcaaagctataaagagataaaaactcgcatgcaaacgatgcatgcatgactgctgcactaccggccggccggcatgcagtaatcatgcatctgcagcaacaggagcagcagcatgaacagggagggagagagcaatattgcaagcaagcaagcaagcaagcagaatgcgatcgagcacgtcgccgtccccaggaggaccacctgcggtctctcatgttgtaaagaagccaacct

SEQ ID NO: 12358 - DNA, 1501 bp, Oryza sativa
gcggggtccacgacgcggacggtgtccacgtgttcgcggctgggttttaaacgaagcaaaggaatagtactactccctctaccaccccgacagaaagattcgcgccaagtcaaaaccccgggcccgtgggtcccaccttccatgtctgtactggaagcgagcggtgcgggggacgggcccacctggcagcgagagcgaggaacccatgtgtgagtgtgaaatgccccctcgcgcccggttgaaaccttgccgcactcgtcggcagccgcgtccacacctcggctgctccttcccagttcccccactccactgccaccaccccctctgcttcatcggggaatgcgaccgcgcgctcgagcatgcgacgcctcgagcccgggctagggttccccgactccgcctccgccgccgccgcggccgaccgacgccaccatcccgcacgacggaagaagccgccgccgcagcggcgaaggcgaccggcggcggccgcagcagtaataaacatatcccgctcttaaccttccccttcctccgccgcattgtcgtgttagggatggctgcggcacgcgcatcgcgagtattttagtgcaaggggcgggcgggcgcggtagaagtcaatagatccaatccagccacgcgcgccgctcacatggcggatccgaggttagtggcgaaaccatcccgcccaagcaaaagataaagccaaaaaggagaaagagggcgggcgaatttgaacaaagctaggcaaaagcgccgcatctgactgcttcgtcgcttttctatcattgctattttggtgcgattcgccggcttacggatcgctcgctgtttcgaattcgtctctgctgcttggggtagtgtgagtgtgtgactagtgcggcgactgtgcagtggtgttcggtggttttgatttctcctgattgctgaggcgattgccctctcttggcggtttctgcagccggcggtggggcctcgcggcgcgaccgatccagatccagcgccctcgccgctgcgcgtgcacggcatcggcatcggcagccacgcctcgcgtggcacggcaccgcgaggttggtgggcgggcgatcggcttggtgtgtgctgtgttatcccagtgcccgcacatttgtcgccagctaacctcttccacacgcaggtgaggaggaagaggaggaggaggagtggagaggcgacggcgacgcgggctcggaggaggaggagggggaagcggtcagtgactccttctcccactcgctgagaggtgattaatcttcccttgtagtacggttgctgcttttgtgctctgttgagtgtgattgctgacttcggtttggaatctgttggttggtagagtgccagaagcagcggaagctcagagcggagggggctgcgttgctgctttcaccggccaagcatgagctcaccggcggaggtggtgggagcatagaactgctggtgctctcgccgaggtgcttggttgggggtaatgttggaggaatgagca

SEQ ID NO: 12359 - DNA, 1501 bp, Oryza sativa
cgggtacggcgagtgcgcgcgcggaggccgcggcggcgggtggtcggggtcggaggaggccgggatgcgggagtcggcggcggggagcgaccagtagaggtcgaggaggccgtggttgagcgcgcgggggagctccgcaacgtagaccctgaggaggcggcggcggtcggggccggacgccgcttgctgccgcgagaaggggagcggcggggaggcggggcgcaggaggaggaaggagagggagaggaggagcgcgacggggacggcgaggagcgcgaggcgcgccatggccgccttccagatctcgctctgcttgcttcggatgggaggaggaggaggagccgccatggccgcactgctgcttgtgcgatgcgttcgtgggcctgaaactagtatacttaactgggccgggcttttcactgtgtccgtggtccatttgccgcgaaaaaacaaaaaaaaatcctcgtcttctctctcgccggaaaccgcttaagccagcgccaccgtgtcccatgcgctgcaccggccaccgaatcaatttttgtttatctttttaaccttttttattttaaaatttatttatatataagatctaaacattttaacaacgttatttgggttagcgtggcaagacaatactactacgtcgatctggctaatagtacgtctattatcttgacattgcagcagtgagaagggcacgagagaaatagaagtcgtcatcgacgtcgcctactcccttctgctgctcccgcttctcacctccgcagccatcctcctagtcctctccatcgtgaagccgcctgtggacaagagtggctgcggcggctggtctgccactttctctaacgacgcccaccttgcattcatgtccaccgccatgctccggctcaacttctttcctacctcaccccgctggtctcctccccctcctcctcgatctgccggcctgctcagacgaggagaagaggacagggtaatgacttggtcaccatgacatgcggagcctacgtgggtcctgtgctgactcagctgctttgttgaacaaaaccagggtcaatatcacctaaagaccaagaataattcggttctgtaagttgacaattttgtaattcgctgagggacctcagttgtactgtttactggaatctgaccaactggacaaacgacccattttatacttcctaggcccatatactacgtggcatggtccacgaactgatcgaatcacgaggcccacggcatgagcatttctgggctcgggatgggccctttcttcccttccaagccgtactccccccaacacttataccatctccaatcctatacttccccatcgcatcgcatcgcacattcgcactcgtctcgtcttactcaccccgcacgtttccacttcccctctcccccacctcaccaacactcctcgccgtcccaccaaaccctactaaccgccgcgcgcgagagggtcccatccccgacttcgccgccatggccggcgctc

SEQ ID NO: 12360 - DNA, 333 bp, Oryza sativa
tacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgcattacacgcggcgtgacgcgttcgtccaaaccgcaataaatgcggttaggtgagcgccgctgtgctcacctaacccatacacgcggcgcaaaatccacaagg

SEQ ID NO: 12361 - DNA, 1501 bp, Oryza sativa
ctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttaaaataaaaaaggttaaaaagataaacaaaaattgattcggtggccggtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagca

SEQ ID NO: 12362 - DNA, 1060 bp, Oryza sativa
cctgcaccccttagcctatgtgatgctacagtaaacattatctaattatagactaattaggcttaacaaatttgtctcgtgaaatagctttcatttatataattagttttgtaagtagtctatatttaatactctaaattagtgtctaaataattagtgtctaaataaagagactaaagttaagtctctggatccaaacactacttaatataggccatgtttagttgtttggctaatttttttttatgtatacatacacatatttaaagtattaaacgtaaactaataacaaaacaaattatagaattcgtctgtaaactgcgagacgaatttattaagccttattgatccgtcattagcaaatatttactgtaacaccacattgtcaaatcatggagcaattaggcttaagatttgtcttgcaatttacacgcaatctgtgtaattaggtatttttttatttatatttaataatccatacatgtgtccaaacattcgatgtaatagggcgaaaattttaaccggcatctaaacaagccctcaatgccatactccctctgcccctataaaacacgatccctagattcccaattcaaaattagtaataaaagtcagaaataccctcatcaagtacatcccttaataaggtttactagttgaaagaggagagagattaagcatttctcgtgtgaacgggagcagagagaggcagcaacattcaatgtttcttgttctctgcacagaaattgttttatactaggacaacttattcactcttgttttctttaaggaacagatagtaggagtttctcatgccgaaatttatagaagaaaagaattggcccagttaataagggaaatcgggcccaaaaaccgaacaagcacggttaattaaacgggaaaccggcaaaaacctatatagaaaaggaaaagaaagcaactattgagacctcacaaaagtcatcgttgccgagctcaccaaaggcaagcagctttgacaagaagaggcctactatagtgtgttgtgactcgtgaattaaacaatttcaatatccttagt

SEQ ID NO: 12363 - DNA, 1501 bp, Oryza sativa
gcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagagattagagagagagagatggaccatggcgatcgggatctatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaataggggatgggggaaccggacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgcggccggcccagtaagggaggggaaggaagggagaagtgggccgacggcccacttgacaaaaaggagggaaaagagaggaaaaagaaaaagaaaaggaaaaaggattttccctggaattaacaattgcactttagtgatttttaattggttaaaattatttctagagctctgaaaattccactaaaaatcctgttaatgaatttcgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacacgtggcgtctacgtggcagtgttgacttgtctgtggcgttgatgtggcgcttaggtggcattagagttaaaaacataatgtgggtccatttgtcatccacacacacacaaagaaaatgtgggcccactaacacatgggacccacttgtcatcctatcctcactccttccttctcactctctca

SEQ ID NO: 12364 - DNA, 1501 bp, Oryza sativa
gcaaagcaaaaggcccatcgtttcctccgtatagaatcgaccattgacaaaatttaaatttggaaacttacttttaaggcttattttgcaatatttttatcaaagtttcattttcattttaacacttaaatcactaagagtacgtatataaaagttttacttagtttttttttactaatatgcaaagtacggcgtattattagcatttggctaaaagatagggcctaactattcccaatgctaaaagccggataaattaatttgtgcatttcctatatcaacactggtaagtagtacgtactcttgtactcttcttttcgttcacccaccgaactctctttgtattcctgtgagctagagcattatttttctttaaaaattaataattattcgtaccattttttacttctatagacatgaaaataaatcaaatatacgcatacgtctccaccacagcacaaaataatacttgcaagattcaacgtacaggtggattttccttagaaaacattggggggctgctatatactggtataccgttcggacggtataggcccgcaagcaatttagccggacgattccttccattcaattagtatgtctgtcatcgtgtctcaaaaggtgtgtcatgtcaccccatcgtttgtcattttgtccacgtgcatacgcaaaaaatcttcatgtgatagctaaactagttcagtatagcaagtagtagcctacctagctaccaggtgtcaaatctgatactaggtaggtatcacatctgataccgggtgagcatcaagtctattattaggtattacgtctgataccgagtgggtgccatgcctcataacaggcatcacacatgtctgataccgagtgggtgccatgcctcataacaggcatcgtgtgtgatatcggttggtatcaagtactagataactggatggccaagtatcatatttgatacatagtgggatcggtctagataaacgatacctggtggttatcaagtcctgatatctaacaggcatcatgcgtttctgccacgtatcaagtgatacttacgaggtatcatatgatacctatcaggcatcatgcaattcttaccacgtggtgggtgatgcttgcgatgtatcaggtcctaatacctagccagtatcgggtgatacctatcaggtatcatacgattctaccacgtatcaggtgatacttgtgatgtatcagatgatacctatcgggtatcatgcgattcttaccacgcggtgggtgatgcttgcgctgtatcaggtcctgatacctatcaggtatcatgcgattctaccacgtatcaggtgatacttgcaaggtatcagatgatacctatgaggtatcatgcgattcttaccacgtggtgggtgatgcttgcgatgtatcaggtcctgatacctagccggtatcgggtgatacctatcaggtatcatgcgattcttatcatgtggtgggtgatgcttgcgatgtatcaggtcctgatacc

SEQ ID NO: 12365 - DNA, 1501 bp, Oryza sativa
gagcggtgcacaaatccaacgagactaggtcatgaccatggatgggggtgggttgatgagcttggtaatgataacatttaactcctcctgatatagaggaggcacttgtgaatggtgtagttggcagggagaatattggatgaaagcctttgacatcgacgtctattggcaccttatatttccctcctttcttccttagaggcgatgtcaccggcaccataaattttccttcttagatgcgtcgttgcggtttttctttcatggtcctagagtttaggcacgctccctacattaggtgatcgttggcttttgtttgtaataggaagtcggagttgcttgtactcctatactttaagcttgacaacgatgacttatatcggtactttagtcctaagggtgctaggttatagtggtatgccgtctttgagtagtcctgttattttcttcattgagattcttgccggtttttcttaagttaatcgtacaatgataaagttttagggtccgatttttcttaacaaattgggttacctcttttctttcttccataataaaaaagcaggaactcccgactccttttcaaagattttcttcgaacttttttttaatttctcaaaagccattctaatgagcatgtcatgttcttggattttcgtggccatatattacatcataaccagtaacaaaatatatacaacaagtcgattaattcactagccgaagaggaagagttacaaactctcagccaaagtaaatttcatcgacttttattgagctaatctcaaaaggccaaaaaaagaaaaccagagacttttattcagctaagcatcttcgccgaccgaccatgcatggcgctgcacctgcagccatggcgacgacggtttagtagacggcccatccgtcgcggtcggcgagcccggccctgtagccggcgtggtagaacgccgcgtcggacaccatctcggtgccgaccagcatcccgccgatggcgccgccgaccagcccggcgttgagcccccgctcgaactccaggctgccatgcttgctcgcccctttcgtcgccgtcggcgtgcccaccatctgccagtcggccttcgccggtgacggcgtcgacacgtgcctgtcggccttcgccaccgcaggtggcgccagcgccgccacgtgcccgccagctcgcgacggcgtcgccggcgccggcggctttgccagcggctgtgtctgtgtctgtggcggtggcggcggcgacagcttggcgggtggtggagacggcggcgacggtttacgaaggtaggcgtccggtggtgggggaacgtaaggcggcgagggaggagcggtctcgaacagctgcggcggcggcggcggcggcgccgggtaggcgaagacggactgcggcgcgacgacggggccgaggcggtaggagaggtggagcacgccgcgggtctcggagcgatggagcttgcggacctggtaggaggcgaactgcggcgggcgggcgccgagg

SEQ ID NO: 12366 - DNA, 1501 bp, Oryza sativa
atatttactgtaataccacattgtcaaatcattcagcaattaggcttaaaagattcatctagcaaattagtcgcaatttgtgcaattagttatttttttagcctatatttcatacttcatgcaggtgttcaaacgttcgatgtgacatagtgaaaaattttggagtgggatctaaatagggcctatatctaacattgtggttaaggatgtaaagggggtgtttagattcaggggtgtaaagttttggtgtgtcacatcaggtattatatagggtgtcgcatggggtgttcgggcactaataaaaatactaattatagaatctgtcagtaaacagtgagataaatttattaagcctaattattccgtcattagcaaatgtttactgtaatcgcatgctgtcaaatcatagagcaattaggtttaaaatattcgtctcgcaaattagttgcaatctgtgtactccctccgtcccataatattataatctaggactggatgggatgtttcatagttcaatgaatctggatatgcatctgtccagattcgttgtactataaaacgtcctatccagtcctaggttttaatattatgggacggagggagtaattagttatttgagtaaagtgtacgggcgatccttaaacttgtagaggtgtgtcatctaggtccctaaactctcaaaatgcatatccaagtcccagaacttgtcataatgtgtcatctaggtctcaaatcgccacaaccccttcaggatgctacgtggcgttgatgtggcatgccacacggatatgacgtggtattattttgactgacagataggatcaatttaattttttttccttttttcttctctttttccctttcttctctttctctctttctttgtgatccgtgcagaagaaatggaaaaaaagaagaatgaaaagaaaatgaaaaagaaaaagaaaagaagaaaaaaaagagaaaagtacacgtcacgtccatgtggtattgccacatcagcgccacgtagtattctagaggggatgtgtcaatttaggaccaaaataatacactttgacaagttctggtacctgaatatgcattttgaaagtttagggacttatatgacacaatcctacaagtttaaggatcaccaatgcactttactctagttattttttttagcctatatttaatactttacgtaggtgttcaaattttagggtggaatctaaaccgatgctaattcaaactcaacgtcaacagctaagaatcgtgttctgaacacacagcaggctcacgtaggccacgccacctcaccctgttgaccgagtcaaaccaagcggaagcttccaccgcaaggagccgcggcccacttatagcccacggataaaatcccccgcaactcgcgcacagcccgcccggcctgtctagcgcctcgactccattcaactcgcgcaaaaccgcggcccgccttggccttgtgcggcggcgaccatggccgccgccgcctcctcct

SEQ ID NO: 12367 - DNA, 1501 bp, Oryza sativa
acagatcccttcccttatataaggaggggtccgggttcctctcgagacgattcttttttctcccaatcatacaatcaataacacactcggcggaatcatccccggacaggagtagggtattacttcttaaataagaaggcctgaacctgtataaaattccttgtctccaaacccatccacttttctagcttgatagccacccccttttattattgccgaaatcttgtttcgacattgatcatttaaggtaacaaatacaatttcctctacagattactaccatcggagcatccttttccttttggcatatcccttttaacaaaaaaacgttgtgctctaccacactcaaacttatcattttctaaattaatttgcaagaaattgattcttatttcattctaccaatgtctgaagcaaccgtgcaaggtatcaactagtttaagtaatatattgtatttgttgattaacattatgatgagtcgaaaaccgggaaatattcatgctctggacatgggctaaaaggaggtaatggggagaaactagacagagtttgttccaatttaaatttgaaacgaaggctgtgaaataattcaggaagattcctacaaatacatactactataaagtatatcaccttaagcattgtgaaagtaaccttaagtattgtgaaagtggaccataagaatctgacatcaaaaataagcattagccttatggtgtggcaacaagactatagaatgtggaagcgaggaactcctacggtgaggaggttacgtgttgataataatgccacaatcgggcgacaggattacaagagataaatagcttcggtgagagtttgttgtgtacagctaaactacagagattgatcatatcttatctaactaacacaacaaactctatcctcagccatacgggagtattatcaaatgtacatgcaatatatccaaactctaacatagaatataatacttttgtgatgtgttgttcacgctagtacttttggggaattttcattgtgcaaagagtttcacaggaggataagaagtgattttttttatccttcggtgggacccattgggacccagcttattttctcccataggcacagccattgtggatatggacataactaatgcttactatagcgggtcccacatatatggctgatggaaccataagcattggccttgccctaacctattggcacaaaagattttctaaacatattgaaattaccatagtttttcactgagacaataaacaactaaaatgatttctttggtatagcttcagatccaagatcttttaaagtgggtattttacacatgacacatcacatcacatagaacctgaaaatcttaaacatttataatttaacatatgaataaactattttttttattttaaatgaaatctaaaattcttaaacatttataatttaacatacaaccttcaaataatctattatgtaactgtgacgtggaactgtgccaaacag

SEQ ID NO: 12368 - DNA, 1384 bp, Oryza sativa
cccttaaaccctagtgacagagacaagccgaatccaatcgagactgcgaaaaacgtgatccggaccaacctcgtgggagggagctggaggtgctccgtcttctcatcgagcacaaccctcgtctccgcgaagcagccgcaagggagttggagcagcgccgatcgtcgtagcgacttgcgagaagccatcgatttgggggagagaaaatcgttgggggcgtagagaatcgctcaactccttgccgatcggccgattcgggcggcggggaaattgggagagaaaagccccggaataaatgaaaggacgtatttgcaaacgaaaaataatttatgaataaaattttgtatatgtgttcttagtgatctaaaagtaaggctgaaaaataaacttcgatgaaaaaaccattaaatcagttctaaatttaaagttgaaaatttaaattttagctgataagtataagcataagcataagggaaaagatgaggccccaaagtttagatgatggcggcgttatttggattgggattatttggcctcatcttttcgtttatgcttttacttatcaaacaaattttgaattttcaactcttaatttggagttggttttggggttttttcattgaggtttatttttcagactttgcttttagatcattaagaacatgaacatgtataaaaagttttattcacaaattattttttatttgtaaatataccgtttggcttattcacacatatgtgaaacgatggggccgtatttctttgtgtttggggaaatttctttgggtaacacttgttaggcccggacttcataatttggtccgaaaggatgcattactttacatgggctttctcatggactagtaatgtagcccaatgtcatcgtcatggtcttggtagagtcccatctattaattgttttgtttagttgggatacatgagaatttttgtgggatagggatagagaattgagggaggaactccctccttttcaatacctgggtagtggtggtaattgggacggaattcctcctttactttgcctaaacaaatctcagccattcattttcattaatgaactaatctccaactaaactctctatcaatttccactacctctaccaaacaagatactgggattaaaaatcaaattctcattttaatctcaccatcaattccctcgtgtaaactcccaatcctattttaatctcaccatcaattctaaactcccaattcttttccctgcgttgccaaacaagcagtgtgcgaaatagcgtgtgaacttcaatttatactgcagagattgatttatacaacatatactatgaaagttcaacaaaagagacaggtccagacctgaacaatgttttgagtgcaataaacg

SEQ ID NO: 12369 - DNA, 1501 bp, Oryza sativa
ttgttatatgattatatccttctggatcagtcctgctgtcctggtctattatgcagaatcgcagatcgactcggagcattccaacttcttccaggtgactaatctgaacttttcacaagtctctcctgatccagaaaaccagaaacaaaagataccacaatagcattacattgcctaattgcagtctcagtttcacaccgcacaatcggtgtgaaccatctggtaattgcctcgccacggacagatggaatcgtggaaaacttgctgtaaattactagattattagtactattagttaatgattacacgagtaggccagccatttgaacacctgtaatgcagagtgtccgagtagtgaggcgatcacctaatccgagttccagttcaaagttttcgtctgattttctttttgacagttaggttttgctgcctgctgaacccaaaggaccagggtttgaaccttggacaagtttggtcgatctgtgcgtgtttatcttacatcttatcatcaaagtactaccactattttgtttgtggctgtggtcttctgttctggttcagtatctattactgctaatttacatatgtgaaacctttcatgaaaacgtggtggcagctcactggcctgcaagcacgtcaaactaccacagttgcgtactactgttgaaattctgatctccggtttttgtcgtcgtcgtattctctgacaaaaaaacaagcagcagcgttttgttttgttttctgtcagagaataagtgcagccataaatatacgtgcacagctttttgaccatccgtcttatttaaaaaatttataaaaaatatttaaaaaattagtcacacataaagtactattcaagttttatcatctaataacaataaaaatattaatcataatctttttttaaataagacaaacggttaaacgttggacatgaatagtgctaaaactacacttatttttggaacggagggagtacaggctacaggctaggggacgtctcagcatggggagttgggaatttggggttgttttctgcagatgcaaacagtcgtcaggccttttccttcggagagaatcgtcacagaaaattggtctaatttttgtgtgccattgaaaattgtttttttcctatattccattgttctaaatttgtgcactctctcatgtcactcccgtgtgttgatcgttatataatcagaatgataaatacgtcttttttatttgagagttaacggtcaacacacggtcaacagatgtgagtgtcatgagagggtgcacaaatttgaaacaatggcatataagaaaaaagtcaattttgagtggcatataaggaatcagactaattttcaatagtatataagaaattctctcttttcgattccttggttgatacaaggccacgaccgcgaaacaatcagacacaatagaatgcaaaatggatgtaagaaaaaaaatgaacttgtggtagtggttctcctataccaagtagaaacataaa

SEQ ID NO: 12370 - DNA, 1501 bp, Oryza sativa; identical to SEQ ID NO: 12369

SEQ ID NO: 12371 - DNA, 1501 bp, Oryza sativa
cagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtacatcgaaggtccctgaacttgtcatcg

SEQ ID NO: 12372 - DNA, 1501 bp, Oryza sativa
ccacttttcctgtatgctaatccttcattccgatgagcgaatagtttcaatttctatagtaatttaaatactccattttcctctaaaaatccttcaatccgaaggagcctttgcgacctattaactccactgtaacaagggatgaagggaatatgattgagaaaagttctacagatttgctttctgtaccccttccaagagaaaacaaacatgaacagctatatgtttttatttcctttaagaagtcccatgcactctcccctttctctagtatctctcttccacaaaattaattccaccaaatttcctttgttttgtttccatccaaatgctcaaagtcaagactcctaaacattgaaaccatgtagaaatatgaagtgtgtaacatattatttataagtattttttctttcttgcttgcaaatgatcgcttagtatggtctagatgaggggacttgggactgggaggaagacatatgtgcaattgtgacctctattccagttcactgtagtacagcaccattcgggcctatttatgacggcccatgtaaggcccggcacaagtgcatcttaagcccatattcatcactattctaatctttggctattggctctcttgagacatgtataattgcatttatgtactcaacgatataggtaatcacacctatatatgctcaatgaccgatatatagatgaaggctgaaacaggaataaattatctgaattttacttctcaataaaaggtcatcaaaattgggtaacttcttttccttcctgtcacacatatagatggttggagattggtcatgcatatatgatgagctttgtttatttccaaacaaaaaaagtgcttaatctcaaccatttcttattttctcccagaggttatagacaactatttagagtggttcatcgattaagttggattccactatgtgagcctgacaaactatatcggtgtgattaagccgctgctccacttcgtggccgctgcgctttgcaccaataattaaaaaggagcatccgtgcaagccacattcaaaaattagtcaaccattacatacaattttagctgttattttatttgtaattaaataaatatttcacgattcatattgcccagattttgctacacagaaagtaacaatttgagcatagatcatgttctttgcatggtaaacctaatggaaatatacgaagaattgtagaaagatcaacacatcacacattgagttatcgtaaatcattctacaaacatgctgtcagggttatagataccatatacataatagtagtcgactaaatctcggcaggacccactacataccatgtcttatacgaatacaaccttcggatataggaggagttccgcataaggaaggatgaatagggttctacatggaaaccacaaggactactcggattgtatccatattagtttctctagttctacttggacaaaaggacatatgggtataaatacaagactccataggag

SEQ ID NO: 12373 - DNA, 1501 bp, Oryza sativa
cattcgccattcgtccacttgttagcttaattaattaccagccacggtaggaattgaaattctaaaactcaactttagttgattttggtttttgttcatcacaatccacttaccagcattggcttttaaactgttaataacaaaaatataaagttttactcataaattattttatttctttgttcattttctcatagtttatcggctgtatctcaaacaattagatttatcgtgtagggacctttgtatggacccttcagaactgaaggaacatcatgggattttttttaggaaagaaaaaggactattttcaaagataactctacaaaactcctatgttcttttcaaggaaaaactgtagagaaggatcctacagtgtatacatatattaatattatataactacatattttcatacaaattatctagccattttgtcatcagaggttgtaaactatttcttgctctatggaaaaccaagccaagttcttttcggaatcagtcttttatgaacataaaagaagaataggtggaaaacaaaactcctgtatttcaaaggagttggcatcgtgcgtagtggtatgtgcgcgtgtcccacccatgtaatattccatgaacaactctagaaaacacatatgagtaaggaaacaacattacatggggtccgaggccgtgcaatattctgtcacaggtgaaggcagcacaattgagcaagttgtcgcctgtggtaccgaacaagcgtccgatctgcatgaaaacagtacacgcactacactctttgcaaacgatggctgaacatgcaaggtttcttggaagaaattcggagaaaactttggtcttgtgcggcaatccacagatctaggatggtgacattgtctcatgtagatgatgcatctccatgacaaaaacaaaatgcactagtgtggcttgcacagtagtggtggactggtggtagagtactcatgtgacaaggccaagaaattccacaagaattgaactatttatgtcagataaatttatatcaccacagcaacattaattcttatttatctggtttgtatagttgaggggataaaatgtctggttttcaaattcaggagagtaatttaatttaattgatcacgatagttgagggggtaattcgtatttttttccttaactcaatgttactactactttttgaagcatttgttgaagtttgttcagtgcactcgtgctcgtcgcgtgtttttggtggcttatcaacagtaaccaagatttgaattttgaaaagtagaattgattcaggagctttttttatcgtagtctattatctagccttggcttttgaatgcttgtaaacttcgacaatggattaaaaacttttgaagcacaaattatataaaactgataataaattttaaaaaaacgaatgatgtaataaattttttttttgttacaatggatgtttttcttcagattgttagccgtgagcccgtgactcaacttatatcgaagcata

SEQ ID NO: 12374 - DNA, 1501 bp, Oryza sativa
tcaaacagttgtagcgatgaaataatttagctgcaagtggaggtcagccaggctggttttcatctgccattctgcgttcacgcgggcgacggcaatgcaactgccgatgtcattgctcacattagcaccggctctttttttctaaagcttaattggttctctgaatttctgagaccacacggcattcgattattcgatcgatacatcgcttactatgggcgatcgagttcatgctactactgtcctgctactctctccattttaatttgtaacctaagattgaatgaaacttaacctattatactacgaatgtaatataaacataggatatgttcatattcatagtagtacatattgagtatcatctgaacttatgatactatattatgagatggggttaataatatatatactatctccgtctcaaaatataccaacataggtatagatgaaatacatcttaacactacgaatctgatatatgggctatctaaatttatattattaggatgtgtctcatccaatagtaagaggttttagcagattataggagtataggtcttttgaaaaagttgatgtgtgctttgatttgattatttaccacaccttctgaaagcaaatttaccacttgcaagaggcctgactagcatgtctgtcaatggcaggaaaattgatgtgggtaagtgcgactaaccagctgtaatcacgaacatcgatcacgactagataatgaacgtcgacaaggaactttttccaaggcgagtgatgcatatgtatgacatgtacgtccattcagaagcgtgtgctgtgagagttttctgcagctcgatctacgatcgatatgatcgaatccagagtagtatccaacaggcagtgccaatactgtacgcaagaccaaattaaaacgtactcatatccaacagcagtagtgtactatctctcgctgcaaaccatgacttctttctaatctttccagttgcaagccgatctactgataatataactaacatattgcatacgtacgtgaaataacgttatccatgcttagcttaattcaaagtttatttttatatatcaagcaggtgctcattgacattggtgagaaggacgtagaagtaacggcgacacaacaaaattagtactatacgttaatcttgctccgatcctctgccaccccttcatttctatacccaacattactttcactagctaagcatctattatttttcatatatatctgcaggcagcaagcgtacgtataatcacagcttaatcagccgacatgaaagtatttaatcatacagtaccacattaattaatctcccgcgaggaaacatctatcctggtcaaagcatgagtaaatacttaattaattaaactagctcctcttaatccatctacataaaaattcgtgcaaaagcatacacggcatgtactgttcgtccgtacgctgccgtctcatttcgctttcgtagaacttgctctaggaaaacaactatgc

SEQ ID NO: 12375 - DNA, 1501 bp, Oryza sativa
gtggttatagctggcttataacctgctattgtacctgctctaaggatttttcttggattttcgcagagataagagactgtttccaaggtcatttcctgaaacaggccacacagaacacagtgacacagatcagactccattactttcatgtgctacacacacagggttacctggcatatgtagcagtgagcagtgactgtttaccaagtaaacggccggtgtcctccaacgaatccaagtgctccactatggccgtatggagacaattcagaattcgaccggccagaaaggttcagagaatctgaaattgcaggtcgactgataaaaccaacgcctgggcgatcgaggtatgctcatggtgcctttcttccatggcgcttttcgtgcagcacgataagagcaagtttaatagtgtagccaactactagctccagattatctatagccaattcattcaatagttgcttactatactattaatacctggtcctacctgtcgtacacacaatacgttttggagtccgtgctgcagctggctacagatctgtagcccgctgctcttctctctcttcctttatctctttaaattatgtttatagttggcttatagcctgctattgtacctgctctaagagcaaggtcaatagtgcagcccactactagctccaaatcttctatagccaatgtaatagccaattcatacaatagttgcttactatactattaatacttggtcccacctgtcatacacatattacgtcttgtagtccgtgctgcagctggctacagatctgtagcccgctgctcttctctgtcttcctttatctctttaaaatatgtttatagctggcttatagcctgctattgtacctgctctaacgaaaccgatcaacgagcacgaaatgaatggcacttttgcagtgctttctgatctctttctttatcatggagccaaaaaaaaccccaaaagggattgatctcaagtggtcgtttcaactctgaataataacgtgcaccaaagagggtggtagagcagcagtatctatataattcttaattctcgtgttcatcatgctactagctagctgctcttttatgtccatggctgagaactgggtggggtgtgaggaaatcgattgtgacaccactatctatcaccatgtggcatgataagagtgcccttgctccaactgcactaagctttattcagtcggaaaaaagaatgggcacttcatagaaaatgaaagaaaatagaagtggcctaagagcagagagatatataggaccagtttggctgggcccctaagcttgcccgacgaaaattggtgagtgaaatccccttcactagtggagtacaggaactgaaaattacttgggagttcaggaactgcaaattactgtggaagtgagaagaatggggttaaatccatgttcatccacatcagtcttcatcacctggaagatttggaaagaaaggggacgatagagtgttccgtgatga

SEQ ID NO: 12376 - DNA, 1501 bp, Oryza sativa
aaataacaaaagctacccataaacatatgggctggaggataaaatatattatttgtctctacttcttctctccttctaatactatttgctatctatatacattatgaatgttacaatagttaaaatccatacatgtgggtcccgtctatatggactacttttgctatacattgttgttgggcccctttaaatcgtagaattgataaaacgtaggaatagaaaaaacgtaggattttgatagaaatgtaagtgtaaaacagaggattgaaaaaacgcaggaatgactgtttgattgaatcataagaaaaacgcagaaattggatgagagagatatactcaaaggaaagttaccaagaggttgaagctcttgctaaatttcctccaaaatctatataagattgttcatttcataggaatttcaaaggattggataggatccaatcctttgtttcaaagtgtttcttaggaaatttttctataggattgaaatcctccaaaattccaatgtttttcctctaaatcaaaggggccctaactacatgtagttagtaacacttacttcaatcaaatcaagtttattttaagttttgttagcacctgtaaccacatttcaatattgaaaagacttttgttgcttttaggttttctcatcttagtttattttagagcctttgtttctaaatcactaataatatatatatatatatatatatatatatatatatatatatatatatatgaaagttttattcataaattgtttgtttgcaaatatgtcgtgggtctcgtttaagggcctgtttggttggtgccacattttgccacacttgaggtagatcagtttgaccaaatgtgattagtgtttaatttatttccacaattttgacatgccacattttctactcttttggtcccactagtcatagactcttttcttagccaaagtttaccacaagtgtggccatcaaattttgagacacataatttgcatcttgccacaccttcggtacaaaattgtggtaaatcgaggagggcttccaaacaggcccttaggggtccggatcctacctgctccagtggctaacgggtgcggggtgccgagcagcagaagcagtgagcgcggtcgtgccctccacgagcccatctccttccccttccctttccttgccgggccaaccaatgcacgcgcgccgtcgccgtcgccgtcgccgcggacagctgccacaccacacacacacacacacacagcacggcccgtgtctggtactccccctacgcaagtgggcaaacgcagcagcagatgcattgcaccttctcctcccccctccccccgcgtgggccccacccacctgaccttatcccttcgcccccctcctcctcctctttcgccgcgatttctttaggattttttttcccgcgatttcggagccgcgggatggatggcccccctcccccctatttaacaccgcctcgtcgctctctccttcctcatcacaagctc

SEQ ID NO: 12377 - DNA, 671 bp, Oryza sativa
attattggaacagataatccaaaccatcttgcgattctggatatgaaattaaatgaagaacacacttctatttatgtggggaatctaaaccatattttgctgacagttctttgtaatttattttataaaaggtttttgatcatgtgtagtgaagtgataactgacgcatatccgtctgttatgggctttatcagcgcaagcatgtccacggagagatttatttcatgtaggcagttatgatatggtttggttggctaacttcatgtcctatgattttggtaactgccattcttgtatctgtagatgtcggatacatgtttaacattcaatggctattattcttctatgctttcatccaaaggcttccaatttttctatgatgtggcttattgggaatgcttattttagtaatcagaagtataggaatagagagattataataacctctaccgctcattctgttgtcataatttgttggtaccttgagctcaagttgatttatgaatctagcacgtcaaatgcatctcttaccttttacctggtttgacacattaagtacaaaatggagagcacaatctggctgatcaaagattcacagtttccatctggtcggtagcataccccacactcatttcttatatgccttgcaatgatatttctatgtgacaata

SEQ ID NO: 12378 - DNA, 1501 bp, Oryza sativa
tatactccctccatccataatatagaaacctataactagatgggacacttcatagtataatgaatatggacaggaagcatgtccatattcgttgtactataaagtgtcacatccggtattaggttgttatattataagacggagggagtatatgaatgtgggtaatgctagaaagccttataacctgaaacagaggtagtacgtaattattaaatctatcacaattgataataacatgaccttaatttgctcatgtttgaaattttgttcccatgacaaaccatctgatgaagagctgaaaaccaaaatttagttgctactattatttatttctatattttacacaccaatctaaaatactattgttcctcacaaaattaaagcttgcaaagtcacaaggatacaagatccacacacacaatcccacaaactttacacaggcactttgcaggcttgcagcacaacgcccagttgcagctcaaaagcaagcaaggcaaacggacgtctggcccacatgtcagcctcacagtgaaggtgaaacaccatatggcatagtgcagagttcagacttcagacaagctcaaacattcagagttcagttcagcaagatcgtcagtcgagcagaagagaggcctgcctgaccaggtggcctctgcgctcgaacacctgcctcctgcgcctctcgaggtccctctccacggcggcgatctcctccatctcgcggtcgcattcggcgatcatcgccgcatactgcagctgcagcgccatggacaggggcaccatgtttctgctgctgctcgcgtcctcctccatgagctcaggtgtggcgctcgccatctgttcgtcgcgaggacactgcttgatcttgcactttgccgcgctcagtgcttcttgatctgcgacggcaacaagccaacaacgccaatacattagtaaatctacttgattcttcgaaatttgttggtttggtttgatcgagttcgctcattttatcaaccttgatcatcattcatcagtgagaatattggaatcctttctttctttcgcaaaaatcgagctcaaccgtatgatatgatgcgaacagggcaatgctccatgctacgagcctacgagccaagtttctccgccagcacacatgcaaattcaaattcaacttctactcccgcaacgaaaaaaataaaaacgaaaaaaaaataaattaaactataactagttaacgtatattcacaattaaattgttttattttattttgagatgtaggagttaattttaaacatgcatatttacaaagtgatatatcacgtattaatacatcttgagatatcctccgaggtggtagtacctgcataggctgctgcacggccagcactgcctgcgtctgcgtctgcggcgtcgacggccatggcgtcgtcgtcgtcaccggagacggccgccgcggggaggttgaggtcgatggtccagcagggccggtcgttactccggcgaggggagccatcgccg

SEQ ID NO: 12379 - DNA, 1501 bp, Oryza sativa
gagcgcgccgctcgccggcggcgggggccgaggtcgagcacctggcgcgtccgaacattgcgcgctctgtaaatcccgtagattaccattccatggctttccacgttaatcgaacggcttacaatcaccatggaaatgccttcgagtgtttgacgatctttctctcttttgattttctgttttaacaaacatcatgatccacacatgaaaattcgtatacgtagggatcacaaattgaaatcggttcctatcaaagaaaaaaaaggtgtagttttgcattgtatcggatagcggggttgatgcgacaactgcatggaaatatattggttatattacagtaatgttagtttcattttaaattaaaaaatgttattgataatcaagacttcaatcctaaccgatgaaatgggatgcaatattcttttctcgaatgcacatacacgtagtcgtaccaactctatcactataaacacattcaaaaatttaggttagaagtcaccgcagatacttcttaccacaaaacttacctcgaattaaggcacctttgaaaaatacctgtctaataaaataatcacaggtcaccacaagcattgtttacccagaaagacatgaccaatttaccatatgcgccatattaaaaaactagtctagaaatcaccacacgttaccatatgccaaattcatatcctctactcagcattatgccaaagttatattgagtagaggagactcaaacattgtcggacatgttgcactataagtagcctagctaattaatttatacttaattcatccgtataaagtaatttatgatagacacactacgtgtaaagaacacgtaggccaaaatcttatatttctaattaacatttttgcatatatatatatatatatatatattaaaatcaaatagctatatcaaccatgcgaactaatgagcaccctcccccccccccttccccgtaatggaacttcaaacaactgccagcaaactctccccagcttgatcattgagaacactcaaccgccatatatcaagcaaaccatatcatatatctagctcagaagatatttggtaatttaacactccttaatattggtttcgattatttgacatattagtccactttcattcatcttagatggttctacatgttatcctcaaaagtatcaattgaagcaacaggacaacgaaaaaagtgttaaattatcatttttttccaagtttggtaggtaaattgttctaaaaaaaatgtttgctaggtaaacattatgttttagagtacaacgcagagcagcatgcgactatgtcctcgctcacaacgtccattttgcaagtagaatcgtatcaatttgacagtgttgtaatttgaactcaagaggattaatttcaaaacaacgtgccaatctccacgtgctcccagcaatgacacacgggtttgtcacgtttcccaaacttagcccatcaaagaaaggaatagaccggaagaaagcccatcac

SEQ ID NO: 12380 - DNA, 1501 bp, Oryza sativa
aacgaaccgtagccgcgcagacgtcgatccgtcacgcaatggcactatggcaggtatgggccgtatggcgccatggcaatggcatattggggtagcatgcagcgatacatggcaggtggtggtgactctctcgctgggacctagctagcgagtgtgcgtgtgtgcgcgcgcgcctgtggttggtgagagcgacaggtacgtgcatgcgcgcgcgacgcaaccaccggccgggccacgcgtacataaaagcagggggccagccgcgggcaactaaccgatcgaggaggcgcccggcctccgagcctcggacggcgaccgtgcggggcggccacggcgcagcgaggggacacgcggggccaccccggcctgccggccgaacgcgacggacgaatcgatcgatcgatcgatcgatcgcccgcgcgcccgcgatcgaaagctacggcggtgacggccaccggacgagccacggccacgcgcacgctcgtgctgactgcggaccgcgcgcccgggttgcaaacggcacaggaatcccttgttgcaaccgacgaaccgagctaagacaaaaacaccttgcattggaacttggaagtaatctttgtaggcacccttgacagagttttacgcagtagtcggtatacaccgtagtagtaacttttttgcgggtagtgtcttgagatctgcaatcatgtccaaatctattggaaaggggagagcaaggaggagtaataaaagacaaaagaccggtaacacctgaagtgtcttcgcacaagtagcggcatcaaaaagaagaatgtatggtgatgccatgattgcagggggcctaaagacggaatggccatcgcacgttgttggtgggtagtagtagaagctttaatctaagctaagttcacaactatgggtctatctggtagaggctcaactcctaaatttagtttcagaagataagtttgtagtggagttatgaagctgcctaaacccaacttcacctatctagctagttcgttttgtgagagagtttcacccagctctactcctatttcagatgaaactgaaactatttggataattgaaagatagaaaaaacatcatcctatattcacgaagcaattgcgggcatagaaaattttcattgggtgatttaatctgagcttgcaaataaaaaagacgtgtttctaatctcactctcttttctttctattaaaataacgatgcacacgtgcacacccataaatatgtctcttaacatatgctaaaaagagacggagactaaaaacatattcgtcaccccactaaactcctattgaaagtgcactcatgtctaggtaatatttcaagtctaatgaataagtcacgtacctgcgacacttcaccatcagtagtggtgaaaaaaaaaaactcaactagtggctgggatcgacttatatcatgcttagttcagatcagctctaacttgtagtcataacaagttgaatcaagctaggcttttagcacgtgaacggct

SEQ ID NO: 12381 - DNA, 1501 bp, Oryza sativa
acttctcgatcagcgctgcccaatcacttcgacgtaggagtacccctacaacgccatcgtgctaagtgcaaacaaaacacgaggacacagatcagatcagtcttcaacctcctcgctgagaacacagagaaaggccggccagccaatccgctcatggcagcatctgaaagtgaaaccaaaacttgaaaactttgcaactgcaacgttgcatcgatgccatttacgtgcagacaactgtgggcttgaaaactttgcatcacaaacaacgcgttgctgcaggtagatgcagagagatagatatgtcatcaggctaaataaaatatactgcgcgcgcgcgcacacacacagagagacgcagtgacagcgccaatgcagtcactgctgcagcctgtgtaaaatgtaatcaatccaaggaaaagttaaaaaggccactgtaaaaaacgagtaattaaagtggagggtggggagagagggtacagggcgagggctccgagcgagagggaatttttcgtggctgccgacatggatcgggttaatctaaaccggccttgccttaatcatcgtaccgcacgagagggtttagcacgaaggtaaaggcgattttactgccgctgatacacggttaccgacgcgataacgacaggttgggaatcgacacctgccccccatgacctaatgcacggacgctaatcaccatgctacttggcatctagtctgaatctcaagaaaccataggacagtacgtgcgtactactgcatttgcccggttgtaagctcaaaacgaaagaaaaattattaacctggttagggctttagggcgcctctaaactatgtatgggcttggttactagctcgatttttagcgtattttttaaacggttaaatggcgtgtttcatatgcaaactatatagaaatctcattcaactaaaacttcttaggctgtgtttgaggagaggagatagaggagattggtaagatacgtaaaacgaggtgagccattagcacatgattaattgacaattaagtattttaaacttaaaaaatggagtaatatgattttttaaaacaactttcctataatttttttacaaaaaacgcaccgttcagtagttcgggaagcgtgcgcgtggaaaacgaaataaaactcactcacaatcacctagatcacccaggaaagaacacagtcttataatttttttacatatgaaatagctaatactcaattaatcatatactaattatactttcattttcattttacatgtgactaatcatctgttctaaaacagacctaagaatgcaccttcagagtggcttttgttagaagcatttcaacctaacacaattttgtgcaaacacaggtgaattccacccatgtcataggggcatccacaatgtactctaaaagtggtccataagcaatacaagtataatatttgattcagccacctaccaacattgtggaactagtccataggaaagaaataacaaaagctaccc

SEQ ID NO: 12382 - DNA, 1501 bp, Oryza sativa
atatttggtaaaacttgacgtgatattctattttggaacatctacaagggcaaatgacatcgccaacctctcgtcggcgcgtacgcaccgatcgaacggcgactacatcagcgtctgcgccggcgcgcgctgcgtcgtccgctccgcactgccgtggaccgctccggcttcggctgctgccagacgccgcagaagcaacaaatgtaccaagcccacaaagccacaaaggcctgagaagtacgaggctcggcctaacccttcatgtaccaagctagagagtactttaatttccggccccaaacacaaaaggcgagcctactttgtaccaagcccaagacgccagcaccatataaaggcaatcttcttgccttctgttaaaaaaaaataaaattttaaaagaatgacgccaacaccaagcccaaagcgatttcttatttactttattgaccttttagccaaagcgattttgtgtcttgcttgcaagttatacatggaatatgtggtggaaattacatagttaaaacctgaaaactaccgttggattaaaaaaagacgtatcagatttgtccacgtcattatgagtaaaacttttactcacaaatttacttgtgagagaaaattttttactcagggtgacgtggacgaatatttgacgtttatttttcgatccaaatgaaaattttcatgttttcactatatttgtggtttgcactgtatatttttccagttatacatgttatctttttctttcttcaaccaatcttatgtggtatttttagggacaacacatgagcccttataatacttgctctaaggcaatcttcttgccttgtgttaaaaaataaattttttaaaaaatgacgccaacaccaagcccaaagcgatttcttttgattttcttgaccttttagtccaaagtgatttatgtcttgcttgcaagttatacgtgccgtctttgtctatcttcaaccagggaatcgaatttctgaaattagcggccgatcaaatttcggcacatcatcgccggcgacttgacttcgaaccgaaaccttacttatttactacagcaagtcagcgctaagtgggactattttggaatatcatacgctgctcaaataagctaccatatcccgaaaacaaaaaaaagctagcatatcctgatcagcacagcagcaccactaccagcacgtcgtgtaatggtcgtgtcgtctgtccattccaggggaaatggaaggcatccagatcatttgctaatctaaaccgtgaagccaactaattaatattaatgaattccccgagataccctttcaagtttattttttataacatctcatttgaaaaatgaatataggtcaaccatcttatgatgttaccctcttatctttatctcacatgggacacgcacctgcgcccaaaactcttcgaaagattaaacaaaacagaacaatttcagacaagttcagtacgaggtttctcgttcatctggctgtttaatgatatc

SEQ ID NO: 12383 - DNA, 1501 bp, Oryza sativa
ggcccttggcggcggtggcgccggtgcgcgcgaggacggcggtggtgaagatggacggcatccgccccggcgaggtcgggttccacccggacggcccgtcgatgagcacgatgtcccacgcgacgtcgtagaggtcgttggggaggtcgttgatggcgaggcggcactcggagaagaggaggttctggatggggcggcactcggcggcgcgcgacgcccgcgccgcgtcgaggaggtcgcggaagtcgcgcaccttggtggtgtaggagacgtcgtaggcctcgagccccgggtggcgcggctccaggtacttgacgtagaactcgttctcctcgaggaagacggtgcggccgccgtggttgagcgccagccagagcggggactcggcgccgaggccgaacacgaggaggttgcaggggcccctggcgcggagcacggcggagatggcgcggatgtcggtgtcggacatgcggtgcgtggcgttggagatggaggcgaagtggaccagcgcgtcgaacaccgggagcggcagcgcggagacggcgccggtgccggagccggcgcttgcgccgccaccggaggagtccgccgccgcgcccgagcccgaggcggaggcgaagtgggaggtgttgtagacgaaggtgacgaacgtggctagcgcgaagcaggtggcgaagaggaggaggaggacgcggcggtggctcgacgacgcggccgcctgtagcttgtctcggctgccatgggatttcatccccgcgcgcgcgcgcaaggtgctcgacgctcgatcggctcgatctcacggcgattcgggtcgtggcgaggcgggggcgcgtgggctggagagaagaggtgggaatcgagcaggggacggggtggagatggagaagagaaaggtcaggtcgtctcgtgctcgtgctcgtgccgagctgggagctgagattttttttttctttctcaactggtagtgtaggctgtagactggagagaagagggttgttgctatctgtccttgcttgctttctggacttcgtcagttcaaaatctaccgcgtaacaagtgggccgtacagtaattatattttggcgggtaagaggcagtctggctcagtggtcaactgctcgttaccctactcttatggcatggtatggattatggcatgagcagtcagagctcatcaagtcagtatacggcatcaatccgacatgaatgaatgattgaatgggatccgagtgagcgagtgaatgagtgaatgaataaaatggctagggccagttttgttttctagtacagaccaaccaacataacccaatatcaaaacggaaaaggaaaacccatcatactcctaaaggaaaaaagaaaaagaaaagtagagagaaaagcatgattttatttcttatcttttcgtttatacttatacttattgataccgtttattagcaaccaaaacataatttttagatgaaacttttaaatatgcatctttagtgatttaaaaagcaaa

SEQ ID NO: 12384 - DNA, 1501 bp, Oryza sativa
gtgggttcacggccttgattaataatattgtatagctctggaatcgtgtttacaaaatagctttgagcaactaagtgtcttttaatgctgtttactgcaaaccctaaccctttatattataaccccctttactcccttgcatttatcctgcacttgtgggtgtgtcttgttgagtacgttggttgtactcagtcttgctcaatttttttcccaaacccagaagaggagcccctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatatatcaactttcggtgtaccttgcctcctgggacaaggaataatacacgcacgtaaggaacgcccgttgggttaattccggtcgtgacatccacttcatcttcttcagcaactggggggagattatttatatagagcaagggtgagtacaagagtactcagcaagtcatgggaattaagtgtttaaatgcatgcttcaaaggaagggctattgtttttgcgattgattttaattaaactcatttttgaaataactagatgagtgcttctcaaacgacacggatgagacagtgcgtctcgtccggtcggagtatgtgcaatgtgtcagggttatggataccacatacctaatagtagttgactaaatctcggcaggatccactacataccatgtcttatacagaaactgacctcgagggagttccggataaggaaagacaaccagagttctacatggaaacgacaaggactactaggattgtatccatattggtttccctagttctacttggacaaggggacacctatgggtataaatacagggccccctaggaggagaggggggacaagacaatcaacacccaacgggatcaacacccgataggatcaacacccaacacaatcaacatagaagcctacatacgccaagacacgccgccggatatcgacttcagggataagtacggctaataccctacggtgtcttcggatactgtcaggagaaacgaaagcgctatctctgatctcgccgggcacggattcgaggaggaaggctaccctgttgtcaactacgagtcagatcgtcagaccgccatgtcgacaacagttagattagctaccccaaatattgtactggtgtgattatggtgaataagagcaataccggctttggccaacaggatgtagggttattaccccacaactcgggggcccgaacctgtataaaaatccctgtctccatctcttttacctcagtctcgcgtataccctagcaccgacgatccccataccatgcaaataccagaattgcgacatcaaacgtcgacagtggcgcgccaggtagggggattttggtgcttcaggatttcgacgagatgggttcaaaaga

SEQ ID NO: 12385 - DNA, 1501 bp, Oryza sativa
acgctaggtgtcatctgggtaagggatctctgggtaaaacacttagcgatcttgtgcacctgatatcaactttgttgaagcaggggtaatgggagaatcactacatcgctggtcgaggaccaggcagtagtcgtaactcgaccacttaaagtggaagtagtgggagaaacgctacatcgctggtcgaggaccaggcagtagtcgtaactcgaccacttgaagtggaaatagtaggaaaattgttacaccgctggtcaagaacctggtgtagtctaaactcgaccactagaagtaattgtacgagagatcgctacgattgactggttgagaaccagtgagtaggtgtctcttgatcatttgaagtcgtggtgcgaggaccgctgcgttattactgtagtcgtacctcgaccatctgaggttgcggtacgagagattgctacgtactggttcgaggaccagcgaacgagtagaattatctctcgaacaccaacggaagctgcagtgcgagagattgctacgtactggttcgaggaccagcgagcgtgtagaattatttctcgaacaccaatggaggtgctagagttggtttattacatgtgcgtctcatgtggctagcatgactcacacacccaacttgtagcatatccggatgtccattcgcaatcatgtcgggtgatcaagccgacggcgttcgtgaggaattatccgttaacaaccttttctcgagtagtccagccatggccggtgctatgagataggtcgtcggtcttcgttggtaggtcggttgcgataactccgcatttgtcgagaatgttctcgataatagagtgtactcgaccacaacctactcgagtgctcaattgttcctgaaaaatattttctagaagacaagacatatagcagataatatcgagtatgtactcaaaaaactgcatggatcttctagtattattatgacataacgagtagatgtaaatgtcagggcattatgtgaaccgtaaataagcatgatttatacagaagaagacagcgagcccccagcgttagatcgtagtcgatttaacatcggggacacccgcgcaacagatattattgtataaagaacatgctctaggtaaacataataaattatagatctgacaatactgtatgatctgaataggtacgataaattgcagataaaatattgcgtacctttgtagatacatgccagatgtatttacgaaattagtagattgatttaaaaaaccaatctaccaattaccttgttgcgtactcgttcgatatcatgcgatctgacatcttttggtacgccgcaaagcttgaggcttggatgatctaaatagaccaagttgtcaatgacgatgatggttccgatctggttaggttggatctccccctcagctgaagtcgtcgagtagctcattgtcggagaatccatcttttgaacccatctcgtcgaaatcctgaagcaccaaaatccccctacctggcgcgccac

SEQ ID NO: 12386 - DNA, 1501 bp, Oryza sativa
caattatcgaaacgaggaggttgcttctgcaaacgtaacctgaaaaaaaaaatctcatattctcatttgttacgcacctaatcccgccaaataagtttgatgagaagattcagctcggtgaaatttcgctaattgcggaaacaaatcgccctgctggtcgttgcatctaatcgactgaccacaaccgtggaaagcaaccggattagttgcgaaatcaatgaatggtttgattcgtcaggcttttggactcccactgaggaaaaaaaaaggtcagtgcatgtactagaaaacaacgcatgcttttgctgcagtattcttcagcacatgtacatgttgaattcgttggaagctaaaccaccccacaagctattggttttcgggaggaaatttcttcagggtacgagcttgattagcagagctgaatcgtatacaccacgtcttggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttagttgtttcgacgtcgcatcatgctgatagacagttgttatacaaacagcgatactacggcttggttcagttcccaacttttttttcaaacttttaattttttcatcacataaaaacttttctacacacaaacttccaacttttttgttacattattttaattttagcgaacgaaacacaccctacagctcgtggaacagatcgtgtgatcgtgtcgcaaactaaactactggttagaagaagaaggccggtgtaagttgaaacttcagaccaatagcaatcagttgactgtaacaacacactgatatttcgagcgagcgagcgtgaggagaagtggtgaaattcgcctcttgttcccgtcgtccactcatctcgcgacgacatgctcgagtgcttctgttgatggaaatcgatggattcttcccagaactcacccgctgcctaattaattaaaaatctagctctgatgcttgatgattaccaccaattggtctctttgatctgatgctatttagagtccagatcacaccatgtcaccatgcagcatgattaatttgtttttgtgatcgagatgcagtcggcgagtcggttgtctggaatttggtggccgcgctttccttcagggatactccggcgccgacgtggcgtcgcctcggcgaaccaaaccccccgccgtccgccgaccagccgcatatcacatcggcgcgtcgccatcgcccgcgccgccgcgtccgcccgcggcgccgcgaagcgtcggcgccggcgcgcgaggatggcggtggcgcgacaagcgtgtgtgtacgtgggcgacgcgccgacgccgccgcccgcgcgcgcgccgtggcgtggcgtgacgtgtcgcgtgcgcaggggaaaggtacgtgggggaaagcc

SEQ ID NO: 12387 - DNA, 1501 bp, Oryza sativa
acgtgctgtgcctgtgcctgccaggtcaaaaccagagctgtcgatgtagattgtagcgtctctatctgatccaccaaagccaccacgaattctaaccaagacaacaggaggacgtactggaggagcaaccactttgcagctaattccaccctacttaatttcaaagccacgcacatataattgcatgtggtctgactactaagctgaagcattatattgagagcatacatgcacacatatcagttcatccataagttgattactccctccggttctatagtttatatcattctaaacaatgacacgtacattatgcaaaacatatcttttgggtgcgttctaaactccatttgggcaccctaaacttagtttctcgatcttcattagcatgtttttcaatctattaaatggcatgttacgtgtgaaaactttttatctagaaattgctttcagaaaacaaataaatctattttttaagtttttactcaattaatcatatactaatcatgtttcttgtttacgtgcgactaatcatccgtctgaaaactcactttagaacacaccctttgaatataattttataatataaatataataaataaataaataatcaattttattaaagtgctttcgaagactaatatgtatacgttgttctagtgcctttaaactatatttttggacattactgatagtcaaccttaatgttcaaaatgataagaattatataactagagggaatttattttaacgcttctattcacatattgattttgttttgcctatagaagtactctcttcgttcataaataagttcatttttagattatactgtttgttccaaaataaggttatccacaaataaaaaaaatattacttcaatacccttacatactcaatcatcaatactattttctccatcaatgaagagtattttggtcgtttttgctctatcttaatttgtacttcaaggattaaatatgaactttacaacggaggaagtaggcatcaggaaccagcacttcctcaaattctgtttttacttgatgtgtcggcgtgctaggtacgaacatgtgaatgaattattcaagactgcaagtactactacacccttgacatgttgtacgtcgcgttccagagatacgtacgggtcgataacggatagagaccgattgatagcagagtgcggctagctttggattctttcccttaaaaagcgaacaacattaactccatcctattccacgggccaagtacaccgtctgtctcaagataaatttatttgtcggtttctatgtttaatatttagtcgcccattttatttaaatttttttatgatcaatatttttttatcattagatgataaatatgaataatattttatgtgtgattttgtttataattttttaaataagatgaacagtcaaatgttgaacgcataaacccacaaataagagatggagtaggaccaagattggataagccagctacaggtggatgg

SEQ ID NO: 12388 - DNA, 1501 bp, Oryza sativa
cttcagataaacttatgtatctacgttttccttcttccatcggtctacctcttcttttcttcatggccacttttgtagtctccggtaaggaacgattgtatgccgaaagcttctaaaccctggagcgatgagcatgttgcaatggcaacgtagtatagaatgggtgttctcatagcagcttggcacaatccaaccgatgtcaacatagatgagctcgcagtggttaatactacgggtccttcgaatcacaagaataaaaaaacagaaaaatagaaaaaaaatctaagaatctgacaggaatataagtgtaaagtagataattgcaaaccacagaaatctaataagagagatatattaaaatgaaaatttttcaaaatgttggagctctttctaagtttatttcaaattctataggcaatgaaccattccatacgaatttcataggatttggaaaaccccattcctttgtatctaaggagcaaaaaagaaaatttattgaatcctataaaattcaaagataccctacatggactagggacgaaaacagtcgaaaacgatatcattttcttgaaacgacattggtacggtcaggaaagtgagttgacacaaacaaattctatccaaatagcatgtctctaaatactaggtgttctaacagagggaaaatgatctaatagtataatgtggattgttttataaaattagtgacataccaatattactatactatgtagtaaaggccaaacttagacaaaaagtcatatttatattttatataacaaacattttattagataaatgaaattgtaccatacttctattgtgtgtaccatatccacatatttatttattgaaccgatgtacaggagtatactttgtgttaaaaaaatccaattttaaagattaatctagacacgtattgttagaatttgattttctttttatagagggagtaaggtttaaggggactgcctcattcatcttttttttttaacaaatgactgttgactgcccctatcgtgataaacatccatgagaaggacttaattaactacggtgcactgttgggataaaatccatggatcggccgacgcgcgcttttgaccgagggcagccgacaaataacgttcaaaggagggtccggtaaagaggagggcatccccagcaggaattctgatgaaaatccccattccccaaaggctgccatcccctgacacctccctccgatcatcccagcctccatgtccctcccctgtccccccccccccccccccttcttcctctttggttgcgtcttgcgtcgcccaacccaatccacccctaaagattaatttagagttaacataaagcttaatttagggcatgtttagatacactggtaaaattttcaccctatcacatcaaatatctggacgcatgtattgagcattaaatataaatgaaaaaaataactaattatatagtttgcgtgtaaattacgagacaaatcttttaagcctaa

SEQ ID NO: 12389 - DNA, 1501 bp, Oryza sativa
aatccttgaagtacaaattaagatagagcaaaaacgaccaaaatactcttcattgatggagaaaatagtattgatgattgagtatgtaagggtattgaagtaatattttttttatttgtggataaccttattttggaacaaacagtataatctaaaaatgaacttatttatgaacgaagagagtacttctataggcaaaacaaaatcaatatgtgaatagaagcgttaaaataaattccctctagttatataattcttatcattttgaacattaaggttgactatcagtaatgtccaaaaatatagtttaaaggcactagaacaacgtatacatattagtcttcgaaagcactttaataaaattgattatttatttatttattatatttatattataaaattatattcaaagggtgtgttctaaagtgagttttcagacggatgattagtcgcacgtaaacaagaaacatgattagtatatgattaattgagtaaaaacttaaaaaatagatttatttgttttctgaaagcaatttctagataaaaagttttcacacgtaacatgccatttaatagattgaaaaacatgctaatgaagatcgagaaactaagtttagggtgcccaaatggagtttagaacgcacccaaaagatatgttttgcataatgtacgtgtcattgtttagaatgatataaactatagaaccggagggagtaatcaacttatggatgaactgatatgtgtgcatgtatgctctcaatataatgcttcagcttagtagtcagaccacatgcaattatatgtgcgtggctttgaaattaagtagggtggaattagctgcaaagtggttgctcctccagtacgtcctcctgttgtcttggttagaattcgtggtggctttggtggatcagatagagacgctacaatctacatcgacagctctggttttgacctggcaggcacaggcacagcacgtatggacggagacggaatatggtatggtatcatccatgcgcatccccttcggagaagaaattggttgctgagccctatttcttttccaacaaacggaatgatagctgaatacttcgtgtttcttttttttaaaaaaaacattcttatatataacacttttaaaaaaactattttaattttattttttaactataatatttaatttattcggttgtacccttaaataattatcgtaagtcgctcagctatttagctacctagccaaacaccctaaactttacacaagaatctgtatttccatgtcatagcaatatagcatacacagcatccgtgagaccatgatacgctcgttaattgctgcacttgtcaatcaccccaccaggcttgctagctagcagagcagatgaaaccaggtttgcccatccgctgatcgaattgaaggcagcagatcaaacctcttgggatgcagatccaagatgaataaacaagatgcgtgcactgactgaaattttcagccattatctac

SEQ ID NO: 12390 - DNA, 1501 bp, Oryza sativa
gattccaaaatcaagagatggtgacactaaacgtaataaatcctgtcaagtggctaatgaatttaggtcacacactcaacatctcatcctaatctctacgttgactcaattaatcatccttttatttgaaagaagttgtattaatttgatgcgatatgaatcgacgtaatgcaaccgtagcacagagatgttcctttaatgccttcttttttgcttatcttgaatatagttgacataaaaattattctccagaaccaaaatagaaggttcggtttgacagtaacatgaacctgaaaaactattgggcatcatcttttgagatggaccaaagccgatagaaattgaccaagaaacttagcgtataaattaagcgtaatattaccaaacgataacagtaaagccggtgtaattttgcgtacatgtagctgattttacactattttcacctataattttcttggtcaaattctgacttattttcatttaaaaaaatttaaacctctccgtttataaacattataaacatataacatctttggagtgtaaagagcttaggatgaagccaatgctcatctttatttacattttacatcttgtcctaacttacttgtacaaaagaatagactggtactatactcgtacttaattgatgtgtaaatataaagattaaactagccacccataattttgacaaatttgatggtaagattgattacacatcgtcctagcttgtacacaagaacagactagtaatatactcatacttaaatgatgttttaaaaaattaaagattaaactaggcctccaacaatttgggctctattaaatttgatggtactaacattgatgagtacctaatactgatgtaggagtaatacacaattcagatctagcttctctttggcacaagccaaaccaagcattgaagcaaccatttctcctccaaaatccccgccaaatttgcagcaagaaacttcactgattctttcctgtttttttttggaacctgaaaagttcagtgattctctcttcctctctcttgctgcacactgacagacacacacaccaaacactttatgtatgtatgtttatcatacataatccaagccactacctctctctctctttctctctctctctctgtcacaatctatgcctttgtccattgctctctgattaattaattcttcaccaagaaatcaattaccttttttttttctcttttctcctcgtttttgccgttcatcttgggtcttgtcgtcgtataaaaggcaccaattcttgtcagtaatcagacaggaagggaggagcttagcagcagtcgttgtgcagaggagagtctcctttgcttcccaagttgccatccatggccgccaaggtgtacaagccggccgccgaggtcaatctcggcccggacagcgacgagttctacatcagccctaacgtcaaaggttcgatcctcccttgcatccagctagttcttgattctggagttcggttc

SEQ ID NO: 12391 - DNA, 1501 bp, Oryza sativa
acgaaagctcagaacgcaactaacacactaagtaccagttgctgatgttctgctactactagttgagatgatgaaaaaaaagagcatttctttttgggtgaaactcctcaatagttctcgctgaaacctagtagtaacagttttgcatgcaagatcattgccagaatcaaaaggagtttttttttctctgaaaaaaagagcaaacttttgaggagaatttgagcagtgttgcaccttgttgatgagattatccttcttgaggatgtaaagcaccattgagccgatgatcggcatctcaagaatccacacgaagatcttcaccagcagccctgctacccgaggagctgaagaacaagaagaagaaaccaaaaaaagaagaaaattcagactcaacttcaagaacagagaattcagaatttccaagaaccgaactccagaatcaagaactagctggatgcaagggaggatcgaacctttgacgttagggctgatgtagaactcgtcgctgtccgggccgagattgacctcggcggccggcttgtacaccttggcggccatggatggcaacttgggaagcaaaggagactctcctctgcacaacgactgctgctaagctcctcccttcctgtctgattactgacaagaattggtgccttttatacgacgacaagacccaagatgaacggcaaaaacgaggagaaaagagaaaaaaaaaaggtaattgatttcttggtgaagaattaattaatcagagagcaatggacaaaggcatagattgtgacagagagagagagagaaagagagagagaggtagtggcttggattatgtatgataaacatacatacataaagtgtttggtgtgtgtgtctgtcagtgtgcagcaagagagaggaagagagaatcactgaacttttcaggttccaaaaaaaaacaggaaagaatcagtgaagtttcttgctgcaaatttggcggggattttggaggagaaatggttgcttcaatgcttggtttggcttgtgccaaagagaagctagatctgaattgtgtattactcctacatcagtattaggtactcatcaatgttagtaccatcaaatttaatagagcccaaattgttggaggcctagtttaatctttaattttttaaaacatcatttaagtatgagtatattactagtctgttcttgtgtacaagctaggacgatgtgtaatcaatcttaccatcaaatttgtcaaaattatgggtggctagtttaatctttatatttacacatcaattaagtacgagtatagtaccagtctattcttttgtacaagtaagttaggacaagatgtaaaatgtaaataaagatgagcattggcttcatcctaagctctttacactccaaagatgttatatgtttataatgtttataaacggagaggtttaaatttttttaaatgaaaataagtcagaatttgaccaagaaaattataggtgaaaatagtgtaaaatcagct

SEQ ID NO: 12392 - DNA, 1501 bp, Oryza sativa
ttatctttatagtgtgatatgtacagatatattatttaaaaatttaagagtatcctcgtaacttcgttctatcttgctacctacatttgcacatgtcattacttgacttataccatatcaggcatcccctatcatcaaaatatctcactgaagttatctgacatatggcatatccctttgattttctccccaagagataaggactctccaaatatgccacataattggtagggatgaaatggatgggatgaggatggatgatgaatattataccatatttttaagtggattttaactttgcaaatatggaatgaattacttcagactttgaaaacactaaggagtccgagtggactcaacttagaaatggaccaatacgcacatatgtataaagtatgagagtggtaacaagcagcaacctaacgtcaaacaaggtagttagttagactcacgggctcgcaaaaagtctatgagatagaagcgacaaatagaacactagatatactatagaagcgacaaactaaatagtggatatgctatgatggtgtatgatccaaccaatggtatatcaaaagttttggattaacttggtcggataatctgcatccgacaaaatgaataccacaacctaatcttcatccgtacgttactatctattggatcttaatttaaaagttaaaaaggcattaccgaaattctcatttgactactcttgtctgaatctaaaatggattgaaccggaacattttcatgccatcagagataaacttattcaatgtacgttacgtacacagtagttccgcatacatataaagtacaacggtacggtggtaacaagcaacaacctgacataaagcaagggtccaattagactcctagattcgtgagaagcctattgaatagaaatgataaatggaacactggatatactatagaagtgacaaatgaaacaataatatatgctatgatggtgcatgatccagtctataatataaagaaaacttggattaacttggtcgaataatccgcatccgacaaaatgaatatcgtgaccaaattttcatccttccgttactatctgcggatctttaaaaaaccgttaccaggtcctcattcggtcactcgtccgaatccgagacagaattaatcaaaaactatccatttcatttcatttcctacatatgggcacgtaaacttattcgatatacattccatgcatggaagtatcacatacatataaactacaatggtggcaaacaaacgacaaccaagcatcaaacaagggatccaattttacttctagacacacgggaagtctataggatagaaacgacaataccgaatatactgtagaaacgacaaatggaacactaatatgctaatgatggtacatgaatcgaatctatgaaagctagaaaacttggattaacttggtcggataatccacatccgacaaaatgaataccgtgaccgaatcttcattcgtccgttacaatccgtc

SEQ ID NO: 12393 - DNA, 1501 bp, Oryza sativa
tttttcctaacaaatattttgaagaaaaccccaatggtgagagctatgactagcgctttttatttgttcaccaataataattttcctaacaaacgtttagttggtggattgattcctatatctttttgtcaactgctaaccatatacataaatatatcaggcatacatgtatgaagtttttattgaaaaataattccactagtcagcgtagcatttcccggtatatttgttttgttgccactttcaactttatcaatttttaataggacaataaaccaaatcatctcttactataaaattgtaacccactaactactaaaacttaacatgcaaaaatgtcacatcatcatccactaacaatcattaaatttaaacaacatgcaaacatgttatattatctataattttataaattattaaattttcgagctttcaaaaatgtaagcatgttaaatcatcatcgcacataattcacataatattttaatatatatttattatttttttataatatgctatatacatatatagttcatcatcacttaattaatatttatttctctcttctctcattaagccatatcacatcaattttttttaagtgcttaaatgaataatctatggtccaaattatctctctcattttcttctctcattaatccatatcaccttaattatttttagcctttagataattaatctacggtccaaactatcccaatacttttcttctttcataaagtcatatcaccatacttttacatttaaatcatcattctatatactattcaaatttaaattatcataaaccacgttaacttacgtaatcttatattatctagaaatcctacacattatttttatttattgttaccatactaaagtcccgcagcaacgcgcggggtttcacctagtatactataaccatcattaccaaactaaatcaaacgtattccaaccattgttaacatacaaaattttggtagttttgagatctcccaccctttaaatcacatcaaaatctgttcgaaccaaatatatctcctcatagtcaaaagagtaaaatacagtagcggtccttaaacttgtcatgaggtttcacttaggtccacgaacttgcaaaacgcacatcaaggcctctaaacttggtttattgtatcatcccggtccaaaatctagtttgaccatggtctaacctacgtggcatgccacgtgtgcgtgtgccacgtgcacgatgagatgggattagtgagaggggcagggtgggtgccgcagctcctgcacgccactaccgtcactcccttcttgcgctgccgccgctccctccgtgtgccaacgccgccgtcgctgccccctccgtgcgccgccgtcgctcccactgcctgctgccccctccctccctctgcgcatcagcgccgctgtcagaatccagacagcattcagaggcttcctggtaagcaatgggtgctcgtgttctagctctgcttcgatggagtaatca

SEQ ID NO: 12394 - DNA, 1501 bp, Oryza sativa
gtaacaagaacaagctagcatgatgaactacgagtaacaatttgtttcaggaataacacacaaccaaacactgtatcgaaaattattaacttttaagcatgagtcaccagccttcctctcctagtacacatgacaaacactatagccagcacagtaaacggaaataagacgaacacttcgatctctacacataccctttgcccgggagtggctgccgccccgcgccgcgtccttcctcctcggcggccgcggccgccgcggcctcgatctcggcctccttgcgcgcctcctcgacgcgctcctcgatctccccctccgtgtacccctgctcctcgagcgcgtccctcagcaggagcagccgcagctccacctgccgcttccggtcgtgctccaggatctccttgttcggcttccgcatcccgccgaggcccccgccggcgtcgtcgaaccccggggccggcgccgccctcgggggcccgcccgccgacgacgaccgcggcttgatgaagaacttgttggtctgcacgtacccattcgtgcccgacccccgcgcggtctggagaccgatgccgttgtacatggcggcggcggcggtggggagcggccggggaggtggtggtggtggtgcggcgaaaccctagctagggtttcgatcggtttggttcgtcgcgactcgcgagatccccaattcgggagggagacgggatgagaggggaggaggaggaggaggcgagcgtgatcttattcggcggctgcttcgtgggctggagaataatttgagtcggtttcgtggggaataagatcacttcgactccctcaactgaccaccgaatctaaatcgtatccctcaaccacaataccagaaatcttgaccctccgaacttacaaaaccggtgtaatttgacttccttggtggttttggatggttgtttcgctgacgtagcgcacacgtggcagtgttgacttggtctttgttccacgtggcattgacgtggcgcatatgtggcattaaaataaaaaaaatatatgcgggacccatttatcattcacacaaaaaaagaattgtgggacccactgacatgtgtgtcccacatgtcaccctctcctatcccttcttcctcctccccctcctcccttctctatctctccctctttctcttcgtgcgtggggagcggcggcggcggcgacggcgacggcaggcaatggacggagcggcagccgacagtcttcgcgcctcctctatcgccgccgttgcagcagcagtagggattcggggatggtggcggggcgagggcatggcggcgagggcaccttgagcgcccgctcagcgagggcatggcggtgagagcacaacagcgacgagcaggatgattccgacgatgatggcgcggggcggccacggcggggagggagcaagtcgggcgcggtggcacgaaggaatgtgcgcagcgggggacaccgagcgcaccgaggaggaggtggaggagcgcgaaaacgctg

SEQ ID NO: 12395 - DNA, 1501 bp, Oryza sativa
caatctccgggatctcctctaccttttctcctttggaatctttggctaaatcgttttggaagttcgtggaatcgagttcgtttcggatcggtttccctctctccaagccgagctttccttcgccgttgccgccgccttgggccttcgccgccgcctctgagcccctttaaaaggacccccggtgtctcctctacccgttgccaccttcgccttcgcctctcgtcgtcggaaaagccctagcgccgtgtgccctagctttgccgtcgccgccgccgctccagccgtgcgccgccgtcgttttagccgtcgccgtcgctcgggaagaccaccgtcgtgctcgccaagtcgtcgccgtcctcgtccgccccttcgccgtcgccggagatcgtcggagcttcgtcgccatcgtcaagccgaagagcttcgccgcttcctcctcgtcgccgtcgccgtccgttgaccttccgcagaccgcccccttcttcctcttggatttgccaccggccgcgcccgcagcggcctcgtggaggcttgggaagttggcggcaggagcagggggctcggtggccgccggggcggcagcgttttcgcgctcctccacctcctcctcggtgcgctcggtgtcccccgctgcgcacattccttcgtgccaccgcgcccgacttgctccctccccgccgtggccgccccgcgccatcatcgtcggaatcatcctgctcgtcgctgttgtgctctcaccgccatgccctcgctgagcgggcgctcaaggtgccctcgccgccatgccctcgccccgccaccatccccgaatccctactgctgctgcaacggcggcgatagaggaggcgcgaagactgtcggctgccgctccgtccattgcctgccgtcgccgtcgccgccgccgccgctccccacgcacgaagagaaagagggagagatagagaagggaggagggggaggaggaagaagggataggagagggtgacatgtgggacacacatgtcagtgggtcccacaattctttttttgtgtgaatgataaatgggtcccgcatatattttttttattttaatgccacatatgcgccacgtcaatgccacgtggaacaaagaccaagtcaacactgccacgtgtgcgctacgtcagcgaaacaaccatccaaaaccaccaaggaagtcaaattacaccggttttgtaagttcggagggtcaagatttctggtattgtggttgagggatacgatttagattcggtggtcagttgagggagtcgaagtgatcttattccccacgaaaccgactcaaattattctccagcccacgaagcagccgccgaataagatcacgctcgcctcctcctcctcctcccctctcatcccgtctccctcccgaattggggatctcgcgagtcgcgacgaaccaaaccgatcgaaaccctagctagggtttcgccgcaccaccaccaccacctccccggccgctccccaccgccgccgccgcca

SEQ ID NO: 12396 - DNA, 1501 bp, Oryza sativa
aagtgttttgccggaagatggaagtgttttaccggaagagtctgaggatgtttcagacggtggaggagttttgtgtcttccaatatttgagcattaagaaatagtttgagcaattgtttcaactgatttccccacgcctcccatccctatgctaccctcgccacggcagtgagttgtgaaaccactgcctccccttgatgtgttgttctcagttgctcactcagtatatgttatatactagttgggtgcccgtgcgttgcaacggcgaaaaatatatgcattaaagcatctcgcctattatgactggcaaatgaagaggatagaatgtggctaatgttcctctaaacaaaggaatatggttaatgtatcagactatcaggtatacttgaaaagaatttctctaaccattaggcattggcacagaagaatacggtttcattttctaagatcacaagttctgaatattaccctctcaggtgatacatagttagttgatgttttcctcaaaacaaaattggttggtgcttcgggaagcagtcacggacatcacacacatgagtaaatttatcaagggtcatgcacttgataaatcaaaattggagtgtgacctttttggggtctgctgataataatcttctggtacatgctaaatttcaagttatatgccttgaacaaactatatatatatacaaaactgaaaatcatcttaaaggattacaactgaatttacatggaatctaatccattaaagacataaatgaatctgagtaattctctggacagtacactgtgtgttcatagtaatctttaaaagcttatagaatcctcagtacatcgagttgcaattttgcatagataaatacaattctctaagaaacaggaatgaataataagaaatgtcagtggtagcatattaggcaactgtggaggcacaaatggacgcgccaagaaaatgtagaaatgtgctatcaattgcaacttagtgaacaaatcttggagaagaacaatatagtttattagttcagacaaaaatgagagttttaacttctatactgagaaatggaattttatacaaaaccatatgcctttgaagcatgaaaaaaggggtcactcctatgatcaccaggaaaaaggcaacatcaaatgagattgtaattttatagtgatcaatagaattttagtactgacctgattatttgacagagtctgattatttgacagagtctctgttcacaattcaaattaatctgctttagtcactactcatattggaacactattccatgtatataccttgagacaaattccaggcctgctgatcgattatgaattgactagcacatttggactgcagtgaaaacagaagaaaaatgatatctaagttgctatcaattgcaacttagtgaacaaatcttggagaagaacaatatagtttattagttcagacaaaaatgagagttttaacttctatactgagaaatggaattttatacaaaaccat

SEQ ID NO: 12397 - DNA, 1501 bp, Oryza sativa
gcaggttctgcttgaattcgctttcaaaaatgcatgggaaagtgtactcatctctcgttatgtacatcctatctaaatagttacagaaaatttaaaataaatttaaaataaagattaatatcaaatatatcactccataatatgcaagttaaaatttaacttttaaaagttgtagaaaaataacaacgaatgtatgataactattttcacagtttagtttgtttctttgttgtaacttatagaagtcgaatttagtcttgcatgtttgtaaaatgatatattttatattaatctatattatcaaaactttttaaaattttttataactattttggtgatgatatgcaagcaacgagaaaacattcactcgaggatgaaaatccgatatcaccgatgtgcatcagtggtagggaccggagttttacagccatcaatctgttcctatcgtttgattcgtttctccctcagtcttgtattgtatgcgtaaatagatcaggagttttggtgcaatcttttaccttaattgggaggctagctttggtttttgaaacaaactgggggtggggggtcgttactgtagctgttttaggctttaatcagtataatataacaagattatataggatgataaatgtaagaattaagaaaccacgcggtcgtactggactcgagctcgtactatactttcggttagtataagtactcctattattaacggtttggtattcttccgaattcgaactgtaatcttagcagctatacagtctacggagtacggacatgacacgagacaatattacccctcccgtctaattgtatccgaaacagtaatctaattatctaatctgaactccgggtagttcagtactattcaaaacaattttgctaacgtatttgtctacacaaattttatattgtagttgcatgtaatattgtatatttatcaaagtcccattcaaaatctgaagggaaatctgaatctggacatggcaaaggcgttgacctcaccacagaccagccccccatcgacgcgacgaccgcccgatcggaaaccgacagtccagatccaacccgtgcccgcccgcctcgacatgcgcgtccgatttatcccctttttttttttcaattttccccaactcgatcgacgcggaccggaccggaccagataccccaaccccgacgcggacagacacgaccaaccaacgcaccccacccaacccaacccgagagacggtccgaccgaccgtacgacgtgccgggcccgggctcccaaaccgggtccctgtcgggctcgctccgaaccctatccacctccggcttccccccacctatatccttccctccccctcgcggcgtcgagcaaagccaaaaactactactcctctcgaggcgacgacgaagaggagaggagaaatctagcggcggaagcagcagctgcgagaggcggatttttcgattcggttcgaggcgaggcggagcggaggaggaggattcgaggcga

SEQ ID NO: 12398 - DNA, 1501 bp, Oryza sativa
cgccaccgccgaggacgcggcgcgcgcctacgacgccgcggcgctccgcttccgcggggggcgcgccaggctcaacttccccgaggacgccgccgcggccgacgagcgacgcgccacggacgccgcggccgccgcggcggcggcgtcgtcggcgcccgccgcgctgctggagtcgcagccgggcgacgtcgcggactgcctcgactactccaggatcctggcgggggcgccggagcggccgacgagctccaccgtcccggacgggttcttcggcggcggcgggaacggccgcttcttgcactcgtggagcattggcacgtcgccgtcgccgtcgggctcgggctcgggcggagccggcggtggcggtggcggtggcggtggcggcgcccctgttcgtcctctgtttcatggcggtaacggctgggagcaacgcggtgacagtgcatacaacggtttctagacgcctcgggaatcgggattagcgatatttgaagaagaaaagcaaaggattcgagaattagcatattcttttatcatggtactgagaattaggctatttttttaggtactcatagtatattcgagaattagcctattcttttatggtactccgtagtgtagtagtagtggagtagtagtaattagcagtagtagcagaataactttgttagattgtttcccgaaaaatcattgtatgttccaaaaactcatttaaagtaaggcaagcgattatttatgtagatagatacatgatgtaaactcaaagcaattttggttgtagtgatttgcgatacaaggagcccccgaatggggggcagagcaaaaataaaaaaaattgctagcgtatgtgtcatgcgctgttttttgctcaattgttgagcgaagagccgaggacaagcaacacagcaatgtccacaagtcggccttcataatccatgggttttgtttgatatgcttacgtgtgacatacgcacactaccatcagcatacacgtccgtgtgtgcgaggtgtgccttcgatcgagcacgtcaacagcgtagcaggatagatatgtaagaagaggtgaaatcctttcgatctccggtgtgggactaaaaaaaattgacggcgctaaagtaaacaacgtgcacctctgtgtctagtgttagaataattgggctagacttaatttatcctattaaatctcagacccataataagtgttaaggataataataccacctcaggatttaagcaagaaatatcttaacctaaatagggagttattggaggctcccagttgactggttgaggtgggggtcggaaagccacgcgcgcgcgccgggtcgggcgagggcgtgacgggcgtgcgtcacgtcgctattcttttgcgtccacgatcccacgttcccacgactgcctctgcaatggcgcgtccacgatcccacgttcccaggaggccgctagataaggaggccgcaagtccgatcagattcctcctccgcaacggcgcgtccacgat

SEQ ID NO: 12399 - DNA, 1501 bp, Oryza sativa; identical to SEQ ID NO: 12398

SEQ ID NO: 12400 - DNA, 1501 bp, Oryza sativa
tacactttaaatatacaaactactcctacacaagtatgttacacaactatgtacatacaaatacgttgtttttactaaaaaatcagctagctatgcacatacaaatatgctatgaagcgaactgcgcatggtttcgtttgttagggtcctcaactcatgtggaaatgtgtggcagtcatagtaaaaaaaccgggctgggccggcagttgaaccgggaaaatcggaaccggcgaccttggtggctcggttcaacaaaaagaccgcccctgcaatcaaacctgtaaaaaacagtgaaccaggcggtttttattaaaaccgatgaactggtagaggttttttaaaaatcgaaccgatttttaatttgtcctaacaatatagcattatgaatctattatgttaccacactacatttgtttttttatgttgtggccatataataatagaaatactagtttatttatgcatattttcaccattttgtgatgattctatatttaaaataatgcaaatcaaatataatattaataaaataaaaaaccggcggtttgaccgatgaacatgtgaaccgatgaccagatcggggcgacctttggtccgtttttttactatggtggcagtgagtatggtgtgtatgtatccgacttgtattttatgaaaaataataagttctgtaagaaacaaaagttatgaagcaacctcctaatttgaaaagggtaaataaattgtatgcacataaatatacaatgcattcacagatcatagagatacgatcattaatcgattcagtggcaaatataccaaaaaaaatccctacctacagaactttgcatatggataatgcattgtaggtgctagtccagatataccatatttatgaatgcactaattggttaacccgcaaatactacataccctgttttttttttctttttactctttgatgagagaaattgagaacattaatacagttttcgaatttcgatctacatatctgatcattgtttttcaatcacacaatttcaaaaagaacatgcttttataaatctataatttccgaggacaaggtagccgtggtaacaacgacaaaccatgaaaatcaaaataaaaaatattaaaaaaaatcatttttttgaaattttgtttaaatttggtgagattacagcccgggcaccgttactgcacccggggtaaccggcaagctcggtattatgaaccctcaatcctcagtaattctgtattaattaattatgatttttttggcgaaatgatgagtcaagattattatttggagaaatgatgaatcagaattttaaatacattaaaaatgctgattcatcgttgcgcaaaaacaaatcaggtaactaattacccgcattgtattttgtatgtcaaatcctaaagatttacaaaagaattaattaccagatcattttaaaataagcagcgacatgacagtgataccaaacaaaatccactcccgcttccgacacatcgccaacca

SEQ ID NO: 12401 - DNA, 520 bp, Oryza sativa
aaactgacatgtgggtcccacgagctttatattttttcggatcgaattgccacgtaagcgccacgtcaatgccacgtcagatcgagaccaagtcaaactagccacgtaggtgccacgtcagccaaaacagcctttaaaaccgccgagggacctaatctgcaccggttttgatagttgagggacctgttgtatctagttttgcggttgaaggacgaaaatcggattcgttgacaagttaagagaccttagatgaacttattccttctcttggccctcacgataatgggccgatttggcaggccctgctggcatggtacaatctctgggcctggcccattttcagagtcagacggcccatctgggctgtcgtttttctacttggacccctgaagaaatcattttttaacctttgcaacctacaacctcctcacatctcaactgaattagtaatagtagatctctcgccgtcgccgcctccgcctccgccgccggaatccccagcaacaacccgccgccgcga

SEQ ID NO: 12402 - DNA, 944 bp, Oryza sativa
gcagccacagctgcagtagcaatagctgtcgaatatggccaatatatatgaagtagtttttaagccgtttttacgataagttataaaaagccgtcgacaatcggtcaaaaaatatctaccagagcaaagtgcaactctcagcgacagagggagcagtgcatcgctgtcggcatgaacactcaattctgaccatgcatgtcgatgccatatcaccattgatgatgatcatggcaaacgcagcaatggccggccagcattcattgacgccttccagcgttatcttcagtgttctacaacagccaacacagttactactatacatgccaagacacttaggcatcgttcgtttaggggtgataggggagattggctctcgttttccgcgcgcacgcttttcaaactactaaacggtgcgtttttttgcaaaaaatttctataggaaagttgctttaaaaaatcatattaatccatttttaaaatttaaaatagttaatactcaattaatcatgagctaatggctcacctcgttttgcgtatcttcccaatctcctcaatccccttctcctcaaacactccctgtcttcaatgaggccctgccagatagcctagcaactgaaaattttcaagtagcaagtcgctgtagacgcgcagggttttttccagggcaatacccatatgcgttaggccatgttacgtgttattctattcatcccaaaataaattattagcgccgtcccaaaataaatcattagcgtggctgtaatcgataggcatattctatattcgaaaggttgagtttcgggtcacgatttcagctaccatggtaaataggtttatcacagggatacgagaacaataaggctttctaaatggtaaccctacgtccctactaccaaaaaaaaatttttttggtaaatttttgttcaatcctttacattttacca

SEQ ID NO: 12403 - DNA, 1501 bp, Oryza sativa
ctgcatccaaaggagcccttagggataaagctagctcccactagagctagtgtttgaggggaattaactatttgccacttatccaaatggtatttttagatttgccttttttttttgcccttttaaggtgatggcttcttaacaattttaccacttttgtttacgtggcgtgccaacgtggcttgcaaccttaaaaagcagagcgggacccacaaatcagcctctcccctagctttatcttccttctcgttcatcctccagcttgccgacagggaggagctcgctcccaatccggcatccctccctgcctccctccgagcccagcaccggcgagctccctacccccctccaagcctggtgccaacaagctcccttcctccctccaagcctggctccggcgcgtcggaccagttgtgcaagtctacgaagatcgggaccgtcgggttcgtggctcatcgcgcggcggcccttggggcatgctgccatgaggttgcagagcgcggcgagcacgtggtccaccgccataggcgatggagaggttcgacggcgacaagcgacggcgctggcccgatggatagcaggtgtgacgcgcccgctggcgcgatggagaggttcaggagcgtgcgcagcggcgcagggcgtcgtgccgcgcttgctccgtcggcacggcctcgcccaccggagctacgcacgggtggccctccccttagcggcatatctcctcggtggcgggcgtgtggaggtgggcggccgtcctctcagcggcggtgccggagctcggggacaccgggcatggagcgggcttgtccccattggcaagctggaggatgagtgaggaggaagatgaagtgaaggggagagactggcttgtgggtcccactctgctttttaggttacaagtcacgttggcacgccacgtaggtaaaaatggcaaattgttaagaactcatcatcttataagggcaagaaaataagagcaaatttaagaggggtatttggataaatggcaaatgcaatagtgacaaatagttaaattcccaagagtttgaagctagaatttgagttcgagcccttccaaacatgctactccttccatcccaaaataagtgcagttttagcactgttcatgttcaacatttgaccgttcgtcttatttgaaaaacaattatgattagtatttttattattgttagatgataatacatgaatagtactttatgtgactaatatttttaattttttataaattttttaaataagacagatggtcaaaacgctggagacgaatatctatagctgcacttattttgggactggagatagtaggagctatctgaaggagactacgtcgagacagagacaaaacgattacgtaaagcttgatttccgccttcaggggtttctgaacgagagagagacagacggcggcgggcggcggcggcggcggcgagggagccgaagcctgagaggatggtgtttggccggagcaagtcgtcctcgt

SEQ ID NO: 12404 - DNA, 1501 bp, Oryza sativa
gtcaccctcgctgcgctgcggcttctcccgggtttagcttcccgaccacaccaccagagaagaagaagaagaagaatcgcctcgctttgctcgtgtaccgcctgggccgaggaatctgaggcccattcatatatatagccaaggtggaccaaggccagtagccgctgggctggctctactcggcccatttacaatttgttggaaataagttcacctgaggtcccttaacttgtcgaccaatccaatttttgtgctccaaccggaaaaccagatagaacgtgtccctcaattgtcaaaaccagtgcacatgaggtccctcggcagattggatggtagttttggctgacgtggcacctacgtggctaatttgactctgtcttcatctaacgtgtcattgacgtggcaattcgatctaagaaaaataataaaccccgtgggacccacatgcagtttcgcacacaaattaataatattatgtagagagaccgagagaggaggaagaagaggagggctgagaataattatgtgggctggcccacatgggtcccactatttttttattaatttgtgtgaaactggcatgtggatcccacgaggtttattatttttcttagatcgaattgtcatgtaaacgccacgtcagatgaagaccgaatcaaattagccacatagacgccacgtcaaccaaaactgtcgtgcaaaccatcgagggaccttatctagttatcggcactgattttgacaattgagaaacctgttgtatctggttttctggttggaggacgaaaatcgaattcattaacaagttaaggggcctcaagtgtacttattcctatattgtttgttctctctcaattacacgaaagatgtgcacgccacatatacactctcctttttttagaaagatagtacaaatgcagacacatataacgcgtgtgcactcacctactatgagtacacacatactttatctctatgagcacctattgtaaaatcaaagtgtatttgattcttattttgtgatgaataattggcatatgagattattgattttgatatttggagattattggcgaagtggttttggagattattgaatttgcaggtgatgaacaggtgctgctggatgtttggtccagtcagacctggcaggtgctgccggtcagactgaagctatgcatgcggttaaaccggccagccagtggtctgaccgaccgactctgtgtcggtttcggtttcgggttgtttcattggatatccgtggattatatgtgtttatgacttctagatggatactatgcgtatgtaatactgttgtttgctaacaatgagtcaagttggagatagcttgttcttggaatatggtttcttagttgattcatgtgtaggtaatcttgacgcctcgggagagtgttgccggtgatggatcgggagtcaacttggagataaggtgatgtccggatgatcagatatcatgcgagatacttaggctaaagatcaa

SEQ ID NO: 12405 - DNA, 1501 bp, Oryza sativa
gtctctcgatcatttgcagtcgtggtgcgaggaccgctgcgttattgctgtagtcgtacctcgaccatttgaggttgtggtgcgagggattgctacgtactagctcgaggaccagcgaacgagtagaattatctctcgaacaccaatggaggttgcggtgcaagagagtgctacatactggttcgaggaccagcgaacgtgtagaattatctctcgaacaccaatggaggttgcggtgcgagagattgctatgtactggttcgaggaccagcgaatgtgtagaattatctctcgaacaccaatggaggtgctagagttggtttattacatgtgcgtctcatgtggccagcatgactcacacacccaacttgtagcatatctggatgtccgttcgcaatcatgtcgggtgatcaagccgacggcgtttgcgaggaattatccgttaacaaccttttctcgagtagtccagccatggccggtgctatgagataggtagtcggtctttgttggtaggttgggcgcgacgactctgcattcgtcgagatcgttctcgataatgtagtgtacttgaccacaacctactcgagtgctcaattgttcttgaaaaatattttctagaaggcaagacatatagtagataatgtcgagtatgtattcgaaaaactgcatggatcttttagtattatcaggatataacgagcagatgtaaatatcaggcattatgtaaaccgtaaacaagcatgatttatacggaaggaaatagagcgagcccccagcgttagattgtagtcgatttaacaccggggacactcacgcaatagatattgtataaaatacatgctctagataaacataataaattttggatctgacaatattgtatagtctgaaaataggtacggaaaattttatataaaataatgcgtacctgtgtagatatatgccggatatatctacgaaattagtagattaattaaaaaaattaatatactaacttgatggacacgtactgtatgaatacgtgtgttttttttctttcctcccagttgtccatgtgcatgctcaatcatgggcatgcagtagctgttgtcgtgtccgacttgattacttgtggttaggtcgtaggagcacgactagtttgcatgggagtccaatgtagtactccgtatctaattgttgtccgaggttgaacaaagttgcatatcctcgccggccgtaactttgctgttttttctagggacgccgcgttggagatcgagtcaaccaaggatgaggaaggctgagtcgatgtccgccgcagcggtagcgacgtcttgaagctatctatctcgaaggaccgaattttcggttatgcttccgatctcgtcggaagacatactccggtcaggttagatcttccatagccgaagtcgtcgagtagcttgttgttgaagaatccatctcttaaacctatctcgtctaaatcctgaagcaccaaaatccccctacctggcgcgccact

SEQ ID NO: 12406 - DNA, 1501 bp, Oryza sativa
caactgaacacactctaacacccaataggggaaacctgtccaattttaatgagggtgaaatgttaaccaatcagcttgtgcggagtgcgatcagctttagattaactgataatagcttatattgaaaaatatagtttgtttttacttcaacattttttaagtgtaaatatgatactatctaccaattggcaacgtctagagtcgtatttttaaacatttaacaccgttttcatattaaattattattttcctattcttttttaatttttatcatgagattttgtattttattaagtttattatagcgtgaaatctgttaataactaacaatttattttatttcttctctcaccaactactgatattccctactgccctggcagggagcaccactgggaatagagcagcagccagctcctttttatttttttttatcagcccagatgaataaaaacggcacaggcctaggcatggcccaaatcgcatgcgtggctgccctggaataccgctcgaaggggcgagaagatgtgcgctagcgcgttagaaagcgattttttaccatcgtaatttgcatatttatcttaaccttttttaatcaagtagaaccgtagaaggattaggaggccacatggcacgattttagaggaggtaatcctggaaccaggtagtgccacgtggccctataagaggcccgagatcgcaccctgaaatcgtatataaagataaccatatgctattttctatatcgatgtttatggttaaattgatctaagaatttgtcttgttgtgcggataactgcactgattgctaatctgccaatgagtgccaaaaatattcttgattcagtgcattgtgctgctgtgactgaatctgaaagtttggcagctagaatgaatatcgatcaatgttatgcatatcccgcggcccggacatggtccaactaccgcagtcaggtcaggcccaactaaacttggatggcaactaactgtagcgatccagattcacggtcaccaatggaaaaagtccaatttgtctcccttaattgttcaccgaatctaattcgtgactcttaactggaaaaccgggtaagatgacttcccgaattattgaaactaatgtaatttgactcctccagcggttttggagggcggtttttgctaacgtggcagcgctgacgtggttttcattccacatggcgtttatgtggcattagaattaaaaaaatatctatgggactcacacataaatatattgtgggacccaccgacatgtggggcccacatgtcatcctttctccttcccctcttcctcttccctctcttcctctctcttttctttcccccttttctcttcccccttcgaacgcatcaccgtcacatcggccacctcctctcctctcccattgttgccgtcgcgccggctgcctctctccccctctcctgccgccaccgccagccgccgcttccctatctgccgccgcacctgcttgactgctcgaga

SEQ ID NO: 12407 - DNA, 1501 bp, Oryza sativa
caaagtttataagtcaaaaatttatatttccgattcaaatttgaatttgaattcaaatattttttatatatagtatttctatacatctaaggtttatacacctaaagtttattaacccaaagtttataagtcaaaagtttacatacccgtttcaaatttgaatttgaattcaaatattagtttatagatccaaagtttataagtcaaaagtttacatacccgttttaaatttaaatttgaattcaaatattttttatatataatatttctatacataaactttttcaactttattttttatttttttagtggtgtaataggaagagaagaagggggagaggagggagcatacaggggggaggggggtgcccctaatgcgcgatcagtcgcgcggtcacgcgggcgcgcgaccaccaggtccaccactactactcatacgctactgctactactactacaaatctacaactcatacactactactgctactactacatgtatatatgaatatgtatatattgtatattaaactttgtattattgtatatatacatataaattttgtattaaataatataaagtttatgcatatatatataaagtatatacatacgtgtatatataatttttatgtgtaccaaaaaatcgatgtataaaaaatatgcacatatacaaactttatatacgcgtgtataaactttgcatacgcgtatacaaactttgcatatgcgtatataaactttgcatacgtgtatataaactttgtatatctacatattaaaaaccgagagaaaaaaatacgaatacaaagattgtatacgtatgaatacaaacttggtatacacacaaatacaaactttgtaatacgtacattaaaaaaagaaaaaaccaaaaacagaagagaaacgaaaaaacaaaaaagaaaaacagaagagaaacgaaaatggaaaaaggaaaaacaggagaaacgaaaaaaacccggaaaaatcgctcagtcgcgccggggcggggggcggcggaccccgtcccgaacgtgtgccccgaacaaaataaaaagagcacgggacgggtcgacgtgtacccgaaggccgaacgtaaactgcagggttatctatgtgcgttcgcccttcgcagaagcttctctaatctctctccaccgtagcgcagaacgtaaactgaagggttattagtaccttggaatgactggatgacaagtgggcccagtacagaaggtcccattatgtcagtggcactagatcgagcactcgcgccgcgagcccgcgattggaatgccatgtgggtctttctcttgactactccatccgttgaatgtcgttttcagttttatgtcaggtttggtaggtcgtgatctttttactattttgcccattgtgcaaaattttctactacatgcaaaatccgtcgaatgtcgtcgtttcgtttgcgtccgcggggttatcactatatattcctctctctctccaggaaaccaagccttccc

SEQ ID NO: 12408 - DNA, 1501 bp, Oryza sativa
ttgcacttggctgtacgccattgaataattatcgattgttcaggttttacatttccgtgttctctctgccatgtcacaaatatgaccgacattttgaagcggcgttgttgtgtggtgcattttgaaacggcgttgttgtgtggtgcctaatcaactttttgagttaacatttggttagatacattcttggtttggcatttttttttttgccgttcttttgccactggtagtacggtaattctaatggtgagggcggcgaagttggggatgccgatcggcactggagaggccatggccggtggtttgtagctgaaggagatgcgagcttgaggacgccggccttgttggtgatgaagtcgagatatccggagcggaactcggtcggcggggaaacgtagtgcttgaacgcatctggtgacgtcggcccgagatgcgttcaggtgagtcccgacgacgtcagcagatgacgtcgggactcacctgctaaggtttaggcccttgtcgagaggtaataccctatgtccagttgagatgtattggatctgtgtccaagtgcgcgggtcagcaatggagtagccgacggcacgtatgtggagaaaagatgcaaaagtcctaaccccttagggtttatgctggcaccccctatatagagctagggcggtcggcggtccgatggtaatctaattacaagggacaaaattgattcccttatctaatattactttcctcaaatacaaactaaccacacgggcctggggcgctttgcccaccctgtacggtgcggcccaaaaggcctactatgaggcaaccggctatcgtgccccccataatcaaccatatataagtacttcaaaggattgaacgcgtttgttgatggctgttaaatacgaaatttacgccgtcaatacctgcataaatctgaaaatataaaacatccaacatagtggtaaggtttatttctaacaaattccactagtgtcggtgtatatttgtatgcaggtgataaactaccaaagttgagatgaactatacatgagggacggaaatattacttccatatccaagctcatagagttttgagccaacaagcccaacaagatcataattaaatgggccaactccacagaaatactaaagtacctactagggcccaaaagaaaaccaagggccagaagggccaaccaggggtcggccaactcaggaacagcccatctagccctcgattttcacatgtcggtagttaccgactatccaaggcgattgtgatcatttctatcggaataaaccgccatggaggggaacttggcagctcatggagggacacttggcagctcaagagtgaagatgctctttagatgcttaggatctacatactcccaaggcgtctcttggcctataaaatacccctctcttccctcattcacaacacaccaatatgtgagctgaattataaggctctttgtattcttttatttatacttagactaagggagagagtgag

SEQ ID NO: 12409 - DNA, 1501 bp, Oryza sativa
gtgtgatgtagcaaatagtagtaccaatggagtatcaatcttctctatctttccactggtcgctgtttcaggctgccgtcggaaagcaaaattctttggcatatcagccaaacttcgcattttcatttcagccaaagaatttccattgattggcgtatttcttgatgttggatcttctgtggcttaatggttgcagctctcaattgatagtagcattcatatatgatgggtttagggattagcaaaaaaaaaatctcaattgatgtaagttgtggaagtaaattactatcataattaatttgtagcaatatatatttagtaagccatataatctctcagttgctacatgtagtcgtcatcctcctcagggttgggttcctcatcatcatcctatggtgagtgaacatacatctcgtcaaactccttgtcgttgatgtccggattgtcgtacaccgtatccaacacaaaattatgtagggcaaagcatgctgtaattttttttgtttgccacttcgtgttatatgagggtatgcctcttaaaatcttccacttggttttctaagcatgtagataattaaaattctcttgcaagagttccggattgcagccacgaaaatccggcacatggtaccattcacccctatatggagccatatatcgtggagccaaggcatatccagtatcaaccaagtagtacttatctgcacaacaagacatatatttcagaaactcggccaattgtaactgtattaaaaaacacttgcacatactgtgaggtgggtgaggaaacaaatcagatttgtctcctctcacgacgcggttgaagacagccatgtcatggcatcttcccttcatcccagcggcaacaaaagtgaagcgcatgtcaaagtcacatacgaccattacgttttgactagtgtatccatgcctacacatgtaggtcatgcactcctcttgtggaatgatgactgggatatgggttccatcaataactccaatgcaattgatgaactgtggggaaaacctagattgcaacaaccttccatgcacaccacgaaaagcaggatcacgtggttggatgatatcattggaaaattggagcatcactttcaaaatatccctaaatttccgatgcacggtgtctggtgacctttgaaaacgcttgcaaatctggctttgcgataagtcgaaatttctttttaggtttgtgaagttgctttgccatcaatctttcatttgtgatatgtgcaaatctctttttatattttcccacccttgtcgattcatatattgaccctccatgttcatctgagccttttcatgaaggcatcgatcaaggaatgccttggtcattcgtcgagtccaattggcgcggtcgtggctcatctgcataggctgaagtaagtggaaaggtagcatgtgcagtgggttgtctactctcaattatacatagtacatatcgaattattgggttaatgtattagttaagtgaccacatcat

SEQ ID NO: 12410 - DNA, 1501 bp, Oryza sativa
ctttatcttttgtatagcgtgattcattatagtgcgccagactgagaagtggcgagaagtccatgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctgatcagagtttaatctattcgaatagccgtacccgcggttatgggtgagttgagcaatgtttttcgtgattagtctcactctactcatcaatgttaataatgtgataattaatttgactcctggtttggaatggataattcctggtttggaggtttaatttgttcaactggggttggttgttcaaatgtggttgggcctatgcaacacgggtgtgttgtatggtgtttatttaatgttgattaattattcaactgtttttattattctcttaaatatttattaaatgctgttttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttcttggttaagatgcctgtggagtggagttgccatagctgttccgtagtttgttatagttttttttttccgctgcgtagaatgttattctttgagaggaactatctacctctgtaataattttttttatttgcgaatatttaatagtactctattatcaatttgttattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaaatatagaactgctcttctctattctcttataaattaaataagttggcagcacatgcaaggttatgcacaaaatttatttaattcaatttcttttcttttaaaagcaaaaagttgttcttctcaaaatgtttctttttctctttaccaaatcttattgattagtcggcactgtacatctattatggtatcgatacaatcatgatagcactagtactactcatctttcttgtggtgacactgtaccgtgcttataatagatcataagtattttagttttattttagttatttgtcaaaaaaaaaatatttgtctctgtccaaaaaagttaaattctaaaaatatatttatataatagctttgtacggtcttttcttttatctttcttcctttttggtcaaaatcagttaagtctagttggtgcagctaacttaaaatatgcattaattcttcccttctatgtttctttaga

SEQ ID NO: 12411 - DNA, 1501 bp, Oryza sativa
aggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcaatttcacacacaaaaaaattaataataatggtggaacccacgctgccccacatgtcagtctaactcacccctcctcttctgcttcctctctctctttctctcctcttttcatctctctcttgtgctaggggatgcggccggcgatgacgatggcggcggaaatggagaagagtgactgccaggggcataggtgtgacgtcgctgggggcgctttgaggcggaagtagactcttacgacgtggccgtcggaggtgagcgaggtcgtcatggactcacgggattggcggtgtcgtcggcagcggtggagcaggagttgtagttggagtccttgtcgtcgacctcgagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttctacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctctcccctctcccgccggcgaggtggccccctcacccgcccacgtggacggccgccttcgaggatgcgcgcgtgtgtcggccggtcggcgggacacgttcatcccgccgccgaggatgccgaggtcgacgtcaacatcgtccgcagccacggccgcggcggcgctgcctccgccgccgggctggttcctttctctccgctagtt

SEQ ID NO: 12412 - DNA, 1501 bp, Oryza sativa
gcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagttttttttaccataatttattttcttctttggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcagtttcacacacaataaaaataataatataataatggtgggacccacgcggaccccacatgtcagtctaattaacccctcctcttctgcttcctctctctcctcctcccctctcttcgtctctctcttgcgctgggtcattctgattctcctcttcaccatcttctctgtcttcatctctctcccctctcctctttctcttctctccggttcacgggcgccggaagaggacggtgtccggctgggagaaggggcgcggcgcggcggccggtgggagggaaactagcggagagaaaggaaccagcccggcggcggagccagcgcgccgcgcccgtggctgcggacgatgttgacgtcgacctcggcatcctcggcggcgggatgaacgtgtcccgccgaccggccgacacacgcgcgcatcctagaaggcggccgtccacgtgggcgggtgagggggccacctcgccggcggaagagggaagaggcggccgactgcgaagacgaccccagtgat

SEQ ID NO: 12413 - DNA, 1501 bp, Oryza sativa
ataaattttgagttttaattcgatccatattctatttatatttattcagttagatcaatattattactatttgaacttagagtgtttcctctaagagaaaacaccctccaagaataaatattatcaatatttgaactccaaaaataaatattatcaatatttaaccttaatttgtagaaaacaccctccaaaaataagagtatgcggctatttgtggcgcgcacacggtactctttagtaaaaggcgaaagaatagttcgctttgtgctcaccacgcagctgcttgagttttcgccgagcagctaccgccctttaaatagccgaatggctaactcacctccaccaaaacaagcggtatggtactaaaaatattctgctcccccggcggctctggtgtctcttctctgctttgcaccaatctcctgcatgggcctatagaagcagcactgttgggcctttcctgacgctagccacagcccacaacagaagtcccattccggcccaactataacgggccacacgtcacgacaggcccgttccgtatgggcctcatgtacgttgcggtcccgtacaatttggcccaacgaaaatgggccaaccacatgtgttgcattcttccggaaggaataagttcatctgagatcccttaacttgtcaacgaatccgattttcgtccctcaaccagaaaaccaaatacaacggatccctcaactgtcaaaaccggtacagattaaatccctcgacggttttgagggcggttttggctgacgtgacgcctacgtgactaacttgactcagtattcatctgacgtggcattgacgtggcgcttacgtgacaattcgatctgaaaaaataataaatctagtgggacccacatgtcagcctcacacagaaaataataaaaaatagtgggccttacgtgtcagtccaactcacccctcctcttcttcctcctctctctctctctccccatctcccctttcttcgtttctctcttgcgctggggatgggcaccagatgcggccggcgacgacgatggcggcggaaatagagaagagcggccaccggccatctctctcttgcgggcgcgctcgctggtaggccagggaaaccaccctcaaaaccgccgcgcgacgccgccctttcccgccaccgacccctcgcctctggaggatggaaacctcgccgcgcgacggggacactgccgacgaatgaacgaacgatgcgtccctcctggtgctccgtcgccactccagatgggtctccttgaggttgaggacctcctcttcgccccgcgcgtcgacggcggcggcggcgacgatgagggcatggcggcgcccgactacgccatccctcccctctcccccaccgcctcctccgtcgtccaccgatgcgcccggtatgatctcccttcatcctcaccagtgtccaattgatttgattccccgatcgatcgtggctgcaggatcgccggcgtggaggtggagcagctgctccggc

SEQ ID NO: 12414 - DNA, 1501 bp, Oryza sativa
agcgagttgtggctgagccggagcacggcgaggttgggcagcgcgccgagccaccgtgggacgccgccgacgaggttgttgttgttgaggtacgcgacggcgagggcggtgcagttgcggagcgcgtcgggtatctcgccggcgaacgcgttgtcgcagaggctgaggtaccgcatccgccggagccggccgaggccgccggggatgctcccggagaaggcgttggaggtgaggttgagcaccacgagccgcgtgaggttggcgacggccggcgagagctcgccggcgaggcggcccatggacacgtccagcgacgtgacgcgccccgccgtgcagttcacccccggccaccggcagaagtgcaccgtctcgttccacgaccggagcacgccggtcgggtccgacgtcacgccggccttgaacgccatcagcgcgtccctgtcgtcactctccgccgccgccgtcgccgccgccaatggcaaaagcaacagtaacaacaccggtgcaactccaactggcattgccatgcttgctagtatgagcgatgaatctatcgaacttttttttttatcttcttcagtatgcaaatttgttgtgtgaagttggggctttatttgtactaggtttgcatgggcgggagtgtgccacgatattccaaacttagctaaggtgttcggctggcatgtacccttgccgtgatggaacaactggtcacataaaaatccgtacacaaagtatagtgaatgaccgaatgagtgtagcaatgcattggagggaatattggattacataggatagtcaaacgaggaacctactgttctgttgaccacttgctacgcgagagaaagcagacgtcgcggccagaaaccaagtcaaacgaactgaaatttttgaaaatatttggattgttttgaccctgataacacccggctggagctgctcagctcggtctttgcttgctggcggcctaaattccatcaattcgtcccaggacaactggatcgacgggttgacttttcaatggaacacttgtatcaacctggtcgacaggatgtcgttactctactttttcatcaatcatctggtgacaattgactttttgtgtgagtgacagggtgcttgacctggtcgtagcccatagtaggccaactcagaatttttagtgggcttggttggacaagtgggccaaaagttgtagccctatataactaaaacggcccactagttagagccaaacccaatgcaggcaggaggcagccctcccctgaaccaaacatccgagatttttttttaataagttcactttaactcccttaactactcatcgaatctgattcgtattcttaaaccgaccagatatattgacctctcaactatcaaaatgagtgtaatttgactttctcggtggttttggaggacggtttcgcttacgtgacgtttacacgacagtgttgactagttttaatagtcgagggttcataatatccgatattatggtaca

SEQ ID NO: 12415 - DNA, 1501 bp, Oryza sativa
gatgtaccggaagtaggacgacatgaaggcgacgaggccggcgtaggagcgggcggcgaggataccccacagcgacttgccttcctcgcgagggagggcgaggtgcggcgccgcggccgccctgccggaggcgtggtgggcgatggcgttgaggatgatgttgccgacggggtcggcgaggccgaggcagtggccgccctcgaagatgcagccgacgagctccgtgatctcgtcgatcggcagccgccgcgccgcctcgtcgtacaacctcttgatcgacgtgatgatctttgcgctctcgtcggggtgaggccgcttcccctcctcgccatggtagcaggcgaagctgcccgtgcccgaccatggcggcgccaccaggtgatgatgggacgaggaggaagacgacgacatggagcccccacgagttggggattttctttcctccaagatttgctggtccaattagtttttttattattatttttgccctcgatccgacggttgctataaatcggtttaatgtggagaaaaaaaaagaccacttccttatatacttatctgtaccataatatcggatattatgaaccctcgactattaaaactagtcaacactgtcgtgtaaacgtcacgtaagcgaaaccgtcctccaaaaccaccgagaaagtcaaattacactcattttgatagttgagaggtcaatatatctggtcggtttaagaatacgaatcagattcgatgagtagttaagggagttaaagtgaacttattaaaaaaaaatctcggatgtttggttcaggggagggctgcctcctgcctgcattgggtttggctctaactagtgggccgttttagttatatagggctacaacttttggcccacttgtccaaccaagcccactaaaaattctgagttggcctactatgggctacgaccaggtcaagcaccctgtcactcacacaaaaagtcaattgtcaccagatgattgatgaaaaagtagagtaacgacatcctgtcgaccaggttgatacaagtgttccattgaaaagtcaacccgtcgatccagttgtcctgggacgaattgatggaatttaggccgccagcaagcaaagaccgagctgagcagctccagccgggtgttatcagggtcaaaacaatccaaatattttcaaaaatttcagttcgtttgacttggtttctggccgcgacgtctgctttctctcgcgtagcaagtggtcaacagaacagtaggttcctcgtttgactatcctatgtaatccaatattccctccaatgcattgctacactcattcggtcattcactatactttgtgtacggatttttatgtgaccagttgttccatcacggcaagggtacatgccagccgaacaccttagctaagtttggaatatcgtggcacactcccgcccatgcaaacctagtacaaataaagccccaacttcacacaacaaatttgcatactgaagaagataaaaaaaaaa

SEQ ID NO: 12416 - DNA, 1501 bp, Oryza sativa
aaataaaaacaaaaactgcgaggcccacatgtcagtaagacaaaaggaaaaatagtacgatctacatgttagtgggtcccaccctcctctatccatgccatggacgacgggagacgatggaccgccggaccgcgtctccttctctctctctccctcccggccatccttcctcggcggccggcaagcgcgcacggagagggaaaaagccgacagccgacgaggggggcggagacggtcgacggccgccgctcgctgtgaggggaatgccgacaagggcagagaggccggggggctgccgctcctcttctgcccactcgccggctgccgaccccctcgcaccgttgctcctgtccctccctctcgtcggccggcgcgcattgcctcctccctcgcagcgctcccgtcggacgccctctccggcagcgctgcgcgcgcagccgctaatctccctcccacccgtcggccggtgtgcgccgccgatgctctcccgccggcagctgcgtgcagctcccccctgccgctcctctccctccctcccgccggccggcatgcgtcaccgctcctctcgcgtcggaggtacgcgtggcgtccttggcgaggtcgtcgccgctccgcttgtgcctctgctctgcccgctgccgccgttgctccgctgcgaggacgagggagagcagagaggaagaagagggagagccgagagggcagggaatgacttgtagggcccacgtgggccccaccagtatttttttgtgtagctgacatgtgggcccacgtgggccctgctatttttaaatgatattttgtgtagctgacaagtgggcccacggttttattattttccaagatataattgccatgtcaatgccacgtgggacggagagctagtcaaacctgctacgtagacgccacataaaccaaaaccactgagggacccgctttggttttgatagttgagggacccgttgtatctagttttctggttgaaggatggaaatcagattcgttgacaagttaagggaccttaagtgaacttattccaaggtactttgacgcgagacgaagctgtggcccaatttgaagccggcgtgaggcccatgaaccaaccacagtttggccccattttgatggttaaaaaaggaataagttcatctaaggtcccttaacttgtcaacgaatccgatttttctctctcaaccgaaaaaccagacacaacgagtccctcaagtatcaaaaccggtgcagatgaggtccctcggcggttttgaggccagttttggatgacgtggtgcctatgtggctaatttgactcggtcttcatctgacgtggcgcttacgtagcaattcgacccgaaaaaataataaaacccgtgggacccacatgtcagtttcacacataaattaataaaaaatggtggggcccatgtgcgccccacatgtcattctcacccctcttcttcttcctcctctccctccatctccctctcttcgtctctctccccta

SEQ ID NO: 12417 - DNA, 1166 bp, Oryza sativa
tgttgcatcgcggcatctagatagcagtacaaatggtatctacacgcataacaatttataaattgcaccgaccatcattgttccagcctcccagatcgctcgtcgatttctttcagtttttcgtctactccgatgtcgttcgacggggtctcccggctggagacgtcgccgccgccggcgttggaggaggagatggcgactgtgactcaggcgccggggctgtcgacgccgtccatgctcggcaatccagatggtggagctccggcggcaaccatgatccagagcgcgccgtgcgccaccggcggcgaggcgttggtgggcgagggccggctgcgaaaggggaagatggtcgccgaggaccagagcccgccgagcgtcagcggcggcgcaccggctgacctgcctcccggcggcgacaagctcactgagaacggcggtgacactgacaccctcctcctgggtgcccgttgttcgtggatagagaggatggtaggacccattgacatgtgggtcccactattttgtccttttgtatgactgacatgtgggccccatgtttttgtttttattttttatttttatattttgcttccagtgccacatcgtcgccacgtaggacgaggaccaagtcaaactggccacgtaggcgccacatcggctaaaaccaccatcgaaaccgctaagggacctgctttgcaccggttttgatagttgagggacccgttgtatctggttttctggttgaaggacgaaaatcggatacctcaacaagttaagggacctcaagtgaacttattcctttcctccccttttccctcctctctcgtgccttccctcccctcggcccgactccctcctcccgtccttctccttgggccggcccactcccacctctcctcctcccgcctgggcctgccccggcccaagccgagccgcagccctcccgcggacgtgcgctgcacacgctgccacgcgctggcaggcggggcccacgcgccggtcgtcgtctccttcctcctcccatccggtctcctctctccctcccgtgaaaaccctagcttcttgctccctcgaatctgccccattcaaaccttggattccaaaattcattaggggaattaattcccttcccttcctcttcaattccccctaatttcccccttgat

SEQ ID NO: 12418 - DNA, 1501 bp, Oryza sativa
tacaagttagagtttgttcagattagtgccaaaataaatattaccaaaacttggcaatataccaaaattttaacaaattgataacattgtcaaaattttgataggattggctttaaaatgttgccaaaattccatatacattgccaatatttaataacaaactaaatgtagccacataattatcaattttaacaaataatgatattatggttgaaaacgtcatcagtctgagtatgcccttataatggcctatcagatcaggcgtgatcctgcctatgtttggctgtttcaagcacacagttttctcaacaaagccctttcagtagcagtagcacatatgtaatgagctgattgggctcatgttttcgagctcaagatcgatctcgtggggtaggtttctaagaccaaatcaacggatcatttttcaggcaacgacagcacagaaatgtcatgagttcctagaatcctagtacatttgtgcctagcttagctgttgccagcaatcaatgcacaaatatgttactaatggtactatcttaacctaactctggtactaattaagttagtaactagctagttataatgttctaatgttgtagtaccgatccaagaagtaggtaagtgtaaacaagccgaacagaacctgtctcttttactcattttcctgacaacttgcaactgatatattgatcttgatcgattgacattttcctcgttgaaagaaattcttaatcatttgagattaaaaaaatattaggagacaccatttaataaaaaaatagagtatgaaaagattggtcaggaaatagccattgggaaggagtcgaaattccggcggccggttggctaattaactgaccggaacttcaatatacgcgaaaaagaagtgaacgtacatagttattgtgaaatcccccaagctcccaactgtcaagcacatagttggtatgccacacgctaattaagatgataatcaaaataaacatggtttctaaggcatgaatatataatagttggtactacttactacatccataaaaaaaaaacccaaacacgaatatagacattgatttgttgtattaggatatgtcccatcctatattattattatattattattatgttagttttttttgtttttttaacggaggaggaagtactactgccactgccagcgacattgtatgactcgtgagacctgatctaggtcatgtccgaggtattcactgcctcattgactagtgttgccggtcggttctggtggagtcaactaagttaattgggtcaaccaaacgctagttagatcgggctaatatatataattaaaaatcatcgttttaaagtttcagtaaacatgcatgcataccgatcgtgctactgctatataagagccacgctcctagctaagctcatgctcatcgctcctagctagcaagcctgccgatcacaacagcagcagctggtcagtggtcgcactagcgaaggagaggatcggaggaga

SEQ ID NO: 12419 - DNA, 1501 bp, Oryza sativa
ttaactactgctgattaataactatattattacaggtgttattgatccgagcttttttttggacaaatatatttgcagatggaaggtgcgaagcatgccgaaagcagcgatgggatttacgacctgagaagtgagaactttcagccggccacagccggctttagactttttttttttatctgtggaattcgttcagagaacaacaaagctttactttgaccctttaaacttatatcacctaccaatggagctagcgtaagtatctagttctcctttgggaaagtcggcaaggaaggaaggattaattaggcaagatgggtaagtgccaacattaagaagttaactctgcacttgcagcggttgttgttacagttacctatcgatgttactgcctagcaacctcttttttttttttttgccgactgatgctgtacgactgtacgtacctccccatgtctatacggtttagtttaatcttaacgaaacattatgctctggacagatagtacattaatacagtaattaattcgccataaagtacgttgatgtgattagatgtacttgcagcagcattactagattaattgtattcgttacgtctaaaaaaaatctgcctacctagctgcctctttggcgatcggaatttcagaacaaactggaggaagttttttttcttttcgtgttaaaaggaaaaagaaagaaaagaagtagaagtatgattaaaaattaattagaagaaatgtgaccactgcatcttaagcacgtagtagtgcatcttgaattttattttgttttgaaccatatgactgtggattattatgagtatatgcagttccacgtactccgttaacgtggctaattttggctccgccatccaaaccgaccgaccgatcgagtccgacggcaccaccacctgtgcagcatcgaacactttgtaaggacgatcatatcattgcaacacgtacttccgtgtcccttgtgtagtccatgctgacgtttctggcaccaaaatcacccaaaaaacacttaattaatttagtttgaaaaacattaataactaattttgtacgacgacgtggccattctcctgcgaaagtaatcgcgtagtgttcatggagacgaaagcggcaggactcctcgcaagaaagaaagaaagaaaacggcaagacgaaattgtacaaaacaacacgatgcattctagctcgatatgatcgatctgcgccgtcctgtatatgcattctagcatggcagaacgcatggaatgtttcagatattcaaaacacacacagccgtcacgtcatggacgctagctgccggcgacgatcaccaccgttgtccacgtactacttccatctaattaacgtgcatcttctaggctctgctcatgcgcctatatatataaaaaacgcacacgaattcgatcgcgttgcatatttgcatgaacaagtcacaagtgtagtagaagtgcagggcgcaagctgtgcaacacacatggcggcga

SEQ ID NO: 12420 - DNA, 1501 bp, Oryza sativa
cggcgatcgggagagcaggtctccggaacctctgccttcgacgtcctacaccgggagaaggcggcaataaggtttttgggaagcgcttcgcgcgactgctccctgttagtccgcgacggctcgccttcctctccgctcgcgtgcttcgcgcctttgtcgacgctcgcaaccgcgagtagttcctgtcgagcaaccggtctttccgtcacctcggtacatgttcgacatgttgcgcatatttgatctgttcatgttttactgcttagtttacatgtgtagatctaatgatgcattcaatctagtttatatctgcaatgtcatgatttatttatggaataaattaaattattatgtgcttataatttcaatagacccatggtcggataagatgttggtctcctgcagaaggaggaagagaactcatgaagaaaagacaatgaggaattggagaagaggaggaatcatgctttgagatttggactggacaggtgtcaaacaaataaacaaagtcctaccgatgagtaaaagactgaagtcttatgaaattttcttcccaaacattgaaatttcataggaatacggtccaaattacaacaacatttggtcacatatacgttgacactgattggcacacacgcttgtttgaagagtttttttttttgttttttttttacggcgatgaattgcatctgacagttgagttgagttgagcgcttcagttgggttggggtatgaacttggtgatgaagttgtagataaggtcgctgacctcctcagccctctcctgctggatgaagtggccggcgccggggatgacgacgacgtcctcgagcagcggcacctcggccttgagcccgcccttgtgcaggtagtcctggatgccggcgtagtggtacgtcaggtcgccgtccccgacgatgaacttggtcggcacctgcaccttggcgtccgcccatggcgccgccatctcccagttcctgtccatgttgcggtagtagttgatgccgccggtgaagcccgtcctctcgaacgcggcggcgaagtagtcgatgtcctcctccgttagccaggccggcagcggcagcggcggcggcggcggcgactcctcgctctccggcttgccggccttgtggacggtgaagcggttgcacagtgtccgccttatgatgtgcctcgcgtgcgccggcgcgaactcctcctccgcaacgccaggctcctgcaaacagcaacaattagcggccggtattgggccagattatcctgtgcaattgggcctcataaatgggccgccggcccagagaggatgaaaggtaagtggtctcatgtatggcagtggctgaaccgaccagaggtgatcacgtacaagaatgtagtagtaaaagattacctagagaatcgatatctttcgatgagaaacggaatggccaagtaacctcagggcaagtaattagggcttaatctctcaattccctatttcggcttgatttgctccctccctgca

SEQ ID NO: 12421 - DNA, 1108 bp, Oryza sativa
tcgcgccgtcgacactcttcgccgtctgccgccgccgccccgcggtagcgccgccgtacgccattgctgccgggccggcttgagctgcccgtgcgcgccagtcgcgcgctccccgccgccgtccgatctaccctcgggtagatctcggggccatcggttcagctgcccgcgtggctgccacgtggctgccacgtgtgtgccacgtcgcgccacgtcagcgccacgtggtgcactgctccctccccggtccgtggacctggttcatcgtggaccgccacccgagtcactgccatgtggggcccgcatgttgacgccgcccctctctctccccgggattttatttattgcgcaataaatcaattaaggatttttctgtttatagtaaaaacacagtgaatcttctaaaattcatagaaaattcatctgagctccgtttaagcccattcaagtctcagtaaatcaagaaaaatgcatagaatccattaaaaatggttttgttctctgtttcagtagtcttttggcctgtttgtattgtttgctttgtatgtcgcttagattccggctctcccggtgctccggtgtactttgaaatagtcgccgaggttcctccagcagcagagcaatgcaagtcatacttatcacttgaacatgttgatcctatattgcaaatgctctattgttttcccttaaatactgcattgttttataatgttactatgggatgtatatctactgtacaaccatgctatttttgtactatgctcctttgttagcttgggatataacatgactagatattgcactagggattgcttagccatgtttagttcaactagcacacaatgggagaatcacattaatgcatagacttcaggttctagtgttggtgttggattaaagcctccgtcctggtgttagtcaattaaaatgcattaaatggtgggctatgggtgcatggttttgatggtcgcgtccatggcacttaaggaccggttcgcaggatgccctggaagaacttatcgtacttaccacaagccagcgtgggcaacggctgggcttgtagtgtagctttcctctagttgacgcatcgaggcaagggtgggcgtga

SEQ ID NO: 12422 - DNA, 1501 bp, Oryza sativa
attgacatcgtgaaaaaaaaatcacctagcatatgcttagccaagttaatgcaccaaaatactacttcctccgttttatgttgtaagactttctagtattgcccatattatgtctagattcattaacatctatatgaatgtggacaatgctagaaagtcttacaatatggaacggagggagtaaattatcaagttcttgtattagaacgcacccacttatcaagttgttgcactcggacgttcaattctcaacttcttgcactatatcgcacccacttgccaagttggtgtaccatgggtgcaatttactccaattgcaaatatgtccatttcaaatatatgccattacaattcgtctattcgtaaccatgctaatgaaattatacaaaattgaaatcgtgccactgccgtcacattttccatcaatctcttttttcccgttttgtttcttctttctttcgtcttcttaccacaccaacgcatggcgggacctcggcggcccggcacgcacgaatccaatccgatgagtggcgggacctcggtggctcgacacgcacgccgtccaatgcaccgtggtctcaaccacatgctcgtggacgcggttgtccatcacgatgacgatctacaaggaaggggatacggggagaagggcatagaggaagcggggcaggcggggcagaggaggtgagttatgcggcaatggaagagtttccctgtcattgatcccgccagggctccatcgctggtggtgtcacctcgcctaaactctacccatatcttatgatagagagagcccccggctttaacagtggaggcggcggcaacgtaaagaagagcaaagatggtgtacgaccgcctcttcgtgccgctcgcgagacagtgggtaggcgccagcccctctctccctcgtcgcggttggcctgaagggctgcgcgagccttctcacgcacggtacggagcaaaacaatgatttttttaagtttaatagaatggttcacttttagtttttgaaaaataaatttaggttttctcttgaaaatattagttttttcacttcctattttcggtttagaaaactcaaaaataaaaatttagaggtggattatacacttttgttggtgatgctcttacgctattagggtgtgtttggataatgggaaagagggtgggattagaattgagaaatgaatgaaaggttatgattaaatggaagagggtgaatgaacggttagaatttaaagatatcttttggtaggtgaaaaattatttcccattagccaaacgctgccttaggtattacagttctaacgctcatatgctctatactatatgtctatatccaacggccctccccgatttccccgaaacgctactacccctccgccacagcgtccacacccgcgccgccgccgccctcaccctcgccgccgcgcatcccgcggtcccaccgtcgccgattccaccgctgccacggacaaccccgccgcccctttccttcctc

SEQ ID NO: 12423 - DNA, 1501 bp, Oryza sativa
agtgtgtgtgtgagagagatatatatatatatatatatatatatatatatatatatatatatatatatatatatatatatatatatatatcattctataaacattaagttaaaattcaaattttacaagtaaaaataataaattacattacaactaattaacttacatttatagtcaaatttatttttttctttcaacatgtagaagttaaattttgccttgcatatttgtgtagtaatttatcacatattagtctaccttgttggtattttttaaaaaaaaacataattatttgagagtgacatgcaacaacgagagtacataccctcgggagtttatagaatagtggtgtgcaaaagattgtccacgatagaaattgcactgtagtttatattaactgaatgaaaataaattttctgctttgtcattatcatcaacgatggaagtgcatgcacggttacctttagcattagcggcccataataatgcaacttctctcttttaagtttttatttttcaagaggacatcctcttatttattgcacgcaacctaaatagtatagttattaaaaatttagaaaaaaaaagttttgatgaagcaaattagtatgaaacatatcactccacaaatataaaagtccaaattcaactttcacaagttgtaataaaaacaacaaatataattgtgaattcacgttaactaatttcaacttaatttgtacttttttcttataacttataaaagtcgaattgatcttgcatgtttgtgtcgtgatatattttatattaatatatcttaattatcattttttttattttttaataattatttacgtgatatgtaagaaaggcaagaatgttccatcaaagatgaaaatccatctccctagctttgacatacctatatatggtcatgatacaaagacacaagctgcaccttcatatttcagggggaaaaaaaagcgcaaatcgcatttttgtacgagaaacaagagcatatgaattggtataacaactcgtgtcaatgttcaaaaaaaaaaaactcgtgtcgacgtgtcgtgtggttgggcccgactacgactcaaaagacccatgcctgagccatggcggccgtgtaacagattataatagcaaatagctcgagttattttcgtggttttctcctgccgagcggtactgctcccggtaaaacgaaacgaagatgcatggcgatcccgtctacaccgaattgaagtctccaagccagtaggaagagagaagatgaatcaacagtcacagcagatgccggggagatgcatcatatcgccctctagcgagtagcgagacgcccaggcggctcgagttccgcaagcatccgcaaacgcggcctccgcaacaacactggcggggtgagccgcctcatgatacgcagctgcttcggcgtgtggtcggtcgtccacggccgctacatccggcggacacactatctccgctacatctggagttgaggacggcttgagca

SEQ ID NO: 12424 - DNA, 1002 bp, Oryza sativa
gatctgtctaagtgataactgtggaggagaggataagtgatagggattatataatacatatttaattttagtctcggttggtactactaaccggggctaaagattatcttgatctttaataccaaccgagactaaagtggtgatctttagtactggttattaacaccaaccgggactaaagatcctcggccccctgacatacatctgacaagggatgaacggttggtgttaccaaccgggactaaagataaaaatttttataaccgggactaaaaacaatctttagtcctggttctttttggatccgggattttgccggaccgaccaaaatggtttctccactagtgattgtagtgaatatccacggcttagagtagcattcgagcgaatcctataataacaatgagcgaagcagctttttaaggatggcgcatatctaaatttctcgttattttctatccaactgtatattccaatattggacggctacacgatctaatccgcacgtgagccactgcaatctacttcacgtccggacagcatggatcgatgaccaacagcatggatcgatgaccacatatcggcgcctctcctatacatgcagtcttccctccactcgaatgaattgttgtatgcttgccatcaccgcttgtgtgttagagtaggtacataaagatattgagaaactaagcaatacccctttaccacaaataaataaatagtccactttgactccttcatagtgttccaaaactaattcctgaccctgaaccgtaaaatcagatatcttaaccccttaaactgttaaaaccggtcaaccagtttgactctctcggtagtttcggagagcggtttcgctgatgtggcacgttacgttacggtgttgacctggtctttgtcccacgtggcactcacgtgacattagaattaaaaaatatatatgagcccatttgtcattaaaaaaattgtggggcccacatggcggtctatctcttcacccat

SEQ ID NO: 12425 - DNA, 1111 bp, Oryza sativa
caggagtaggagtagtgtccaaggaacaaagacgtgtctcctcagcgattagatctgcaagagcctccgccatagtaggacgtgtaggacgtccaagcaactgaactctaatggactcaaattgagaggaaagtctcatgacaaattgatacactagattttcttgatcatgcttctctctcgccttgcattgtgcacaacctgaagcaccttttggagtctgtgcctcaagctgtccagacaaccgagtaaaggcattataaaattcttcaatggactgatcttgttgttgtaagttgtgcaaattctgcagcaaggaaaaacgcaaagctccgctttcttgagtgtacctctgtttgaggtagtcccacatctctttagcggtagtgtgatccctgaaactcatccgaataggcacctctacactcatgaatatgaatcccataacacgatcatctgctgttttccacgccttaattttagttgcatccgttttctcatcaggaggatcatctgtgaggtgagatgcttgaccaatcgacctcaaaagcatacgagctgaaagttctcattcttgataattttgaccatttagcttaatgtccgtggagagcagagctccacctccaagaaaggggtcggatgttgccatcaagaccagcagaagaaaatttgacaaattgactggacagagacttgcttacaggacttgatgtattgtctcctgaattagcaccagcagcacacagcggcagcagtagtggaagagcagcaacaacggctgagcggagcaaccgcgtgacgagcggctgcaatgagcgatgcactcacgcttgacggacgaatcacactgacttgctgtgaatcccgctgctgatccggacgaggaggacgtgaagaagatttgcccgatagggagccgccgccggcaagccggagcgccggcggacaacggggatcgagggctagggttcagcccatgagctctgataccatcttacagtgatagataaatttggggaatttactatgtactattgacttatggtcaaggaccacatataatgtatacaagagatgaaaagacacatataccctttaacatctacat

SEQ ID NO: 12426 - DNA, 1501 bp, Oryza sativa
aggttgttgtacttgtgtgtgtgtgtttgatagcatgcatgcatggcccatcctcctccgtttttgattcatgcttcctatatcccctgcatgctggatgcatgagtatgaggagctactagaacagtttaattaatttgagtttggaccgcacatatatatcaaagaaaaccagaagatcagtctgttatagttgtgatgatgagtttctctaaactagtttgaagggagagcacatgcatgcatgcgtactggacaggtgtttggaaactgaaaaatggtatggcaagctagctagctagctgttttttcttttatttcgtgtgaagtactatatactagcatatatatattggaggccaataatgtttttctttgcttggattttttcgtggaatatgtccaatatattatctaaagaaaatgttcaatatattatccggtcatgcatgtttccctccgttttatcttgtcttttctgcttcaccatgttcctctagcagttgctagctagctagctcgatccatccagctggctggtgacgatgtaagagctgaggtcgccatgaactaacggtgtttaatggtcgatcagctcgagcttgttcgatcgatcatcgatgatgatgcatgctatataatgtttagctatatacatacatataatccaaccagttcattcagttaattgcataccgaccgatatgatatatatgctgatatatagagttcatttcgggggcagccagctagctgtgggcgggcggagtggagtggtggcaatctatatatcgagttgagctagctagcttaagctaggtgaggtcgcagtgtagcagggcagtggggtgtaccgtgtacgtagtacgtactggtgcatgctggccggccgggatcgatctatttattcatccaacacgtacacgtactgcttatctagtgcatgcgcaccatgccatattgcatgccatcgctacgactattcccaaacacgtatttactccgccccatgtgatctttgcgtccgtacgccccgacgcgtaccgtgcatgcatgttaaccacaaatatgctattgggcacacgcatgcatgcaagaaacacaagcagcgcacattctattcattttatcagattaactggctcttgtttttatccaccccatcatatactccctccgttttaaaatgtttgatattgttgactttttagcacatgtttaactgttcgtcttattttaaaaaaataaaaaatatgtaaaactacatgtgtacatgaaagtatatttaataatgaatcaaataatatgaaaagaataaataattatttaaatttttttaataagacgaatggtcaaacacgtattaaaaggtcaacggtgtcaaaaacattttgagggagtatatcacatcgtcttcgatctcccaagccgcacgactcactgcaccgctgcgcctccttcctggctcctctcccaggccataccaccacctgcatgtaga

SEQ ID NO: 12427 - DNA, 1501 bp, Oryza sativa
gtttcctggcagaatctgtaatttgttttgttattagacaatgtttaatacttcaaatatatgtccgtatatctaaactttacgcccatagatctaaacacagagttcctgcaccatatgtatgtagtgctggcttgatacggctgagccggatgaagttgtgaacacttcctccattgcacgcaatacgaaatgacggttcagcgtatgtctaaataagtattagctaaaaaattcatgaatagaataatatgatttttaaagcaatttttctacattttcttaaaaacacgtcgtttaacaatttgggaagcatgcatataatgaaaaaacgagggatatgaagttgggaaagtagtagactaagtgcctatttagttcccaaataacatttcccacgctgtcatatcaaatgtgtggacatatgcatggagtattaaatgtagaaaaaatcaattacacagttcgtcaggaaattgcgagacgaatcttttaagcataattgcgccatgattcgacaatgtggtgctatagtaaatatttgctaatgacggattaattaagcttaataaattcgtctcgcagtttcctggtggaatctgcaatttttgttattagacaacgtttaatacttcaaatgtgcgtccatatatccgtatatccgatgtggtatgtaggtttttttttccaactaaacaggccctaaagatcacagccgtacaattgtactggagtagtaccttcttgttaattgtcacctgccatctgtatgtttttctttctaccttactactggagtgtattggttaggactcggcaggatctacctctactatacactgttgtctttgtacaaatttaccacaaaaatcatccaaacgttatctcttaatcattggctagataggaaaacaactaatttgtttagtcggctggatgagagagaatgagatgagaacagtaaatttttaattaacaaaaaaatattttaattatcactaatctttccataatcgacataataattaacaacaaaatatactatccatagagagagataggcaaaagaggggagaatggtagagagaaggaagaagattagtcactaacacacggaggctacatgggtcatacgctaacttgtcttgtcagttaaaactggacacgatggagccttggttacaccaatattatgagttgaggatcaaaagtgaacttattccttactattattccgtccgtacacgtagatggcccggggtagaagcccatgccaacgaggcctagatgcggaaatcacaataccgtttgccatacatgtacacgtaaagtcgaagtacgcttcctggcctttggcctgtgggtgtcgtcttctccagaggaacgaaacgaaacctgaggaggtctctcgagttgtcgactcgcagtcgcaccaacgcagcagcagcaactcgactgtagtccttgcgctacctcccgcagccaagcttcctcgccgtcg

SEQ ID NO: 12428 - DNA, 1501 bp, Oryza sativa
cgcgcgggagaagttataggaccgggagagaagaaaaaggagtgagtgagagggaatactgcgcgggaaggagatcgatcgatgcggtgggtgggagatctgtccatcgatttggcgggaggggatcgatgcgccaggaaggagagatcgatgcgccagcctcctttctcgcgctcgcgccaagagggagagggggatcgatctcatggcaaagagaaaggggaaaggggatcggatcagtggatcggcggcctaggagcggtgcgcgcacatgatcagtttttccgttcgtgggccccacaacccgcgttttctagcgcctgcctcggctgcaagcggattcagattgggtgagataggatagacatgtcataaggtgacatagcgtagatctcagctctccaaaataaatccaacggctgagattcgttcacatcatcatgagttaaaatttaactcgtatgagtaaaaattttactggtagttaaaatttcaggagttaaaattttattggagttaaattttaacttgtaatgacgtggacgaatctcagccgctggatttatttcgaaggactgagatctacactatgtcaccttgtgacatacctaccccatgtcatccaatctaaatgcgctgcaagcgggcgctatgcccccaaaaaatgcgttatagcttggcgacaatttagtcgccagctcttctctttcccctcaatcattacccttccacgtagaaataatgtgacgtggcaattattggagctgatgggtcagccctattgtacctgctctaaatgatcaggtgggtttccttgtgcaagaattgttcgtagctagattggttaggcagccgcgccttaaggcctgtgggcatatggttcaaatcccttcgctagcgggcgagtttggctcatttgcatggcattcggttttggcgcgttgctgctcgtttttttttttgccttggttttcactggcgcgctcacggcacgctgtctggaccgacgcttgggtctcccatctcctgcttgatctatttaagacacgccacttcttaacgccacctcttcctcacttgttcatgtactgagccatccgcacatggccgatttatttcctgggttcgatctcaacgaacctgcggcagagcacggcaacggtaatgcatcatttcattgtttcattgtttccgttggagtatgaggaaattagttttgttttttgatattcacagcagtctcatgcaaattagtttccattatcagtgtgttctttcattttcgacaggatttgatttgaacttaccactaagatgaatatggtgcatttgattttgatttcgtacaaaacatcgctggtaagccgtggttattatttcctttctcagtttgtactttccatgtatgattgttttttaggtaagccgtggatattattttgaatgtgcttgttttttttcctcttactagaaccaaaccatcgaaagaaagaaatgacag

SEQ ID NO: 12429 - DNA, 1501 bp, Oryza sativa
cgttaacttaaataagagggacatggatccctgataagtgggacccaccctcatggaaccacacgtcacgaacacacgtccttttgacttaagttagagggaacctcgttgacttgtcatgaacaccttagcttccttgtcctcatctcttcaatgttgaccaagggaggaatcaatgattgtccgccgatgaggtggaaggcctggcatagaggctcgcctccacttgccatctagacagttgcgtcctgcttccacgctgtggctgcttggggtcgagcttagcaccaattggttctccttgcgtcgttgtcgaaaggacccatcctcgccttgacaaacctcgacctccaactctccatgccggctcaccatgggaggaagatcgacggggcggagtagacgatgccttatgcactagtggatcttgcgaggtcaccaccctctcggtgttttcttccacacccccttcccctatcaagctccactccacctcttcctgagcggtcgtggctgccctcctctcctgctcccttcctgccgtagtggatgtcatagagctagaattggaacctctctccaacgatgacgtcgatctgttcttttttctgactgagcttgggagaggagaggcgttgatatggtcaaatgttccccagtgttggccacgcacacttggcatcatggtccaggtacatcattgcggccgcctagctctgctttttaattcgttactgccaacagtggtgcactacttaaaaaaccctcataggtacctgctcataggttctagtttttaaaaaacgggcacctattgacagtttcccacctccatgagagagaaaaatatgaaatcggcacctttgaacgactattggtgcctgttataaattaaaatcgtacctataatatattgtaggtgccagttctttaaaatagcggcatctattataggatccagagagagtgggttcatattgcttgggtacagtgtcagatttagaaatttttttttagcctaggcaaacctaacgatagaaaacaaattaacacgtaaacacaaatacatatagcattttatcatggatagaagtaaaattggggtattagctaatgactaagtatgataattagtgctaatctaatggtgcatgtacgcagctaggttaatggctaggcaccatagttagttctaatgcattgatgcatatgcggcggagcccgggcacctgcccgtgctggccgggccttggctccgcgactgcttgggtagttcttcatcttgtgtagttcttcatcttactagtgttgacctgtgatggatagggatgaggattattgttgttaatctgtgatctgcgatggttggggatgaggattgctgttgttgatctgtggtctttgatggatgaggatagggattattgtggttaatatgtgatattgatgtatgggattaggggctgcttgtaggaggacgctcgaaagcaccggctcaatg

SEQ ID NO: 12430 - DNA, 1501 bp, Oryza sativa
cgtcggctgcgacgccgacgctgcaggcgacgacagcgagagcagcgcgctggcgtgcacccgtaggctctccatctccttgctctccgcttcttctctcgtgattgtcattacaacaaaccaaagaattccaagtaactttctttcgctcttaatgacgagctaaaaattcccttcacgttggcggacgtactcgttttatatatagagagtacgcggttaatatgcgctaatgaggtgtgatagagtcgttcacgtcaaggttggtgcgcgcgggcgccaaactactaactagagccaagcaagcaagccgcatgagcgagcgaggtagcggtaggaggtagctagcgcgccaggcttggccacgaagaaacgtgacgcggtcgcgctgctcgcgtacgtgtgcatcacgtatgtgcacccgtggcgtgccccgactcgggtcggaacgcaacgaagcgctcggtcgcgcacacatggtttatcggttgggctaaaagtttgcttgcttttgcgcgctttccagaagccgatcattcacaagcctcgtcaacttcaggaactcgcttctgcagccgccgtttcaatttttttttaaaaaaaatcttctcctggagcttccgttttcgactggctccaacagagtgcaggagaatatatcagcaagtgggaaacggaaacgtttgccgcgacgtcacctggcagttgtgtgcgagcgaaaaaggaacactacactactctccgtgtgctcacgggcaggatacggatattcgtcacgagttgatgagtatccgtccagtcatcccacttggctgtccatctcgcttaatcgtgtgcgtacattgaccatctatctggtaactgtacgtacatatcttgacgaatcgaaagtgcacgcactggccattccgtcacgtcagtggacggtgcaacaagtcgtcatggacacccgatcgagctaagctagtgtatcgtgtactgataaatattcgcgcgtttgatcgtgggaataaatctactggaagaaaggatagtgtagcgcgcggcggccgtgtagaccacgtcggcgagaggagcatgcgaaccggcgaacccgcgcggcggcggacgtgacgcgtgcggcgccacgcacggggcgtgaggcgtgtgggacaacgaccacttcgcctgtacgtgtggcgaggcatataaaattccggaacgaattgaaatttaattgttcctcctgttgtttcagttgattttctttttccgcatacgtgtatttcttgtgccgaaaggcgaaagcagaatactgccagtacatccggaagctatttgatggagtgcgcttctcgcgtaccggacgcgtgctactgcaagtcggcaaggtagttacgggtagagtgggagtatatacaatccactggtagaagtcaacttggagctttatccagaaactgatgtggatgtcagtcatgctgatgtgagatactactactaatgtcatccccaacctaga

SEQ ID NO: 12431 - DNA, 1501 bp, Oryza sativa
ccctccgtcccaaaaaaaaaggtaaaccctgagtttccatgtccaactttgactgtatgtcttatatgaaattttttttataattcgtattttcattgttgttagatgataaaacatgattaatattttatgcatgacttgtctttttaattttttttcataatttttttaaataagacggacggttaaacgttgggcacggaaaccatctaggttggggatgacattagtagtagtatctcacatcagcatgactgacatccacatcagtttctggataaagctccaagttgacttctaccagtggattgtatatactcccactctacccgtaactaccttgccgacttgcagtagcacgcgtccggtacgcgagaagcgcactccatcaaatagcttccggatgtactggcagtattctgctttcgcctttcggcacaagaaatacacgtatgcggaaaaagaaaatcaactgaaacaacaggaggaacaattaaatttcaattcgttccggaattttatatgcctcgccacacgtacaggcgaagtggtcgttgtcccacacgcctcacgccccgtgcgtggcgccgcacgcgtcacgtccgccgccgcgcgggttcgccggttcgcatgctcctctcgccgacgtggtctacacggccgccgcgcgctacactatcctttcttccagtagatttattcccacgatcaaacgcgcgaatatttatcagtacacgatacactagcttagctcgatcgggtgtccatgacgacttgttgcaccgtccactgacgtgacggaatggccagtgcgtgcactttcgattcgtcaagatatgtacgtacagttaccagatagatggtcaatgtacgcacacgattaagcgagatggacagccaagtgggatgactggacggatactcatcaactcgtgacgaatatccgtatcctgcccgtgagcacacggagagtagtgtagtgttcctttttcgctcgcacacaactgccaggtgacgtcgcggcaaacgtttccgtttcccacttgctgatatattctcctgcactctgttggagccagtcgaaaacggaagctccaggagaagattttttttaaaaaaaaattgaaacggcggctgcagaagcgagttcctgaagttgacgaggcttgtgaatgatcggcttctggaaagcgcgcaaaagcaagcaaacttttagcccaaccgataaaccatgtgtgcgcgaccgagcgcttcgttgcgttccgacccgagtcggggcacgccacgggtgcacatacgtgatgcacacgtacgcgagcagcgcgaccgcgtcacgtttcttcgtggccaagcctggcgcgctagctacctcctaccgctacctcgctcgctcatgcggcttgcttgcttggctctagttagtagtttggcgcccgcgcgcaccaaccttgacgtgaacgactctatcacacctcattagcgcatattaaccgcgtactct

SEQ ID NO: 12432 - DNA, 1501 bp, Oryza sativa
accgactatttctgagtagatgaaaaacagttcagaacaataaaaggtacttactacttgttttaatagagaatcaaatactagcaagtagcaacgtaagacatgtgacagtcaaaatgcagtataccctattcatgactcattaaacttctgatttgtaggtccctttcaaataaaaaaaaaatgatttgtgacaagcacaagtggtcaaatgcaaatgcataccacagtgtttttctggtctggtcagagtttgttagaaattggaattactttaagagcctttctttctgaacatgcacaactcatgctagagaacattggacgagtagatagagcagaaacttcagaagttcattttgaactggcctataaaatgtcagccccatgaggatgaaatactgcagctgatagcatatgtttttgcactgaaggtaagagttgcaggaaactgaactctttctttgtcactttgttagtaacagtttcaggagttcagtttcctccaacatcttatcttcggcgccttaatctgcagtgactgtaaatgtgtggagtggtagcttagctaggcatcacaaaccataatctttgacagttgaatttgaggtttggatgggaccaaatcttactgcagacttgcagattaacgcaagatttggtttcctccaatatctcatgttcagttgtcagacagtgaataatggtgcaattagtgagctgaacgaacaaccttggaagctgaatgtgagagctggatgggaccaaatcttgagcttcagatcctgctattgcaaaagatttggtttcctccagtatatcatcttcacctttcccagatgcaatatgaaatgtgttctgagggttacaccatcacagatacttacagaattttctgtcgagcttcttaaattaattagttaaatcttgaagctagttggcaactagtacaatgccgggttagaattagagtggaatcaattcaatactccgcattcagataaattatcagcagtctgcaggtgcattcaacatttctactctttccattttaaaagaaatagtcgttttcctccgattcttgatcatctgccacacacaaatgtcacattttgctgaaacataggtttctttctgttgagacctgctgactgccgttgccatttgctaatttagttttttttgcagcttaattccatgaaaattgcagataaaaaacttttcttttccattaaaaactgagatcatactcatcgattcaagacaattgctcactgcacaggagcattgctcatttaatttttttttcatacatcctctgaagcaaacacatatactgaactaatcagtgaaaaagaaccagtaaaaaaaactgggtgttttgtgcctgaagcacgaactaaatcaatcaaagtgtggtgtggcaagtttagccaccaaccaaacaacccctaaacaaggcagacaaaaatgcaataattccaaattgaccaccagtcag

SEQ ID NO: 12433 - DNA, 1501 bp, Oryza sativa
cccagatacgacaggtgagacagcccaagtatggtgtagttgattgggcttgcagttgcagaacaagaaccagtcggcatctgccctgccgccgttacctcctccattaaaagctggcgctatcaatcaaacctttgcttaactagcacttcatttgtggataagctcaagagacaccactagtagagcatactaagagcacccgcaatggtaaaataaggtgctatctataaaacatgtacatgtcagcaatagactaaattaatagtaaaccacctcaatagtatgtctacatgggtatctatagctctctaatacattgtctcgtttttctctataaactatctctaggttagtaagatagctttgctcctctcttcatttaatctcttccaagtaggaaaatatgctgacatagatctcttgtaaaaagcctatagataaccattgtgggtgtcctaatgggcaagcctacaacacctcagatagagtcaatcatcactgtaaataaaaattcccagctgaagaaacaaacaactgggaatttctctcccaataaagatgataaaatttttaggtgcacatacagttgtctgtaccttgaatagacggtaccactaatgagatcatggatcaacaatcacgtgtgtatcaggtggttgatctcatcgtcagatcaggtcaggtgcacactgaatcttgcttgactattcccgacgcgtcattctcatgaatctcatccccttatccactccacccaatcattcataaccaccgcccacagaaaaacacacacgcacccaccattaaccaccgccgcagaagatcctaatcccctttcctcccccacggccaaaaccctaactcccacggcccgatccacctcctcaaaaacacccccatcactcactgacatgtgggtccgccgtatcatgttccccacatgtcagtgaaacgtgtggtgagacacgaggtgaggctggcagtgccacgtggaaagaggatagggatgagcggccggccagccggcccaaaccaaaaaaccagcgggccgagaaaaaggataagcccacaggacacgcgcacccccatgacatgcggggcccacgagacgtgagccccacggcgtgtcgggcgcgggcgggcgacgtgtccccccgaatcccaatccgcctccgtataaaatgccaccctccctatcctttctctctcatctcactcactcgctcggagagaaaaaaaaagggaaaaaaaaggagcgtagaaaaaaaaatttaccactcgcctcgcctgcacaaatctcgcgcacgggttggcggcggcggcggctcaggctcgatccgcggccgaaaccctaggtacggcaacctccgccgcggaggcggcggcggattcgagtccccatttcggcggcggccggtgctgatgcgtggtgtaattttttgggtgcaggtggtggtggtgggattaggagttgaggtggggatggcgtcgccgagga

SEQ ID NO: 12434 - DNA, 1501 bp, Oryza sativa
ttttttctacgctccttttttttccctttttttttctctccgagcgagtgagtgagatgagagagaaaggatagggagggtggcattttatacggaggcggattgggattcggggggacacgtcgcccgcccgcgcccgacacgccgtggggctcacgtctcgtgggccccgcatgtcatgggggtgcgcgtgtcctgtgggcttatcctttttctcggcccgctggttttttggtttgggccggctggccggccgctcatccctatcctctttccacgtggcactgccagcctcacctcgtgtctcaccacacgtttcactgacatgtggggaacatgatacggcggacccacatgtcagtgagtgatgggggtgtttttgaggaggtggatcgggccgtgggagttagggttttggccgtgggggaggaaaggggattaggatcttctgcggcggtggttaatggtgggtgcgtgtgtgtttttctgtgggcggtggttatgaatgattgggtggagtggataaggggatgagattcatgagaatgacgcgtcgggaatagtcaagcaagattcagtgtgcacctgacctgatctgacgatgagatcaaccacctgatacacacgtgattgttgatccatgatctcattagtggtaccgtctattcaaggtacagacaactgtatgtgcacctaaaaattttatcatctttattgggagagaaattcccagttgtttgtttcttcagctgggaatttttatttacagtgatgattgactctatctgaggtgttgtaggcttgcccattaggacacccacaatggttatctataggctttttacaagagatctatgtcagcatattttcctacttggaagagattaaatgaagagaggagcaaagctatcttactaacctagagatagtttatagagaaaaacgagacaatgtattagagagctatagatacccatgtagacatactattgaggtggtttactattaatttagtctattgctgacatgtacatgttttatagatagcaccttattttaccattgcgggtgctcttagtatgctctactagtggtgtctcttgagcttatccacaaatgaagtgctagttaagcaaaggtttgattgatagcgccagcttttaatggaggaggtaacggcggcagggcagatgccgactggttcttgttctgcaactgcaagcccaatcaactacaccatacttgggctgtctcacctgtcgtatctgggccgtgttataggccggcctgattaatggcccagtagtcagctcagaactttgttcaacttagatcactgtaaatttgtacaggcaactctgtgcacctaaaaactgacgagatcagatcaacttcagtgaaaaaaaagggtactaattctaattaatctttgttatctgatactctaatcaaattaaccacaagtataacccagatcaaagtgacagaaccaaaatcgcat

SEQ ID NO: 12435 - DNA, 1501 bp, Oryza sativa
taggatctaaacccagtttgtacttctgtaccgtgcactgcggatgcttattttggaccgtgttaattttttgagcgaaagcactgtgatgataatgaatggtgaaatgtggactcttgttgatagtgaaaaggttggaccattgacgtgtgtgatcgtgatttagtttctccttaatttggggtgtgcattatattattgcagcacctcccactctgcacctctgtttctgcaaaacaagaacaaatgttgaaatgattccccttctcatttcggaatgctgtcaggaaacaagaaatctgaaatagcttgttgggaggagcacggctaactgtgaaactacgttcagacattgcttctgttttctcacaatcaaaaaattatatttctaccatcgaaaaagaaagattcgctacggtaccataacttaagtatgcttcagaaaataccacactcaaccaaaacgacttcgcaagaataccctggctcctcttcttcctccttcatgcgccgaagatgctcgacggcaacgatcggtggacggcaacaactgcacgtcatgggcaccagcaattaaaaaaaatagcaaaatcatccaagattaatctcctttgtcatcgtcccaattagcagtgatgaatgcaaattacatggcatgaatcaacggaaattgattccggcgaaagaggaatcaatctcaggagggatgacagaaaaaaatcgatccagccggatgatacaatcatacgaatcaaattgtcagcaacaaatagaggagttccatgtagcaaactttccctctggttgccttctgtctgcccccaagaggaactgccgcctacgcttgccgctcgttttgttgcctagtacaggaatcgccaccgccgccacctgatgctcgcattcgcgaatccaatcttttgcgatggtagatatgcaattagatcactccataactttgataaatcttctataatagccaactaaaccagaaagcctctcaactgagtgacattagtgagttctggtcaaagttatacagcttcgattaatagctaataatgtagccccggtattctacttgctgttgactgaacacacatttacttgattatgcaaaaaaaaaaaccctagttagaccttaaaatgtccaaaatgcatgtatcacatgttcttctatggtcttagaatgtcatcaaaagatactagcatatcttttctcaagataggagccaacaccttattcatgagaacatgagatgttgctggggctttgtgagaccaaaaggcattactatggagtttatctagcaggtctttttataataagaatgagtatttgttcttagcatttaattgcctataatgaatgcatagtctcctattcctatctttttctttaccaagatagtatcagatgaatatcgactcctatctttttcttcacctgatttgctcttttggagatgctctttagtaagaacccagagtcacaccaatc

SEQ ID NO: 12436 - DNA, 1501 bp, Oryza sativa
ctttcgtccaacgcactacacgcccaacaaccgggagtgtgcccgatccacacgacacgcggacggcgtacgcgtgtgctcttatccgaaacgccgccgtttccggatgtttgtgttacaaccttatcgcagagaccgatcggtgggtgactgatgaatatccctccattattttactcaggtatatatactctttccgtcactaaatatttaacgctgttaattttttaaaacatatttgatcgtttatcttattttaaataattactaattattttttattgttaaataggacgaaagttcataacatgtttgaaaaaattgacggtattaaatatttaggacggaggactatatcgataagaacacgcgcgtacgcctcgtccccacgtacgtcgcgcgcacgccggcgacggcgacatgggctccgatccgcacctccccgcggagcaggaggaggaggatgcgcgcgaggccgctgtggatggcgacgacagcacggtgtgacgaggttagcagcgagcgatcctatctaaactgcccaaacccaacagctagcgtctagcgatcgatcgaggataaaaattctagaaacgtacgtacgcaccgtccgtccgtccgcgtcagcgcccacgcacgacgcttgcatccgccgaactgccggttgatgcgatgcgatccccgggcgacgcgtcggtccaatcaagttgccgcgcgcgagctgctagtaggtgataaggccaggcacatataaaaacgggtctccccatctttccatttggcaattggctgcacaagaagcagcaagggagtgactcggagtcgtaaaggcgaatatttagctgctactacctccgtcccatattacttgtctttttttgagtttttatttgtcaatatttgatcatttgtcttatttaaaaaaatttgaaattattatttattttgtttgtcatttgctttattatcaaaagtactttagatataacttatcttttttttatatttatactaatttttcaaataaaacgaatggtcaaacgttacaaataaaaagtcaaaaacatcgcctattataggacggagggagtaggacagtaggactgaacatactacaggtattacatatggcaatgactaatgacgaatagacagatttcgttttaaacgtggggaaagttcctcgattcctatatttaactagccagtttaaaattgaacgaaccaagttccacttgaaccgaatcgttccatatcaatggttcttttcataacagtggtccagttaattgtctaatgcataattacttctataatcttagaaggtatctactccttgatggatgcaagaacatttcatttgtatgggacagctgcatctgctattgtgcacggtgactactcattgcagctctacgattttttaaggggaaaaaatagcatgcttcaatttgtacagtggccacacacacacacacaaacaaaaaaaaaacagcaatca

SEQ ID NO: 12437 - DNA, 1036 bp, Oryza sativa
  unsure (1)..(1036): unsure at all n locations
tggggtggaattganancctgatattcgagctcggtacccgatgtcgcgattccggtatttgcatagtatggggatcgttggtactaggatatacgctagactgagataaaagagatggggacaaggagttttatacagggtcgggcccctgaatggtcaagtaataaccctacatcctgttggccgaagccggtattgctcttattcaccataatcacaccagtacaatatttggggtagcctatataactgttgtcgacatggcggtctgaagatctaactcgtagtcaacaacaaagtagtcttcctcctcgaatccgtgcccggcgagatcagagataacgctttcgtctctcctgacagtatccggagacaccgtaggggactagccgtgcttatccctgaagtcgatatccgacgtcttgtcttggcgtatgttggcttgtatattgatcttctgtcttgatctatgttccgtgtcttctatggtggatgttgattgtgtcccctctcctcctaaggggccttttatttatacccatatgtgtccccttgtccaagtagaactagggaaaccaatatggatacaattcgagcagtctttgtcgtttccatgtagaactttggttgtctttccttatccggaactccctcgaggtcagtttccgtataagacatagtatgtggtgggccctaccgacatggtatgtggtttccataaccctgacaaggatgtagggttattacctgataattcaggggcccaaacctgtataaaaattctcgtctgtctcttttacctaagtctcgcgtatatcctagttccaacgatccccataccatacaaatacctcacgcgcgcgctcctttggtgtcggtatatcctaagtctcgcgtatatcctaagtcgtcgcgtcccgccacatcggcatttcgacaaacacctcacgcgcgcgcttctttggtgtcggtcgtctgcctcgcggcgggctgcaacgtcgtgacgcgctcctcctcctcctcctcctcctccca

SEQ ID NO: 12438 - DNA, 1501 bp, Oryza sativa
tgtggccagccacaacaaaacgaacggtttgtcgtaaccatcatgcatataatttgttcatatcataactacggtttatgggtcgtgcattaagaccacactgaccaccagggacggatctagaaaaaaataatagtggaagctaaataaactatatcagtataaatcgaacctccagtccccacatcttatggatctatagaaaaaaatttagtgggggcttaggggggtctccactgtcccgggaacggtagtggggtttcaagacctctccgcccccattatgaatccgccccgctgaccacctagctagctttcaacaaacgaacttctagaacaactttcaaatttaaattaccttgaacagacaagtatatttatgcgttattgtcccatttgggaaatgagtatgttttaacagccattagaatacacgttggttatttcctcgtcacatcagagggtgattgagaggcgtgacagctgacaagggggtgcacttgatcaggaagaaaaaaaaggggtaccacgcagagggaaactattttatactctcgagaggatattttttttgtcatttacatgtcacttaaatagctataaaaatatttgaaaaaaagagaagatatattaatatgtgatatatcatttcacaaacatacaacctaaaattcaagttctacatgttgccaaaaaaaagacaaattaaactagttaacgtatatttacaatcaaatctttttttgcggcatgtaaaagttgaattttaagttgtatgattataattatttaagtgacataaaaaacaatgaaaatatctagagagtttaaaatccactctagagtgcaagtagcaaaggcgggaggactatatatggtcgcttaaccctcccttcagttctattaaaaaaaaactctccttcctcacatagagaatcaaacggtccatgatgctctatgccgatcggacggtattccctacacgggaactgaagccattcacggtaggatagcgattttggtcgaggggcgacaacatccatatcgacggaaaggaaacggccgaaccacccaaaaggccaacatgaatcacatgccgcgacgcctcgctccaaaaaccgcacaatcccgtaaggcggccgacccccgcgtccttggtgcatcgaacccgctccaagtcctgtacctcgccgtacgtcagctccccccttattttagcccccggctcgatcgcaacttcacatcgcgcatccactccacaccacacgcttcactggttccgagcactcgccaccgatacactccagtggcagccgagctagccgagagccaagcaacttgccgtggccaataagctcccgtgagctgacgtctcgtgctcgacggctcggcgctatatataaaagcgtagtaagctggtaaaaaattcacaaggccacgcgcatcttgtctcggccaaaaaaaagagagcgcacacgcggttgatttgtttgaccgacgc

SEQ ID NO: 12439 - DNA, 1501 bp, Oryza sativa
ggttttagctgatgtgacgtctatgtggcggtcttggccgggtttttgtcctacttggcattataataaaataaaaataaaaaaaatatgtgggacccacatttcaccctccctctcctttccttccttcttcctctccttcctacctctcccttttctctctctctcccccttctcttccctttgggcgtccacggggacgggggcggcgagtggggatttggagacgaaacacaggggcagaagcgtaggcggacgcgacgacatggggcgagcataggatggggatagcgatgtgatgttcgattcatgaggaagacaagtggtggtggttgggcggctacaccgacgcgcgtgtgttgtggaggagcggtggcggcgccgacgcacataggagtggggcgctgccggcaaccacctctgccctttgcgtggaggaggaggcgtcggtggcggagggaggcaggaagcgacatggggaggatatgacggggacgaggaggtggtggcggcggcggcggcggccgatgctgtcgccgggggtgggggcgggagcgggagcgggagcgggatggggattgggggagggggacggggaggcggtgccgccgagcttgtgggcgcgctggtgtggccgcgtggggcggagagaggaaggaaggattaggaagaaagaaaggagagggaggatgacatgtgggtcccacaatacatttttgtgtggacgatatatggtcccacaatttttttatttttgttttattacaataatgctacgtaacgtaagcgccacgtaggacaaaaacccggtcgggaccgccacgtaggcgccacgttagccaaaatcaccaagggacatagtttgcatcggtttaatagttggaggagtcaatatttccggttttgtggttggaggactgtcatggttatggataccacataattaatagtagttgactaagctcggtagggcccaccacataccatgtcttatacggaatcatacctcgtatacataaggagttccggataaggaatgacaaatagagttatatatggaaactatcaggactactcggattgtatccatattggtctccctagttctacttggacaaggggacacctatgggtataaatacaagccccctaggaggagatgggacaagcaacaacaacaacatatcgacacacgattcacaagctaacatgtgccaaaacaagccgccggatatcgatatcagagataagcctagacaaacccaatatggtatctgcagaggccaacaagagggatctagtgctatctccgatctcgctgagtgcggacttgagggatgactaccctgtcatcgactacgtgttggttatccatgccgctaagtcaacgacggctacataagttatcctaattattgtactgatgtgattatgatgaataagagcaacaccggcttcggtcaacaggagtagggctattacctgtcagataaggggcccg

SEQ ID NO: 12440 - DNA, 1501 bp, Oryza sativa
attgactcctccaactattaaaccgatgcaaactatgtcccttggtgattttggctaacgtggcgcctacgtggcggtcccgaccgggtttttgtcctacgtggcgcttacgttacgtagcattattgtaataaaacaaaaataaaaaaattgtgggaccatatatcgtccacacaaaaatgtattgtgggacccacatgtcatcctccctctcctttctttcttcctaatccttccttcctctctccgccccacgcggccacaccagcgcgcccacaagctcggcggcaccgcctccccgtccccctcccccaatccccatcccgctcccgctcccgctcccgcccccacccccggcgacagcatcggccgccgccgccgccgccaccacctcctcgtccccgtcatatcctccccatgtcgcttcctgcctccctccgccaccgacgcctcctcctccacgcaaagggcagaggtggttgccggcagcgccccactcctatgtgcgtcggcgccgccaccgctcctccacaacacacgcgcgtcggtgtagccgcccaaccaccaccacttgtcttcctcatgaatcgaacatcacatcgctatccccatcctatgctcgccccatgtcgtcgcgtccgcctacgcttctgcccctgtgtttcgtctccaaatccccactcgccgcccccgtccccgtggacgcccaaagggaagagaagggggagagagagagaaaagggagaggtaggaaggagaggaagaaggaaggaaaggagagggagggtgaaatgtgggtcccacatattttttttatttttattttattataatgccaagtaggacaaaaacccggccaagaccgccacatagacgtcacatcagctaaaaccaccaagagacatagtttacaccggttttgattgttagaggagttgatatatccagttttgtagttggaggatatgaatcatattcaggcgatagttgagggaatcgaagtatacgttttcctttgaaatacttcagacctttgttgggccttcacttcccatgtttggactctcccacaatttgggccatatcagatgggccctgtattaagcccaacaagaccgtagcccaccacgcgccgtgacgagggccccggtttgcttagcgacacggcaactactactaaatcgtgcgggcccacctcgcagtgtcccaactcacacgcacaatgcgaccgcgaagccgcctccgctaatccacctatttttattcttctctcccaccccaaaatccccaaatcccgacccgatcaaaatcgaagcttccgccgagttccccgtcgccgactcgcctggatcggcccgccgtcgagctcgcccccgaccatccgctcgattggaggccggggagctgcgtctggtggtgaatcgcatccgccgcggagcggttcgatttcggcggcggatttcgcgggggtagaggagatcgaaggggggcagagcagcca

SEQ ID NO: 12441 - DNA, 1501 bp, Oryza sativa
ttttatcatctaataataataaaaatattaataaaaaaattaaataagactgatggtcaaatgtgggggaaaaaggagcttataaatgaatgtatttcgggacagaggctgtagttaaaatcaattcttgtgattgcacgccgcggctatcatctcatcatttgtacccgtgacatggatacgcgatccagtacgtacgtagtacgtcgccaacgccggatgcaggaaaagctggcgccgcacggcgtgaccgcgcgcagcggtgcgtacgtacgcgcgcgcgcgccgcctcgcaccgctctccgcttggcccggcgcgcgcagccgcaggccgcaggccgcagcgtgcgtacggcgagggaagcaaagcgtggaccaaccgaacacacgggcgggcgactccgctcgccgctcggcctcgcccgcgcgtcacgtaggtacgcatggcagattggcagcggcatcgtattcgatctcgcccccaccgcgtcgcgtcgccatccacccccaaagcatcccgcatcccgtcgtcccccgtgctctctctcttccggctcgatcggcgaatccacgcgagaactaacacacacaaaagacacattgacccatcattactatactaatcactttcataacctaacctaaatcagagttactcctccgtttcatattatatcccattttaactttttactagtaaaaccttctcaagtttgataaaatttatagaaaaatctagtaacatctacaacaccaaattagttatatcaaacttaacattgaatatattttaataatatgtccattctgtattagaaatattattactccatccgttccaaaatataagtatttttagaatattgacaaatcaaatatttttaactttagctattaatagaaaaaaaagatcaataatgtaaaattaatgttataagatttatcattaaacaaactatcataatatgtaactctttttatttaaatcatttgatattgttggtcaaataacatctcggagactgtgtcagattcaaaagatgcttatattttgggagggggagtatttttttacaaatttaaaaatatttgactggagaaaatatcaaaataactttaatgtgaaacggacggagtagttaacaacccaaacgcaccgaccgcgaccggtaatctcatgcatccatccatccgctgcatctgcaattctgcattggcagcatctcttctcttttctctcctcctcgctgtttcgcacgcacgcaccgcaccacgccgccgtttatcaacgactcctttttaccgcaaaggtttcgtttcctttttcctccctctcgtcgcggccgcaccccgaagcggaaggaaggaactccgagagcgccatccatccatcagcaccaccgcgcgcggggggcgtagtggcggcggcggcggcgggagtcgccggggagatgtgagagggagaacgacgtgggggccggagcggagatggctgcggcgg

SEQ ID NO: 12442 - DNA, 1501 bp, Oryza sativa
tatgcacgtttaagttgcagtagtattcacaattatttatttttttcacgacaaaaaataactggagtactgcatacaagaaaatgatggctactctctccgtcaaaaaattatagcaacgatagtgtctaatctattgataagttgttatattttgggactgaagaagcaagtagcttcttacatcttacacgatatatcatgttgtttccattgtctgagggaagagaaatcattggttgaaagtttcatacgccctgtttggatcttgctatttagaagtattaaacatagatgctacagtaatcatccgctaagtatggattaatatacctcgttagattcgtctcgcaaaatagtctaggggttatggaataggttttatcagtaatctacatttaatactcctaaatagcaagatatcggagggctatttaatagctgggaggataaaaaaaaaggagatagtacacacacaacattgctgaaacttatcttggtgaaagattatcaaatcaactcgattatcccgtggttggtagatcgagtcagtgtcaacttgatcgtgacacgaacgtcggatgagacgatgatgcaggtcttttttatcaggaacacgaattgtcacacggatactagaagaaccaaactgctttgggaagtcgcgacagcttcgtttaatcattttttctcctagtgtatagtagtagttctttgtttgttggtagttttgcacatatcagcttgatctaacccagaacagtagaaaatgcaggtggtttcccttgtaaggttatgacatcttcgtgcttgcggcagctgccagaaagttgctttcccaagcacctgttgttacagtgatagcttcacagaatttttttgtcaatttacactttatattcgggataaattatattaaccgacaccgacgtgatattataattttcacgccaatttaacatggtttcgcgtgtaatttaatattttcatgttagtatttcttttaatcggaggggaattccacctccatttttattatcagaaataaggtgtttttcgcgccacaatcaccgtaacgacaaaattgtttccatattagatcaaatcaccttaatattcttcaaaatgctttttaaccagtgggttttatttttgttgtccataaatcgtttgtttctacatgggcaattaatgtatggttggttcccaaggaagacagatagaagccaatggattcaacgccagccatctgatgtcctctagtactcctacaacaagcataggagcagagtcagcagagcttttgactgacacagccctttctcaccttcagtaatcagctcagacttcagacttcagagatggagtgatgctgcaatgcaaagcctgcaagaaccaaaccgtagctcatagcaattgtaccttctcctctcagaaaagaataatttttagctagaactatgaatttggaaataaaggttgtgtttagttcacatcaaaa

SEQ ID NO: 12443 - DNA, 1501 bp, Oryza sativa
taacaaggctattgtcggccatggagtgcacgagcggcgggggagaggagtggcgtgcaatgcggtggcaggagaggagaggagctcagacttgttgtcggctagctcggtcggtttggtctctaatccagatttcttcgaacatttgttcgcctaggattgtgtcacatatgtttgggcaatggactttgcgacaaaccaaatagctcagacatctttttcttgtaggggcagcaacaacttattgggtcacttggctttcgaggaatgattatgggttttgaaagcaaatatgtttcttctcctttgctagttattttcttggttacacattagcttcgagcatgggctattctccagaagcccggttcacatagttttgtcacttcggcttgtattcatttggagcatgtggccaatgagtttttttttcaccttggtgcatgggtggcaacatagttttcaggtgcaaggttcttgaaccttagtttggtttttattttctttgtgtgtgaggtgtgttggttgtgtgcactttcgtagtgtagaggctaggagtgtccttaaaaaattttgccaagttcaataaatcttccattatcttaaaaaaaataatgtcctttttttttcatttttactaggtttttgcaacttgtcctgagtgatgctttaattgatttaaaactaatctgagtgctacatttctttaaactggtatcaacatattggatattttgttaagggttttttctttgttcttacttcctccgtttcataatgtaagtcattttagcatttcccacattcatatcgatattaatgaatttagatagatatatatgtctagatttattaacatcaatatgaatgtaggaaatactagaatgacttacattgtgaaagagagagtaccaattttaggttaatggaaatgagtgaatgggaatagagtttatttgagaagggtgggaatggatttaaattgaaggtatacgtatggttttcattttggcattgttttgcatctcgtgctaagggcctattcggctgccggagttgcagctgcgccgcaaccaactagtacagtctgacaagctccaagatagcaggggctgcaacagtcgcagctgcagtcccagcttgccgaacaggccttaagtttgtttatttgagtgaatgggaatagagtttctttgataagggtgagaatggatttaaattgaaggtaaatgtatggttttcattttggcattgttatgcatctcgtactaagtttgtctattttgaaaccaagagagtaagtcagtagtgtggattctctcgtgtaacaatgcactcttttttgagtcggtagaagtaatttgcaacatctcggttgcaaatgttacttattatattatccctctttcaggttcttttagtgaattgcactttagaccatcttttattaccttaattttactttggatcacctcgactctctttaatatccatcctatac

SEQ ID NO: 12444 - DNA, 1501 bp, Oryza sativa
tggctctcctgcttcctctgcccccttcgcttctctcttcggccctcgggcctcgtagtcggcgcgtgcgaaaatatcgatgggccgtattggcgcgttgggtccacagcccatgtacacgtttgcctctgtacaagtaggaataagttcaccttcaatccctcaacttttacactgagtttgtttgacattccttatgctcaataccagaaatcttcacccctaaactatatcaaaccgtccaatttaagtcccatggtaatatagatgcatagatttattgacgtggcagcctagtcagcaaaataaaaataaaataatatgtgggtcccacatgtaagtgagaaatttttcttcttgtttttttcttctcctctcttgagcaggtgcagcggcaggcaaagcgggcgcagcagcgggctgctagatccgcgtgccagtggtgcccgcccccctcttcccaagtggcggcttgcgtccacaaacgtcctccagttggactcataggcaaacgcacccttcaccgccgttaggaggcctaccttccttcactgcgacggtgggcaaagcgcggcggcgggaggcgactaaggcgggtggaggtggaggtggaggcaactcttcacatctcaggagtggaggcgacgggcgaccgccttggcgaaaccctatcgcatggcgacgagttatgcggcttggtcctcggcagctttgacagaggcggggaggggggagacctagatgaagtcgacgaagacgcatacggcggcggtcttgtcgatggaggatagcggagcttctggatgaggcgctccaagccgctggcgtgccatccgcctctctctctccctatcctgctagcgccgtcgtgccaaccgccagtgccgtcgcgtcgtccgcctctctccccatctcctgtcaacaccctccctctaccccttctaccgctggcgcccccactctctctagccggccttcctctctctaagaagatggtcccaacaggtgggccccacatctttttctcgcttcacctacatgtgggacccacatacttttttattttgatgacatggatgccacgtcagcaaaaacatgtatctatactgtaatgggacctaaattgaattgttttatatagtttaggggtgaagatttctgatattaatgataagggatatcatacaaagtcggtgtaaaattgagggatggcaggtgaacttattccgtacaagtatacaacgtagaggaataagttcatctaaggtcctttaacttgtcaacgaatccgattttcgtccttcaaccgaaaaaccagatacaacgggtcccttaattattaaaaccggtgcagatgaggtccctcggcggtttagatggcggttttggatgacgtggcgcctacatagctaatttgactcggtcttcatctgacgtggcgcttacgtggcaatttaattcagaaaaataataaaacccattggacccacatgtcagtttc

SEQ ID NO: 12445 - DNA, 1501 bp, Oryza sativa
ctttcaactgttttttttttctttgtcgtcacactcagttgatcaatgatcgttcactatagtgatgaaaatagttgaaaaaggtctcaaccattttaataatcgtattttataaaaaaacaaaatcaaatatggtaaagtcagaagcgaaaacgatattagaaatatcggaaaactggaaacataccatacagacggaaacatatcggtattgatcggaagccaataataaatatcaaaaatattgaactgtaaaatcgtatatttaacttttcactatataatatgatgaaataaattcaaagttacgttaagttataatttgtctcttttaaccttacccaaagttagagatttagctgagaagttgatagatctctaaactatggatcaaataaagaaatagactataaatattaattaccataatataaaaaacaattattgccataagaatgtggtaaaagtcgagaacagtcggtatgaaaagaaaattccaatttcatattttttaccatttcccttctcgtttctatcggcaaccattttcacgttgctcggttggtaaaaatggaaacgaagcgtcggtcaatcgaaacttttcgtgacaatattcagttattcacccctactcactagcacgtgaatataacatggctgtgcaacaactcgaaagatggatgggcgggtggctattgctactccatcaatttcacaatgtaagtcattctaacatttctcatatttatattgatgttaatgaatccagatagatatatatgtctagattcatgaacatcaatatgaatgtgggaaatgctaaaatgacttacaatctgaaacgaaggaagtacttgctaagggtactgatcgccgctgctctcaaacccgtcgaactgagctgcccggcccgcggctagtgcacagtccacccatggtttggttccattatttggacgacacaatggggagtgacctttagtcctttacaccattatgcttcggaaaaagtccacttagactcccttaattatttaccggatctaattcgtgacccttaactagaaaaccgggtaagacgactccccgaattagtgaaaccagtgcaatttgacttctccggcggtattggagggtggttttgctgacgtggcgctgatgtggtggtgctaacccggtcttcatgccacgtggcgcttacgtggcattagagttaaaaaatatatatatgggactcatatgtcattcaacacaaaattattgtgggacccactgacacgtggggcccacatgtcatccttcatcatttcttcctcctccctctctctcccttctctttttttctccccattctctctttcccttccagatcagcggtggaggcggccaggggccagagtggcgacggcggcgcgcggacgagggctagagcggtgacggcggcgtgcaggcgacgaccgtgccaccgcctgccccgtctccaagccggcccgccgccgct

SEQ ID NO: 12446 - DNA, 1501 bp, Oryza sativa
cggagatgacaagaagacggcaactcaagcaacaacgaataaggcggaacggaacacatggaaaggggaaatggtaatacagaagatgaatagaaatcctaaccctaagcactgcactcaccattttgttcaacaaatcatgaattgggcatttcagattacaagtctatttacaatattcaatacagagagacaattgttgtggtaattattgtatggaagctatttgatgttattaattgcaaatcatgataaaaaaatgttaattttcaagcaacacgtactttctgtcaagtatgttacgcttgcattgtatgatggtagtacaaatttaagcttattattataattaacatgtagacacatctaatggagagaaggttagagttgcacaaatatacgacttaataaaatgctagtactatgtggaagacgcacacgcaccacctcacacacataacacgtaccgacgtacgtatgcatcaactaatgtgcccatttaacacacgtaagaattataaatctgttgacacactaaactcctaattatgctaacgatgattcactctagctttttactttatgaaaacaagtgcaattgcctgtacaatattcagaatataatttccacttcccattaatcgaccaaattttgattaccactatctgcacgtgtccttcgaggtatttagtacatgatattaatattttaatattgctacaacaatatactccactcaagtgtcttaattgaaattaaatcatacattcaaatatacgcagacctttcaactaattctcaaagcttttttccaaagaacaaatttcaaatacccaacaagtataaaatgttataggtctgcccccaaaacccactcttctcagtctcctcaaataatccatgaaaaatatagaaatatggagtaaatttcagtctcctcagccccgctaatttttttttttttgctatatgtaaataggaagggtggttgtagctttatatagtttattcagacccctattatcccctcctacatctgccactgattaaaccctcccagttcctcggtggcagcggtagctagctttgagcaaagctgggatccaacaaggaggaggtccaggattcgcatgagacgatgcggtcgacaccttcctcttccgccgatgcacccagcggcaaaatgttgtggccgacttggtcgctgtcgaagtgtcgataccgtacccgcccgccacctctgcgcctacttgcctccagcagcgctgttccgcggcgcagtcccgacgatggtcggccgcgcgtgcgcctcccctgcgtcccgttgtccccgtcgcgcctcccctttgtgtccgcccgtagtcctggcgacggtccgcggcgcacgcgcctccccttcgtgccgccccacggtcgccgccgcctgatacttcatccctacgtcgcgtcgtcgccgtgcctccccgtcacctgttcgtgtcaccgccgctttgttcgtgc

SEQ ID NO: 12447 - DNA, 1501 bp, Oryza sativa
cgccattcgcagctaccagctgctccctccctgtccccgccgcccgtgagatcccgccatggaggtgagcgccgcctctcgtcccctttttttccttttcttttgtttctttgttttgtttgtctctttcgatttgatggttctcggcggaggaggtggcgttgtagtgtttgccacccctggccttctccagccccgtcaccccgaccttctccaacggcctccacatgaccccccgcgccagtcgcttcgtcaccgacgacgacctcacgagccgtcggagaccacgccggtaaccgcgaggatgaggatgacgagcggcagcgcgggccgccaccgccgttccactcgtcctcccattgccgcgagtcgccgctgccgttcccctcgtcctcccactgccgccagtcgccgccgtcgttcccctcgtcctcccactatcgcgagccgtcgcggcggagccaccgccgccctagccgccgaccgccgcccctggtccggttctgatgtgccccgatgccgccagccgccctcctgcccgtcggccgaatgggaagaaggggatagaaagagagagaaggaagagagggaggaggaagaagaaagggctgacatgtgggccccacatgtcagtgggcccacagtttttttgtgtgaatgactaatgggtcccacgtatattttttaattctactgccacgtaagtgccacgtcaacgccacgtggaccgaagactaggtcaatatctacatgtaggcgccacatggtgccatgtcagcgaaaccgcccccaaaaccgccgagggagtcaaattgcaccggtttcgcaagttcggggggtcgagatttctggtattacggttgagggatacgatttagattcggtggtcagttgagggagtcaaagtgatcttattccctggcctcgtcgatgtgtgttggagtccagcttgattagcgaaatgggctgtgatcccgctggactgcacatatgggccatgtgtctcaagcatggcaatttgggcccacaattgggtctagatgattaatgggccggtctaaatttcatgaatggaagtcacatttgagcccaacacgtttctcatggtccaaatggccctaggcttgcactctagatgacagcaattatatttgggcccatcgaatcttcctgtggatgggcccaaatataattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccatatatcgatctttctgtaatccctccttattacatgaaaatggagaaagttttggatggatg

SEQ ID NO: 12448 - DNA, 1501 bp, Oryza sativa
acagagggagcggcggcgccggtggctgccgggctcggagcagagggagggagtggcgacggtggcgcgagggccctcctcatcgccgacccaacgcttccccttgttaacgaccaaatttggtaatatcagcatcggaaaagaggattagatcgaagtggagtcgaaggcggagatcgattcgagaatagagcaagaatcggctggagtccagatcggctacgattaggatcggctggatccgagtcggactgagtaagttgatatagccgattctgataatacgacttggtatacgatatcaggttgaattaagatgcttcaagatggttgccgcacatggatagagtcttgagaaggcaattgtatctattaattaggacattttatgtaatttccttagagatatgtttagggaaaaagtctgccgcaaagacttatggtatcttagagtttgttagagataagagtcgtgtccgatatggacatagtttgtaattttcgggtataaatagaccccgaactatcacgcccagaaattcccgaatagaattctaagtagaatgtgcattaaaatccccgtccattaccggccggggtacacaaacgacaaagttaacatatagatccacgtcttacaaatattataaaagtcttacataaatgcagcggaaaattaaaagataactggagctaagccttgacttggactgcagcgggaacaccactccacaggcattctcgacggcacggacgaagcctactcctcagagaaaccaccatctgatgcatactcaaactctgggggtttggggaaaataaagcaagactaagtacaaccaccgtactcagcaagtcataccggaacagggggtatgatgcaggatattaccaaaggatagctagagaggttcttttgtataaagcgagcatttataaacagtagttgaaagcaggaaaatcaggtgtaataattaatcaatattaaccatccactgtccaacgctataccacgttgcaacaggcccaaccaaccacctgaactaatcagttccatcagactaaactagggtgagactaatcacggtgaatctcgttgaccgcccataactgcggacacggctattcgaatagttttactctgatcagaggtgtacaactgtacccacaagacacagccccacgacatgtttccatacgccgacatgccaccacgacataccggaaagaggccgtgacaggactcttcgcataaccccatctagccaagcacaccacacctcaggtttcacccccgtccccagcgggcaacgggcagtcccctctcgtgcctaggagaatccggaagcaacagaggccgtcgcagggcccgcccggctccatcacgcccacccttgcctggatgcgtcagctagaggaaagctacactacaagcccagccgttgcccacgctagcttgtgataagtacgtggaattcttccaggggtttcccgcgaaccg

SEQ ID NO: 12449 - DNA, 1501 bp, Oryza sativa
taggtttggaacttcttatatacgtcgtaaactcgagttgggccgaaaaccaaaagaccgaactaccgaagtaggcaggcaagcaaacgtgagcttcaaaaagagttggttgtcttcgtgttgtgcacatgggtctggtgacgctactcctgaaaaaagcttagcgtggttttttttttttttttgtcgtttctgattcgctaacttcggctccagcgaatgcctgcgtatcagacgcacaagggggggtatacggctagtcactgaccggtgagcctttcttatcaggtaaccgatagttgaatgtggtttggtagtgatacagattccctgaaaattgtagtgttccgtgaaatttactcaatggaaagtggccaacataaatattaagacaaaatgaacttaaaaaaatacactcttaataaaatactccatccgtcttgtaatatatgggattttgacattttgcttgcactgtttgaccattcatcttattcaaaaaattttgaaattattatttattttatttgtgacttactttattatccaaagtactttaagcacaacttttcattttttatatttgcacattttatttgaataaggcgaggggacaaacagtgcaagtaaaaagtcaaaatctcttgtattatgggacggagggagtatattatatgcttgtcctaggctgacacgccagtcccactctctccatttaaaccatttcccctttccaagctgcaattgacatcttgatcggttgtccctcgaatggggatttcggtaggaaacatgcagctttcttgctctcaatttcttcgaaggtgcaagttgccactttttattagatgctaaacactaaataaactaccgacatcactattattggtgtgtctatgggtttaccaggttcccattgatagtgtgcaaaccacggcgcacactctggccggtcgtcagttcaaccacccgccaactgttcgatcaaatgcctccagggcgtctactttgccattgcaattcccatctgcgagaaaagcttcggcgagcaaacacaggtaattcatgtaccttctccgttctatcttgccttatttagtctgtttctctcccttatgtataggcttataggtggttttgtggtttgggttccatgttttttacataaaaaaggctgaaaaagaaagagtatattgccttcgattggaccagaaattagattgtgtagcatctgtttatttgaagagaaaattccttatatgccacttaaacttcaccggtttcttatttgaattgttacatggatacatctggcaccaaaaaatttgtgaaataagtctgaaatgacaaccgttctgttattttttaacttaatgcaatttttcaagaactctggtacaaagtaatttgtaggatgaaaatttattattggatgcttgttcattttgtttcaggtcttgcatttgaaaatatctgaactgagagatcgagcactgaatgg

SEQ ID NO: 12450 - DNA, 1501 bp, Oryza sativa
attttttttaacaaaaggcaagagttctgccttagtttacctccgtcccataataattgcatttctaaaaaatagagatagattgataacaaacataatttaccacagtaatcctatttaataactgcactgcatgcgcatattccatacctatacttatataaggaaggttgaggcacacatttcatttgtaaacttaattaaaaggaaggttgagggtacacattccatttgttgggtcccatcttatcacaaatataatttttcgggaaaaaaatagaatggtagaaatgcaattattatgggatggaggtattattcagataggagagggaaacaattctaaatgaaatttagtttggcaacgaattgaagcgtagggagtggggatggagtgccaagaagagatgacatgtgtggagaacaagctagagaattggtgcgggtgtatcccaataagtgagccaatccgtgaactcacttatatcgcttgtagaaatgattttgcatgctagcccacctacaaccctattggcgtgcctcattggcaatggtgacgagggatcgtggcattcaggggcggaagtagtggcgaccaaatggggattgattcagttagaggggatgaaaaagtcgatgaagatgacaaaggaatttcaacatgatgaccttaaattcgactaatatgaaaagaaacactcaaatcttttttagacaatacttaatattggcttgtgattcatactaaagatttgagagaccgacaaaatggaacacatgttgctcatgactgaacttaattatagtctcacgaaggaaaatgtcaaaaaggattattatcatgtgaggttagttggtggcatattggcaaaagtctgttaaaattcaaacttgaagattctttgttctcagaaaatcaataaatataaatgggctatgttagaacttaattgcatttcagtgaatccgtgaatgataaatacatgcttaaatagtgttcgaactgctttagctatgtatttgtcttttttttaatcatgcaactgagttaatatcaaaatattgaaaagatatataccatattctccaacgcaagtgctaaacctttttcttttgagaatttttataaacttatcttctctgtggacactggaaagtgcaaatttacagtggggtaaacatttttttaactgcactatcagctgatcggtcaaggactttttacaagcacaatactgattttcttttttgaagggaacaatactgattttcttacttgcacataagaaaagtatctcaattgccacacataccagcaaatgacaacttgctatatatgttcaaatgctgcaatatctcttcccccctccaaacactgagctggtagtggacacagagagttctgcactctctttcactgaggagagcagaacagaacaagaggaggagaacaaaaaaaaaaaagagaaaaatcctatggcctcttgtgcatcaccaaggc

SEQ ID NO: 12451 - DNA, 1501 bp, Oryza sativa
atccggcacagggtggtggtcggcaccggcaagccgaggctgtcgaccatctacttcgcggcgccgccgctgcacgccaggatctcggctctcccggagacggtggccgccggcgcgccgcgccggtacagggccttcacctgggcggagtacaagaggaccatgtacacgctccgcctcagccacaaccgcctcgacctcttccacgccggcgacggcgacggcgatgccggcgttggggacgatgacgaccatgaatagctggacatgagagatcttggaactgtgcaatgcacacgaaattttggatcgctggaagtttgttgcaatttcgttggattgtaatatatttatggtgcagtaattactaattaagtttgtgactttgtagtaacagtgatcagtgtccttgtgcattagtgcatattgtataggctacagcataattatatgttctgtttcaaatttttgtcctaaagtcaaatattcataactttgattcattgatttctaaaaatttatttagtttaacatgataagattcatgtttttagattatctatgagaaatgctttcataatatatttttcacatgttattaaactatataaatttcacatagtttacatgttgtccaactaattctagaaatttattttgtttctacctttacttttgtgtgtatgtttgtgtgaagaaaatagaacttcccttctctcttaggtctgaatctcttccctgtttcaatttttgtttcttgctaatgttgcagatattgtcctttgcttaagccttgaagcaaaaaccttagtcttacctgcacgctgcactgaggaacgtagcagtcatagatgttgagatccaaaagattttcgttgtctttttcccttaattctcgtggaggtactacgttttggtgtgaaggcttactctcgttcgttgtttgctttttctttttcttttttggtttttttttcccttgcaagattccttttgttgaaaggggactcctgatctttcttgtagatcttttttcccccaagggattgttgcgtacatcttccggtcgactgaacgtaacactgaacctttctcccttcgcggccacggtatgtggttcatgtcccaaaattctgaaccttcctcaaggctttcagagatcataaccatgtaactaaatctttcagagatgtgtagctcaaaagattatatatttgcagttcttcaaccttatataggagtataaactttcttagctttattacgattatagatgttactaattcaacacaaaccaaacaccaaaagttgagtttgagatgatctgctcaagcaatctgacaagttttgaaggtcaagatagaaccagcaacaatgcaacaaggtagccaaggtgagtcttgcgcacatgcaagactacaacacaagatggggggcacaataaaaacgtgtgacagttccagcgtctcaactctcaacatccaacagaacataaatcgat

SEQ ID NO: 12452 - DNA, 1501 bp, Oryza sativa
cggaaggaaaacgcagaatgcctgtcgagtacacttacattgatggcggcatcacgttcagccgtccctttttcacaaagggaaacggggatggcactcgccgttgtcggaccactgatcatcacctggccaacacgacgttccacggcttcgctgttcagacctgtgaatcgagaaccaaatttcggtaaatcgagagaaacgcgaacatgagcatgtcaggataaatgcgagaaagataccccgaggagaaacccgggtcgcgtcctccggtccggaatagtcaaaggctggatgggcccgagcctggagcggctggatccgcctaccaacgaagtctgcagtgactttataccccgacaagcctcgtactcggagatcgtcgataatgtcgataaacgactggagagagggggtcaaagggggctttgcggtccaagacgaaatcttgagcctcgtactcggagatcgtcgataatgtcgataaacgactggagagagggggtcctagggggctttgcggtccaagacgaaatcttgtccagttattctttgggaacaacgaaggcagggtccgagtctttgatctgaaggtagaaccacctagtccaccatttgctgcgagaagaagggcactggaaggggatataacacgacttcaggctatcccgaagtcggaacccgatgcaaccagacaccctgttggactccatccaacgcagctcgtagtagaagcgaaagagatcaagaaagggctctaccccaatgtaggcctcacaaagatgagaaaagatgctaagaaaggcgatagaattgggtttcaaatggagaagagaaagaccatagaagttcaaaaccaagagaagaaattcagaaggcggagggagaaaaccgcagagaatatagtcttcgatcgcaaccatgtgacctaagacgggctggggattagtacctcctgcttccctttccatggttccgcgaccgggaagggcgccgtcttcctaaagcttcttcagtgacgcactggtggaggatgatttgctgagatccatctctgatcggagatcgccggagaaagagctcaggtcgatgtactagggtttcttgtgggagcggagaagacgaagagcgcttgcaggcgggatgttttttgcatggggggcgaacttcaaaatggatcctcaaaattcctttaaatagacgcactaccgacggtgcgaattccaaggaacagagagagatgcccgccggaaatttctgggtccgttacgcgcggcggttttttggacttcagtttaaattcgctcgtgaccgttgggcttcaaatggtgctctcgactacgttttgtctctacggtcctcgcaccgggaacgacaacagtctcgacgccagaagtcgcgaatggttacacgagctcattttaagcagaagtcgggggctactgtcagggttacggattaggtataccctttaccctttgatgtacgtcacatatcggta

SEQ ID NO: 12453 - DNA, 1501 bp, Oryza sativa
gaatatggatttggttggatgtttttcttagaccaatacttagggctcattttgatcaagagagattaggcccaaaaaattgaatcaaaatccctgctcatcccatggaatttggtttagccttttcctatccaaccaagaacagttcaacattcatacacttgagtttcctaaccagaaaatactatatcaagatttcatgatttatcagcacataaaacttgtttgcaacttgaaaatacggtccagggtctcataaagactttacctgttagaattgtatgatagacatgcataaactctaatatatcccaatatagatatgttaaagttagttcaaacgctgtcatccagcaactactcaggtttcaaaccactcaggttcccctcctaacaactttctgtaacaaacagaacttctctatcaaccattgaattgattaatacatttgaagactacactgatcaataggtgcagtctcttttctcgttaattatagcacctaaccaattaaagtacaatatataccaatcttggttgcaaagaaacatagctcatgagtacaggtttcaatggatcaagcacaccagatctactttgtggtcataatgcagcgtgatgctgcacaaccacttgccttaatggaactttggactacaaacaacaattaggacaaaacccttgcaagaattagaaaaaaaaaatctccgcaactcctaatgttaaagtaaaacaaaaaaccatccttcttaatttgcaagtactaaccagctggtgtaaatgtaaaatacacaagttgctacgatgcaatgatcccctaagaactatagcaaattggcaatggcatcctagaataatatcgagcaacagtacaaacatgtcagaaacccctccccggagtagttagctgttaacagaatcaacatcaccatgctgctttcccccacttaaactagttcccggtccactattttatagcctaatcgtgcccaaaaccagtgacgggctgacggcacacatggaatgacatcaggcgagagagcaagtagtactgtagtatcaacgaccattgccattgtcgtgtacacccacatacgcaaattgcggcaccagcagcagcagccggagaccttcgagcttaccacccacgtcaacaaaaaattcggtagaacagacaaagcagcccaaaaaaaaacagagagagagagagagagagaagagacgacatgatctcatcgctcgcaatcgcatctgcggtcgaacacctcaccacgccacagaccacacatgatctccgcagcagccagccgcccacacgcagcacgcgtacacccgcgctttccagttcacgaaacgaaagcgcacgcccgccaaccccaattgtacgtacttggcgggcgtagatacgtacgtacacgtatacgtgtacggtatacatccgtagagcgagcggatatgcaggggaagggaatggtggggggggggggtggggggggagta

SEQ ID NO: 12454 - DNA, 1501 bp, Oryza sativa
ttgtagatcttgatgagctatacaactttgctattgatgacttttccatttaaaatcatttactacccgaaaaattattttaatttgttatattttaaaactcaaattttgtatagtccaatcaaactcggatggagaaataaccaaaataaaattggtagatctcaatgtattctacaaatttgtttttgacaactttttgatatgagttaatttaatgtcataaaaatcaatttaaagtttaaaaaacacatgatttttgcatgcggacgcttaagtggtccgcatgtaaaaatggtccctcttccttctctctccaccagtttaaaatttttcacacctatccttttatcttctagtccttcccttcctctcctcttagagtcttctctctttcactctctctctctctctatctatctcactctcagaccaagagccagcgcagtgtggcgcgcagcagtcgagggcggcgcgaggtggtgccggccgagggcatctccatgtcctgttggggtgacatctccatgtccaacccaacctatgccccaaggtccaaaattgttttgatacccttgtcaagtaaaccaataatctccgcatatagatgtccgacatctatcctattttatcatgataaaaagtgacactttgctatgtcaaacccatcacttatgatcacaaccgaaataggtgcaattattgaaagagcataaatttcacttaatttttctgagggaatctatcctaccatgtcatatcaaatatataacagcaataaagtaagatagatataaaaaccccaagcgaaatctaaggggcaacgcacacggcagtcccggggtacatagatctcatctacgattcgctatgtgaaaaccttaacggcgtaatcaaattatgccgaagccgagtcaatctcattggctcgttttttctcattggcgtgcagttccagtggacatcggactatccgatgaacacaatcgcgcttggccttggtgagtactagacatttataacatcccggcctagggcttaataggattaatagaatacttatatcaacaagttgcaacttcttttccggaagccaatctccaaagaactccagggttaagcatgcttggcctggagcaatttaggatgggtgaccgaccgggaaattcttcccgggtgcacacgagtgaggacaaagtgtgcagaaaagatatgtgttagtctgtgagggcagtctatgacctatgaaagctatcagatgtaagcgggcccggcctgggggaaggcgggacgttacaaaatggtatcagagccgaatctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggagg

SEQ ID NO: 12455 - DNA, 1501 bp, Oryza sativa
ttcgtctccatcaggcacggcccaccgcagtactcgtccacgctctccttccccacatggaacgccccctccacccccagccgaagctcctccttgcactcgctgtacacctgcaaattcaaaattattaattcggttcaatgatcaattgcgacatgcatgcatgaagaaacacacttgattataaacagttaacagttaattaattaacttgattctgtttatagctatatatatgtgcttacgttgtgatcgtcgaagcaatggcaagccttctcgaacatttccacggcagctttgcctgcatatgcgacgatgaaattaataacgatcgtgttaatgttagagaaagctgtggctaacttcagagtttgttgctgacatgcatgctgtatcctaatgtagttatgcaatggcaccaactagctagctagcagcatgaagattatcatgcagaaaaccaagaagaactagaattattgaggcactcactaccaaagcagcatgggagcaaaagacacactgcaattgcaaaggccaagcagacacttcttggagagggatggagcaatactgccatattgctgagttaattcgggagaaggtgatcgttgtagttgagcagagatgtaatttaggctagtgccgctgcatttcggcgatgaggctagctctatatcttgttatatatggttttctctgcttgattgtttttcgtcagagcatgctttctttctttctttctttgacaaaacatgtgcttgttttctatcaagatttaccagctgcattcctagtcctaccaacattcccaaggatgcccaattgtccactctttcattttgcaaaacttcattcaaaagaaatcactgccgtctagctttgagcaatgctatctagcagtaattatggaccgcttcattcaaaagaacattttgtgtctagctggagatttgtcgtaaagtttagtttgggcaattgctactgaattaattaggactagtaaccaactgttaacgaaggaatatgaaagaagtgcagttcaagttatacaagtcgaatccaacaccttgcaaggatcgcaacttttcttgcccaaatctttgtcaattccatcgggctaattaacaatcgatgtcttgcacgaaaggaggaagatctgtctatgcaaattctccagccaaccgctgccaatagattatttcaagaatctaaacatgggccagaactgggccatgcaaagcctgctctcctagctaggttgggccggtctggctgtaaatgataggaataagttcactttgtgaccctcaaaatgatcgaaatttaatccgtgaccccaaaccacagaaccggatatctcaacccctaactctcgaaaccggtgcaatttgactccctgggtggttttggatggcggtttcgctgacgtggcgcctacgtgacggttttaactcggtcttctttccacgtgacgttgacgtggcgcttacgtggtatt

SEQ ID NO: 12456 - DNA, 1501 bp, Oryza sativa
cccggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgattagtagtactcctattttcctactatgaagtactatggtttaaaattctgactgtttgaagcgatacttgtctctggagttttggactgggcacaatttgacgttcgagcatttctttgctctgatttgatttttttccccttatgtatgcttgagttgattgaccaaatgaattacgatgtataggctcccaacaataccaaaaagacagattccttttcgcgtatttcgttgaacgttgattccatactctactatgcaacttgcatttatatacggacccattcgtgcatcgttcctattttattttttgaatatcaaacgcaccggatttgatatgttcttttcttcttcttttgagtacttgttagacaaaaccgaaagcacataataactccatatccgataatgtagaccgagcacagcctctgaattattggagggaaaaagaaaaagcagaaccttttgagttcagtttggtcatgggctaacctcgcatgaaattcagatacatctgctggcattttgcctggcggatgtatctgaattttgcctggcaggaacaggaagaaccaattgcattcggacatcccgtccggcaatctgaatctaaaatttgttcctcagttcaattatctatcttccccaggtgctactgctacatctgctggcatgaaagaaaaagctgtactactgtttgtgatttgtatgaggaattgaggtggtgtttggatccagggacttaactttagtctctatatttaaacactaattttgagtattaaatatagattacttacaaaactaattacataaataaaagctaatttgcgagacaatttttttagcctaattaatctataattagagaatgtttactgtagcatcacataggctaatcatggattaattaggctcaatagattcgtctcgcgaattagtccaaga

SEQ ID NO: 12457 - DNA, 1501 bp, Oryza sativa
ttggtattgtatcctctctgcaaaacttatgtcgcatctacaaatcacctaaggagaagaaatatggaatttgcttttagatggatgatgggatggtgtctcgctaagcattgtgaggctgagtttaattttcacatgaagcttcctgctcaattaacggatgcagaccgatgccacgcttgactgcttaccggcctcatctttttcttaagcatcttattagccaaaatttgaatttttaatcttaaatttggagttgattttggggtttttttcatctaaatttatttttcagcttttgcttttaaatcactaagaacacgtatataaaagttttatttacaaattatttttagtttacaaatttattgtttcgaaacgatggagccttgtagatgtatacatgtaggacccacatgattcaatgacaaatttatgtggcatggttcaaattttccatatattgtatacagaccccaaaagagctacagtacaaatgctaccgcacataattctgagagcacctatgtgttccaatctcattcaccgctgttaattatatcggctgcaatgatgatggcatcaaacgaattagaatgcagatgcctcgtggccactcagacgaagtaaatctctattacgattcactaattacttagagaagggactaaacaatgcaattagtcttgagtggcattggaaaaaaaatatatagcaccatggatttacctagatcgatcggaaggggcatcacaacaactcgataggaagggggcatcatgatgatcgatggctcctttcctgacagttagcacctagcgagttgtactcgtattattcaagtgatgcacggagattaatcgcagctcctctttccaatctgttgagagtctcggatcgatacagaaacgtgataaactgcgggcctagctaagacataattacgtggattggaaatttttcttttaccttaaaatttctatgatttttttctaatttatttattaatttccttaatattaggatgccacgtggtggcataggagcgttggtaggagtgccacttggcggcataggagcgtttgtaagaagttttatgtaattttagtatataatagattcatttttttaatttttaagtaatacttaattactcaagtgttttgatgtgcttgtcagaggagaaatgttcccaacatgcaccttcaaacacagactactgtccgattgtaacggaaagtgttatgaactgaaagaatatccgctcatcttatgtataccatctcaatagttaaaaaaaataaaaatttggtaggacatattaatacacaatatataactccacaaacatgcatgcaaattcaaatacgatttcagtaagttgtagcaaaaaaatatatatataactgtgaatatgtatacatactcgtcagaatttaatttgactttttttaattaaaacttatagaactcatatttgaacttacatatatttttaaaa

SEQ ID NO: 12458 - DNA, 1501 bp, Oryza sativa
gccgacgtgtcgcgtagcaccacgtccttgttgagccgctcgctcccaagcaaggaaacgcgattcctcgctcgcgcgaggcagagggaacgcctagagctcgcgctgtggagggcgtgcctccaactcgtcgtcccctcgcgccctctccagcgtcgacctcgttgccgtctcccgctccgcgtcactgacctcgatgtcgccggggagctcgtcgctgcgccgcttcgatccgtgccgccgccaccgtcctcgtcggagaagctcgccggctcgatggggaaagcgcggagaaggagaggagctcgaggtcgatgccgcgtccgacctcgccgtcgtcgccttgatccagtgggcctaggccggatctggccgctcagcccagcgtcgtcgccgtcgccgctcgggccgccgctccacccggctttgagaggaagacaaggtcgcgtggctccggtcgacgacgaccgtgccgccgctcgtcgtccgcgaggaagacgaggtcgcgcggcgacctccgcgaggaagaccccaccgagagcccgttgctgcggagcggggtagggggagggaggcgccggcgtctgtggcctccggccccaacgatgagaggcgccgccacgccggcgtccatgccttcttgcccgccgtcctcgccccggggcttcccgtccgccgcgtccccggcatcgttcggcgccactgccaccctcgccggcttcttccgcttcgggattaggggagtcggcgccggcggagggaggaggggacagccggcgccactcggccccgaggacgccgccgccacaggacccgctacctcgccatgcgcgcagccgtcccaccgtcgaggtcactgccgtccggcccgacaaggagaggagggggcgggcggttcgccgtcgtgcgccgccgtggagccgagtgagggagggcctcgtcgtcgtccacgctctccgctccgcgtcgccgacctcggtgtcgccggggagctcgttgccacgccgcttcggtccgcgccgccgccactgtcctcgtcggagaagctcaccggaggttgaggccgcgtccgagctcgccggcgtctgtgccttcttgcccgccgtcctcgcccttgccgcttgccgtcctggtcagtggcatgcgagaagaatggatagagatagagagggagagatgaatgtgaaaagagagatggtgggacctactaacatgggtgggacccacaaacatgtattgtgcactgtgaagtgtggttctttacggcatgtgtgttacccgcactgctattggccttaggggaagatggtggcctggcccctgagtccgggaaaagagatactaatgaggtcaggttgctcagcaaatcaacttgctggaacactcttcccaactcggtagtaatatgagccctttgaggagaagtgaagatggcgtgattgcaacaaacaactctaatgcacaatcggcgctctcctttgaggagagtgaccgggcacaa

SEQ ID NO: 12459 - DNA, 1501 bp, Oryza sativa
gaagagcctcttggtgatcgccgggaagaaggagaagacggggaagctggtgaaggcgcggagcatccatagctccagccgctcgacctcctcgagcgcctccggggcaagcctggcgccgaggctcatgtacaggagcagctcgaacatggcgcgccggagcaacggcctcagctcgacgggccgggagccgtcgccgccgcggtcgcggaggccgcggacgagcacgtcgcgcgcgcgccgcctcgccggcgcgaagagcgcgacgcgggccgggctgagcgcctcggaggcgaggttgcggcggacgaggcgccagtaggggccgtacggggaggagttgatgtcgcgggtgtcggaggtgaagaggcggccgagctccgggagcggcgggcggtcggcgaaggtggagccgccctggacgagtgcgcggtgggcgaggcggcggtcggcgacgaagacgagggtggtgccgaagaggcggatggagatgacggggccgtggcgcgcgtgcaggtcgcggaggagcgggccgaggtcgaagatggagcggcggaggcggaggaacttggcgaggaagagcagcggcgacggcccgggagggaggcgcgccttgatgctgctagagcggcggcggcgagcggtggcgagcaagacggcgacgagcgagatggagaagaggaggaagagccaggtctcctccattgttggcttggcgttgctgctggtacccttgcttagcttaatttcctccaagactaagtactaactctcctcatattctaactttaccttgtggatattattttggaatagcagtactagtaaaaagtccgtaatgacttttatttatacttgaggcaataatataatattattccatctagtcttatccatcatgtgtttttgtcaaggtttttttttttcctttcttacgtacgcaaagcaaacaaaacaagagtgcgcgttgagcttttttattctctggcttagctttggtggtttcgataagtctctacgttgactattcacacagttagttagcccatgacctcttcacctttgtttggttgttaatggaattgccacgttcgatcttatttttaaaaatccagttatatactatatcctccataccctacgcaaacaacaatagttgagtttgacatccataccctacacaaacaacaattagttaagagtgacagttttgtatgtatgcatgcagtcgagaatccaaaaggtccatgtgagcaacagggtagggattgacggtgtactgtacactgcacagcacgtcctactcctagtacatcacttcttgtttccagaacaagccaaacccgttgcaagcagttgcgcaacaataattatatcaagcattggctggagcaatctatatgaacatatgagatacaacaaataatacgaccaagcatgatcaaatgatgtagatagaatcaggacatgaatgacttgattagatgaaacaggaagacaa

SEQ ID NO: 12460 - DNA, 1501 bp, Oryza sativa
tatgatctcatcgtattataattttgctccagtaacccaagtcctttatttattaaaaaaattgaattaatctgatgtttgtttcttatgaaatttaaaaccaaactctgaatacaattagtcaaaagaaattatgtaattttattttcaattaccttcatcttttgatattgtcttcttctcaatgtttttgtctctctctcttaaatccttcaaaatacctgcacaacatatgttttctttctaagttaatttaaacatatcaatgaaataaaaatttatatggacaaatgttttttttccgttcttacctgactgtgcagtacttgatcgtgtactacttttctttgcatctattataaatgatcttgtcctattgtaattttgctcaattaattgtaaacctgtttgaatgagattttctgattataattctgatttcatattgaaataaacaacataaaaaatttatgttttttcacctgattgtgaaatttttttgtttaaatccaagtcaatcaactgttgttttttcgctgtttctgtatacatagaattttcaaaaattagtaattttttttaatgaacagttgtatgcataacctcattaaattatataaacatataagtctgttcttacctccaacaaaacctttcaaattctcatctgtcaaacctgtgaaaacaaagcataagtatatttcagtacacttaattatcaaacatttagcaatcaaaacaaagaacatattatcagtacacttgatgagtacacttgatgatttcattttgacttgtattgtaattttttatctcatatagttttcatatgatattctgaaattccttctaatcagttcatatgaaataaattgtctattttctgaattctctgaatgatttctgttttgagttttcaaatttttgattatgtaaagttttaagtcttcaaactggacaataatccttaaatacagtagtctttgtgtgttgcttggtgatgtgaatcagggccatcaaatacagtctatcttattgtagtacaaatatattgacaattgtatctctgaataatttatttgagagcttgagttagtggatggatggtagttgaactataattaaaatttgttctgattttcttttcctatgaaattctgaatttgtttccaataaattgatatgcaatatgaatagagatcttaagtccacaagaagttagttgaaaacaaaaaagtgcaatactgtatctaacctgttgattctcaaatgagttatgaagtactgtatattatgtgaaagttatgttgtggattcatatgaagattatgttaatagtctgaagtaaattcgaattttgcagagtataagttttcaaatttttgattatgttaagtttttaagtctacagtctggacagtaaatccttgaatgttgcttgctgatatgtatcagggccatgtgattgttttcttatagtcattgtgtgttgcttgctgat

SEQ ID NO: 12461 - DNA, 534 bp, Oryza sativa
gggatggagatgtgcgcctagaggacgccgacgagccctcactcctcgagcttgccattcgtcgacactcgtcgctgtcgccgcttcgccgccgtaaccctcaccgtcgtatccctctccgccgccgcttgtagtagggatggggaacgagcgagagagtagataggcgagagagcacgcgctatttattcccaactaccaccgacacgtcagcgatgttgaccgggtccaactgccacgtcagcgaaaaccgctcgcaaaactgccatgggagtcgggttgcccaggatttcaaagtttaggggtcaagatatctggttttgcggtttagggtcatgaattagattccgatcacttttgagggtcatgaagtgaacttattcaaactggtcatcccccgcccaggcaggccgcgtccgtgacgtaccactcttggcgcctgcgctcacgcaggccgacgcggcagtcgttctccatgtatggagtacgggaccctcatcccgctaggccggcggatgcggccgcctcctcgtc

SEQ ID NO: 12462 - DNA, 1501 bp, Oryza sativa
attcaaattttccctttaatatgtgaccccgttgactttttatccaacgtttgatcattcgtcttattcaaaaaatttatataattatcatttattttattgtgatttgattcatcatcaaatgttctttaagtatgatataaatattttttatatttgcacaaaatttttgaataaaatgaatggttaaacgttggtcgaaaagtcaacagcgtcatatattaaaatacggagggggtactattcatgttctttctcgagatacaaaagtattggacaataatactgtagtgacagcagttagacctgcgtggttaacatgtcttggagactagctttgtaaaacacaaattacatgtatgtgcaaggaaaacctgtgccattttttcctgactcatgtagtaggacatgaagcctcatgctcttacgtgcaattgagctaaaccataaatggggatttaaatagtgctgagtcatagagaaacatatactcaatttgaaagtgctgatgaatatggctggaaccacacaaaagcttaagtgcctatagcagtttgcttgctactagcgccgttctctacgatccttaaaatatcatacactttgtgcacaatcctatatttccaaaacttgtgtagaattaggacccatcaggattggggtggctccagatatccattccactcgaacggtcacacagggatcgctggaaaaaatggcacgatgttgagaacacctaattatgttggtatggtaggaaaatgatgttcgaagaagatgatgaaacagaagatgactgaccatagcgaaacacatcaatcgatcggcactcatcatctggaagacgcggcgcggtgacaaccagaatcgtagcattgatcatgctcagaccattaaacgattatacaccgtggggtcaccatacagctatgcaagagatgatcaattggatttaaaccatgaaatttcatatggcagtagaacaatgattttgaaggagcaaactatataagattactccacgatcgagtacaaaaccgtggtgagagcgttgaagagcaaagcaagctacttttgtgaagagattaattaatgttgagaagagttaattgcattttcatatactactattttagtcgctcaatcgctgaagacgttgtgccattgagacattatcacatcgttccacatgttgtcgtttggtaatttgatcagtacaactttaccaattgtgtataaaagaatggcattccaatttttgaacccactattttttttatgtaatcatggcacacgaatgtaaaatggcctacatttatacttcctccgtttaacaatataagtcattctaacatttcccacattcatattggtgctaatgaatctagatagatatgtatgtctagattcattagcaccaatataaatgtggaaaatgctagaatgactttcattgtgaaacggagggaataactagtatatatgtaataattaagatacg

SEQ ID NO: 12463 - DNA, 1501 bp, Oryza sativa
ttttgcctggagatcgccggaagttcctccttgctagtgatcagagaagaacgccgtcttcttcctcctttggcagtccctcccgccttgccagagcaccgccccgctgcattaacttgtctcccttcgatgtcagccttcgattcccttgtcatcctcttcctcaaccgtgcgttcttgtcaagtgaagaccatcggaacgcacccgcgccatcgacccgaatgacatcaccactatcttcctctagccactgtcccctcctcgtccaagtgcttcccgtcgtcaccctcaccaccatctccctcaagtccgcagcgccaatccctccgttgtcccctcgtcgttgaccagttgctgtcgtggctgctcaagctcgccattgtcttcctcgccaacaattccctcctcgctatttcggttgtcgacatgtttgtggcgagaatctggtttccgctctttccctcctattttccttgccttaggtgactaccggtcatgtgccgcagtcgctggttatcgtctccatccacatgtagctgcgttttcacgcacgtgactgcttgtttggtgtcatgtgggatccagtcttcagtcttttctctgaggcttacacgtaggtgcacttttcccgtggatcgtctcggtgaacctgatccacgatgaactagccgtctgacccgtgggtcctggttgtcagtcactcaattctttctctcctcgagcgatgttgtgttacacataatttatgggaacaataataattaaacaattcggaaatcttaatttaaactacagttaaattttggatggccgtatcttggccatatgagctccaacttgaccagtttaacttttgttataacttaaattacccatgtatgttgcttttatgtcttgttatcatttatttcttagagttgtggccttgttttgttgctcctatggttgttgtcatttcggaggttccagtcatgcagttcatgttcgttgctgaagtctcagaagtttgtttcgttgagcaagggaagtcacactctccttatcaaatcccaatttacggaaagtattttaatttaaatttttgcattcacttttgtcggtgacatggggccgggggtatcgtgactagaggcttgggtagccgcggtcgcctacgtggcctgaccccctcggggggtcgggcccgagggtgacgtggccacccccccctctctctgtctccccgaggggtcgggctgctcccgtttcggccccgagggctggggcgccccgaccccctgcggtgttggcgccacgtgtgtaggttaggtgagcagcagcgctcacctaaccgcatttatagcaggttaggcgagcgcgctacgccgcattcaatgcggcgcagcgcatgcttacccggtccgtgaccagtcgcggtatgtgaccggtcacagatcggtcagatcgcgggatgggtggcaacaggcggcctgtcgcgcgcctcgccctgtcccgtcagaa

SEQ ID NO: 12464 - DNA, 1501 bp, Oryza sativa
atatttaataaataaggcaataacaaaaaatataggaaaggctaagtaaaacagttataacacaataaacttaataaagttgacggagcttagggctcctcaccgggagaccgcgcaggcccccctttgtcggttcggccgggggcgctgagtgaggttcttcgccctcgatctgaggaacgtcagcgagaagaatcgcacaagacacgggcgacgtagacaggttcgggccgctgagaagcgtaataccctactcctgtgttctggtggatctgtgtgtgaaggattacagtgagctcgagagcgagcgagagtgcaggctcctcccaaaatccctctccctcctccttaggcctgggcctccttttttatctggttaggggtcaccacatgggcctctagctgcctaagaaaggaaacattctttttataatgagggctagtctacagccggaagtgacctttgacaagcagagcgcacgtctcttgccccgctcgtccgcttttccgggggacgcccatttcaaccttcatttaatggccagcgatttccttgccatgcttgtgctgaagcctagaatggatctgaccgggactgacataccaactccaggagtcagcacgccagctccggctagagacgagagccaggaagctctcatcattctgacgggacagggcgaggcgcgcgacaggccgcctgttgccacccatcccgcgatctgaccgatctgtgaccggtcacataccgcgactggtcacggaccgggtaagcatgcgctgcgccgcattgaatgcggcgtagcgcgctcgcctaacctgctataaatgcggttaggtgagcgctgctgctcacctaacctacacacgtggcgccaacaccgcagggggtcggggcgccccagccctcggggccgaaacgggagcagcccgacccctcggggagacagagagaggggggggtggccacgtcaccctcgggcccgaccccccgagggggtcaggccacgtaggcgaccgcggctacccaagcctctagtcacgatacccccggccccatgtcaccgacaaaagtgaatgcaaaaatttaaattaaaatactttccgtaaattgggatttgataaggagagtgtgacttcccttgctcaacgaaacaaacttctgagacttcagcaacgaacatgaactgcatgactggaacctccgaaatgacaacaaccataggagcaacaaaacaaggccacaactctaagaaataaatgataacaagacataaaagcaacatacatgggtaatttaagttataacaaaagttaaactggtcaagttggagctcatatggccaagatacggccatccaaaatttaactgtagtttaaattaagatttccgaattgtttaattattattgttcccataaattatgtgtaacacaacatcgctcgaggagagaaagaattgagtgactgacaaccaggacccacgggtcagacggctagt

SEQ ID NO: 12465 - DNA, 1501 bp, Oryza sativa
ggcttgaggcattgcaaaattttgtctagttattggttttgatgcatttacactagattccttccattagtgttcattattgctgttgttttttattacaaatatatgtcattatcttttcctaccaaatcattgatgagatgttgcattacgatattagtgctaccacaaactagaggagtacggctcaaaattttgaaagacaaaattgctaatgtaaacataaaaacataccgtggctacttaccaagggcaactagagagggtttcaggctgcaggtgcaccgggtgaggcttgccgacatggccgcatgggccgtggccatagcccatagagactgtccacgacttgcggcgtgacgcgattggcacgggagatgcattgttgggcagatagcgatggaaggacgccgacatcccgccatccgtggctctcgtgaagcctccaggcagtggtcgcgacggcctccttcggcgccggcacttgcaggctgtgggaaacggcgaactgcgggaagcaccagattttgatggcctcaatagctccggtaattacgatttgtagattgggatccagggaaggggagcggacggttcgagtcctcaatactgtcctcaccgcacgcacaaagattgcaaaggaaggaaaccagaagagtgggggccttcttgtcaggtgcagtgggggcctattggtaatatgattaggggtatgtgtaatatatgtaaaatttgagtggggtccagggcccccactgctaatacgctaaatccgtctctgcccgggcacagccgtgaccgtggccggagaggggagatggggagatggggagaggggaggaagaagaggtaggggggagtgacatgtggagcccacgtggacccccaccattttttttattactttgtgtctaaaactgacatgtgggtcccacggggtttaatatttttcatattgagttgccacgtcaccgccacgtcaatgccacgtgggatgaagacatagtcaaaagagccatgtaggcgccacatcggccaaaaccaccctccatactgccgagggatctcgtttgtctggttttcgtaagttgagggacgggtcgtatccggttttacggttaagggatgaaaatcggactgaccgacaaatagagggacctaaagtgaacttattccaaagagaaaagcccaagtaaatcactgcgcagtccgagtccgagcccaactaaaccacgttctaatctctcctcctccgagtcttttcggtttggctcgatccgctttgccgcaacacgagagaggaaggaatccctcacgccgttctcgtctcgccgtcggcgcggcgtgacggcgtcgcgatggaccccgccgccgctgccgccgccggcggcggcgccggtccaaaatctgatgcggccccttccgcaccggcgctgcacggcctgccggtggagatgacgacgggggagatggaggccgccatcgccgccctccccgcgaa

SEQ ID NO: 12466 - DNA, 1501 bp, Oryza sativa
ctttgccattaaaacctggagcgaaagtagtcaagctttgtaagtatccctcttggtatggcaaagaaggacatcatatacaacgggaggctacttagcaccgaattaatcaatgttagccgtcctccggtagataggagttttcctttccaactgattagacgcttttcaaagcgttctacaacctccttccaatcggcatttcttaatctcctgtaatgaatagggatacccagataccgaaatggaaattgaccagtggaacaaccaaagagttccatgtattcgttttcaaaatctttcgcttcaccaaagcaatataattcaattttatggaaatttatcttaagacccgataattgctcaaagacaaaaagcaacaacttcatattactagctttttctaggtcatgatccgcaaataatatgtttcaataatctagtaaaatagcttaaaaagaacatgttctaaatatatacaattcagactatatgcatgcacgtgaacatttggagagggatcgagttaggaagtactagactgtaaaaaaaaaaagataaaccctaactacaagtctagatatgtactccctccatcccaaaaagaatcaattcctcatccagatttatagtcaggaattggttttttttaagaacatagggagtatatgtttaggttcgtaactaggattagattttttttgaacggagggagggggtaattcattttttcttttgcagtgaagaagtttgattagctacctgaacctgcatttcatgtagcgcaggcaactcgtacggacgtacgccggctgttgaagacttgggatcacgatcacgatgtggatcgataacacacacgtcggccaccgtcggcgtgagggtccatccatccattgcatcccattacgcatggcaattggcaagcacctttcatgcatatgccacagctgctgttgcctgccgacctccctagcgattacgcatcgtgtgttagtaagtaattaaattactcctaactagggttagggtctatttaagtagagtttcaactcctaaatttagcagcctaaactctgctccacatctgtaatttattttgtaagagcttcacctagttccgctactatattttaggtgaaggtaaggtggtgtttagatccagagacttaactttagtatctgtatttagacactaatttagagtattaaatatatactacataccaaactaattacataaacgaaatctaatttgcgagacaaattttttaagcctaattaatctataattagagaatgtttactgtagcatcacataggttaatcatggattaattagacttaatatatttgtctcgcgaattagtctaagattatggatgggttttattaatagtctacgtttaatatttctaattagtgtccaaacatccgatgtgatagggacttcaaagttttagtctcatctaaacagagtctaaaactgtttgtctgagct

SEQ ID NO: 12467 - DNA, 1501 bp, Oryza sativa
acagaagaatgaatgccttaccaagaaacctctcaattccttttctcagatcgagttgagtctctctcactatctatacattctacggatgattttttttctctctcttttttttttcaaaaaattctatgccaagattgactttatcaagaacagccaggcagatctggccaattacctgttgaatcgtatgatcaattagctatagctcgtagtaagtagaagtgtttgtcacttcggcgatcttggcgccgccgccatggaccgccgcgtcggccctgcctcgacgtcgccgtcctccttcttctccaccacggccgccgtctcctcctcgccgttctccgccgccggggacggcagcgagggcccctccaggtcgtcgcggacgcggaaggaggcgtggagcacgatgaccgggacgccgacggcgagcgcggcgaggaggttggcgatggcgccggcggcggcgaggtcggcgaggacgagcgcgacgaagacgagggcgacgaggcggcggtcgaggaggcggcggagcagcgccgagttggggaacacccggaggagccccccgtagaggaggaggcccttggaggccgccatgaggaagagcatggacgccctgtgccgcggcgcgagcgacgccaggaggagcgcccactgcagcgcggcgtagtggaaccggaacgtgcggaggttgcgcacggcgcgcaccgccgcggcctccgcgtcggccgcggcgccgaacgccgacggccgcggcgcgaaccgcgccagcgcccgccgcgcccccctcgccgccgcgcacgccctgtccgccgccgcgcacgccgcccgccggatcgcgcccgcgcccgcgccggccgcgcccatatcgccgagattcgcgctgccgccgctcggatcccccgcggcgtcggcgtccttgcacggctcgctttctttatttggaggcggagtctgagacacgggaggagaggcgaggtcaagacgcggtttttaacgggtcgcgcacttccgggagacgaccggcgcgtcgcctgcgctgcgaatacgaaaagaattccggctgcatatcgccaaattttaaatttttaagctgattttgaggggttttttttatcaaaatttatttttcagtcaataattttaagtcacaaaagttttattcataaattacttctcgtttgcaaatatgcgggccgttcggccccatcttttcctcatcagctgctgctaaaatttaattttaaagttaattattttgtgaggaattttaaagtttttttcattgaagttattcttttaaattagtattcaagtcactaataacgtactccctgcgtttctaaatatttgacgctgttgactttttaaaaatatgtttaaccattcgtcttattaaaaaaaatttaagtaatcattagttcttttcctatcatttgattcattgttaaatatacttttatgtatacatatagttttacatatttcacaaaagttt

SEQ ID NO: 12468 - DNA, 1501 bp, Oryza sativa
gtttattttctttcaattctttatttggtaatgttgtagcaattcccaatatgggattattctcatcactgttttttccccttcccttgtcagaaacatgttcctcactctcaaatgcattggagacaactggtcaccaacaatccatccatgctggcctggttgactagttcagtacttctgtcaggagattcgccatcatcatttgagtgagttcacctttactctatctaatcaccacaatcaagttaatttcgaggcagagccagatcatatattatcgacaaaaggatcagttaactcccaggtgtaaatgtgtaatcaaagtgtctttctagctaggatcctttttcaaaggtttctcgtgctagctgctgataagtcataacttcagaactgaaactattatgaaccatggtcttgttaagtcatgtttggattgatataatctacctttacacatccccaaaggtggtagcagacagcattaacgaactgaatcacttggattgaaagccatggagcaagcacacatgatccatctcgttgccacgccagatatacaagtagatatagcttaatgatcaccacaataatcaacttaatgatatggagatagaatattcccaactcctagcatttttgacaaggatctgttagcttcctggtgtaatcaaattgtctctttagatagcgtgtgttaggggacgcacttacgggtggtgattgtagtgtgcgtgtgtgtctttcgtgtaatcgtaaaaaaaaagtctttctaagatctttttaaaggtttgttatgctagctgcccataacttttgaacttaaattcatataaccatgtccttattatgtcatgtttggattgatccacctagctttacacatccccaagggtagtagcaaacaacatttactaactggtgaatcacttggatcaaaagttttggagcagagctacacatgatcaacaatccgtaatcccgttgccacgccagatatatctcgagccaacgaagctcctctcacgtacaccatagggacatatatctctctgacgtgtgggtctattggggtgagcctcacgtgtcagagacgacttatgtccctctgactttacgttagaggagcctcttccatctcgagccagctcatattgattatccaagttcgtaagtttttctaaaactttttctacctaactcatgtatctccaaatcatgctgttgaaaagatagcttaagctaagctcgaacgatcacgcatgatgatcgatgttcagagctttgtgtgcagaggtggaagaactagcttttgtgtgctttggcggtttggccatgcatgcatgcatgcgtgcttcccacgtgagctcgccggagcgggagcacggctaggtgcagtgacgtgtgtccactccccgttgatttgatttgtctcgtagctgcagcaacaaccgccttggcctcatgcttccccggcgagccaccagctgccaatccg

SEQ ID NO: 12469 - DNA, 1501 bp, Oryza sativa
cagaggcggcggctgacgcggctgctgctgaacgtgacggtggagcagagcctgtggcccgtccacgtcgtgatcggcgcggactgcaccgtggccgacctcgtccgcgccgccgtcgacgcgtacgtgcgcgagggccgccgcccgccgctcccttccgccggcggcggcggcgacgcggcggccgggttcgagctgcatttctccaagtactcgctcgaaagtgcgtctttctattgccttttctcttatttttcaagctccattttcgtattgtcatcgtgacagagtggtttcttcagagcacgaggccatggagtcggcttgaaaatttcgattcattcatggattaagcttgagaatttcgatttgttctgacctgttggagcaaattcatcgcggactgattcgattcttggcaggtctaaggccggaggagaagctggtggatctgggctctcgtaacttcttcctttgcgcacggagaacacctgctgcttaattttcaatctgctttcgtttttgttaagcatctgctttctgctctgctgcttaggacttgtttagttccaaattttttttttgtcaaacttccaattttccatcacatcgaacattttatacacacgcaacttttctatcacatcgtatcaatttcaaccaagcttctaaattttaaaatttcagtgtgaactaaacacgaccttaattgattcaagcgagcagagcatgcaactgatcacctgctcgtcacgagctgctgcatcacgagctcgtgatcatacgtgttgtgcttgacatgccgtcggctagctcatcgcgacgtcgcctctactgttcatctttgatggatcttcagagccgtggagagactgaacttgtacttttttttttccttttctcttcttttctgaagatcatgtttgtactgctagctgttggagtgcaggaaaaacataataataccctgtttagatgggactaaaacttttaagtccctatcacatcggatgtttaaacactaattataaatattaaacgtagactattaataaaacacatatataatcttggactaattcgcgagacgaatctattgagcctaattaatccatgattagcctatgtgatgctacagtaaacattccctaattatagattaattaggcttaaaaaatttgtctcacaaattagctttcaattatgtaattagttttgtaagtattctatattaatctctaaattagtctctaaatacagagactaaagttaagtccctggattcacacaccacctaagttgcggtagaactaggcaacatgcactgtctctctcttgattccccagaacgatcgaggctgaaactgaaactgttcgccttttttttttacgactcacaccagacgtgcaatgttcatattaatagaataggaaaaaaaataaaattataactgtgggaggccgtaatcaggaaaaaaaaaaccacccaagtaccgacagc

SEQ ID NO: 12470 - DNA, 1501 bp, Oryza sativa
caggctttgttatgggcctggcctgcttacgtgggctggtcgatgtcaatcgtgggccacgaccagagccacagcgatacggcataggaaaaagtacaccgaaggtccctcaacttgttatcgaattacaaaatcgtcccccaaccgtaaaaccagatatatgacatctcttaacttacaaaaccgttcgttttacatccttcggtggttttcacccggttttattcgacgtggcgggtgagtcagcatgggacccatgtgggtcccacatgtcaggacgccacgtcatcaggctctctcttccccctcctctcccttcctctctctctctcactcatctccctaggcaggctggtcggcagaaatctttacaaaaatagaccctgcggccctccatttaggcggcaagctgacgtggcacacggcgtcgtgacgtgccgtgtgcgcattttgagcttagacccttggggctaaatgtaatttttttccatgctaaaaaaacaattgactagttctttttgcatctgggctccttgccgcccttgcgaattttgcacggaggctccttgccgcccagacagagggcggcaagggggccacgtgtcgtagccccccaaaacgaccgtcctgcaccgtgtgccacgtcagcttttcgctgatataatatttttgtaaatattaaaaaataaatctaaaaatgaaaaaaatcagtgttcaacagctactctgaaacagagccaaatatttcctgtagtgccaaatatttcctgcatccttcgtacggcccacagctaaatatattttctccactacaaaatgttggtacctagaatgaaatttagacaacgaatctggataaacttttatccagattcgttgtcgaatctgtacataatttctatccaggttagttgttctagtatggattaaatctcattttatattacaacattttaagacgatggtaccttcagaatagacaaaatgccaggtaaaacctcaataatataaaactcgaaaatgtaaatgaagtctgctctgccttgtgaggctacgctgttcagggaagcaggaaccaagtcaagcatggactgtaacatatccatcgtggcatccaaaaagcatgaatgaacaggacaatctgcagagtgcagttatcaaagatacagggtatctcaactccccaacgttgagatgcattgcaactctgcaagttcagtaaaatttaaaagaagcttagcatgaagatttattatcacatattggcagaaaaggtgtcaactgtaaggccttagttgtatttctgcataatctgacctttaaggctgtcataaatagaacagtatctcagtgccttataattaatggagagctcataagataatcacacctcacaatccatgcacgtaaactcggttcatacaagtgaaactctcatccatcagaaatgtctaaaactattatcccatttacaagtggtcctatttattattattattat

SEQ ID NO: 12471 - DNA, 1501 bp, Oryza sativa
ctgcttattgccaatcattttatttggtggagaagaggaggacggatcggatttctctccttatctccacttgcagtactcaaaagaaagtctgatgaagcgtttgcgagtgtgtgtgtatgtgttggtagtgtttgtctggatcttgagacagaaatgcttttgcatgatcgatatggcgtcggtttcggcagcactgttgaggcacgaacggcttcgtttctccgagaaaagtcgttctggatttcagtgggtactaggctgctttctggcgacgtgatttgtcgtctccaattatccagagagagagagagagagagagagagaaagcaagtagaggtcatgtttgctcttccgaattgttcttgttgctgttccgcggctgcacgagagcttgacgcctcaacgaccaccttgttctcatgatcctcccattcatctttgattttaaaattttaaggagtgactacactacatatgcaggtggttggtagtcagtttttaaaattttgaaaaagttaaaaaaaatccaaagctcttgacttctagttttctgaattgcttgagaaagctagatattttgaaaaaaaaatttgcaggtgcgagaagttagtttagtggttgtgacctaagtagtacctcaagatactgagttcaaatctttatataaaagaattttagattaggttgtttgagggacaaaattcccaatttaaaaagaccgcatacatctgttttgatgcaaaagttgggtaaaaaaataccattctctaaaaagagaagttaaaaccaaagctttcatatccaaattctgcaaatcaagttcaaatagggttcaaagttgcgaaaggacctgtaacctagtggttacaagagtctcagtagcatctgaggtcctaggttcgactccccgtgaaagcggatttttcaagatttaacgacgttgtgctttaataaaaaaaatagggttcaaagttaaatccactaacacttcgggatttgactgaacagatggaccgccggccaaacgaacaaacccaccactcccactgtcccacgcaacgaactgaagctcatgcgatcaaaaattcaaggaataagtccacatagactcccttaaaagtgacccaaatctaatatgtaaccctcaaccgcaaaaccggataggataggatgactcccgaactactgaaatcagtgcaatttgactccctcagtggttttgctgatgtggtgctgacgtggaaatattgacctagttttcgtcacacgtggcgcttacgtggcattacaattaaaaaaatatatgtgggacccatctgtgattcacacaaaaatatattgtggtccccactgacatgtgaggcccacatgtcatcctctctctctctttcttcctcctccctctctcccccttttctctccaccttctctctcgtggagcaatagacgggcaggggtagcgacagcgggcgggagctggagcggcggcggccggcaa

SEQ ID NO: 12472 - DNA, 1501 bp, Oryza sativa
agtacgataagttcttccagggcatcctgcgaaccggtccttaactgccatgggcgcgaccaatgtcacgcccggaatttctatccaaaattccaaacgcttacatgtgtgttaaaccctcgtccaggaatcaaccgaggcacacaataacaaattgataatagagtacaaataaataactatttaatattcgcaaataataaattattacagaggtagatagttcctctcaaagaataacattctacgcagcggaaaaataaaactataacaaactacggaacagctatggcgactccactccacaggcatcttaaccagaacaagctcaatccttcagatcatcaccttcgctgaaatactcctcttctgatgattgaatattgcaagaatgagcatatgacatactcaacaagccacacagcaaatatgcaagtgcataggataacaaaggatggcataatatagctcatttgcataacagcatttaacaaatatttaagagaatagtaaaacagttgtataatgaatcaatattaaataaacaccatacaacacacccatgttgcataggcccaaccacatttgaacaaccaaccccagttgaacaaattaaacctccaaaccaggaattatccattccaaaccaggagtcaaattaattaccacattattaccattaatgagtagtgcgactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcggaaaagaactgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacggtaaaagttttacaacagtagctcgcgaaccggtccttaattgtcatgagcacaaccatcaaaaccatatgctcacaacccaccttaaccaggttttaatcatcaattaattaacatcacacgattaaccatcgtgagctaccatttaatgtaaccataattaaaataataatgtaacatagtttataattaatccctttagttagctaacgtttctaagcatggctaagcaaacttgcatatagcatttagctgaaccaatccaacatataaggttcatgctaatcaaattataacctataggaaaataagatcatcttcggccattaattaattgggaaaggtttaccacccgatgacattcgaaaacaatgcatagctgaaataaaataatagctttaaatgggttcaacatgttcaaagggttgtttgggatctgtgtgacttgcc

SEQ ID NO: 12473 - DNA, 1501 bp, Oryza sativa
taatatttctttttgcagctatgtatgatcatttgaaggggacaggatcatatggatttgggatttccattgaggatcttaaagagcccaggtttttttttatctaccacaagataatattgctaatatgttacaatattgataataatatttgctatcttattgggatgcagttatcaaatggcttattcgaactatgtgattgtcacacaaaacaaagaggatgtggaaccccggtttttaaagaagctagggaagaagtacatatttcagccggacattgattcaggcaattatgacaatttgcctacagggttgaagccaatagacaagatattgtaactatattccaatagacaagatattgtaatcatataatttccattctttggtgtaggaacttcaatatagcttaatgtctcgttttactttttttttaaaaaaaatacctgcatttttttctcatagtgaatattgtggcatttttctatgagtatgtatacacaatgatacaaaatgagacattctctacgatatggtgggaaagttagccatatctgcgatttggtaagtaacaaacatcagcacttatttagttgattgattatagattgattattataatgtcttgaagcaacacgcaagtagagagactgaggttcctttccccttcccaactccccctatcgtttttcacgcacatgcttttcaaattgctaaagagtgcagcttttgtaaaaagtttctatacgaaagttgcttaaaaaaatcatattaatctatttttgggaaaaaaaattagctagaacttaattaatcacgcgctaatggactgctctgttttccatgcgcactgtgttccggttgtgaacctcccgtaacgaacatagctctataccacatttgttttttaaatagatgacgtcgttatttttttcacatatttaaacattcatcttattaaaaaaatttatggcacatttgatcattcatcttactttaaaaaaaattatgtaattataaatagatgacgtcgttatctttttcacacatttgatcatttatcttattaaaaaatttatggcacatttgatcattcatcttacttaattatgtaattataatttattttgttgtgagttgttttatcagtcaatgtacttaagcatgatttatattttatatatttgaaaaataaataaataaaataaatggttatatctattaaaaaacggagtaagtatatgcatatgcagcttttaaattccaatctaaaacgaaacgaaattccgtagcgcgcagttgtgtgacatgggagcagaaatatttcagccaccgctctttcgatttcagagttcaaagtgaccgactgagaggaggagggttcaggaaggaaggagagggagaagaagaggcagcgtgcgcactcggcttcgtcagagatggggatcttctggagcaaggcggagccgccgccgccgatggtgctcgtcccgccgct

SEQ ID NO: 12474 - DNA, 1501 bp, Oryza sativa
accgacctgtgcccggccaaccacgcgctccccggcgaccgcggcggctggtgcaacccgccgctccaccacttcgacctctcccagcccgccttcctccgcatcgcccgcttccagtccggcatcgtccccgtctcctaccgccggtcagcaaccgccgccgccgccatcgattgatcaactcgtcgtactagctgataattaatccgccattgatttacccgtcttgtttagctcccaaaataaaaaattaaatatagaaaaaaacaattatgtgtaaatgacgagatgaattttttaagcctaattacgtcatgatttaacaatatggtgctataataaacatttactaatgatagattaattaggcttaattaataaattcgtctcgcagattcgtagcggaatctgtaatttattttgttattatacttcaaatgtgtgtccgtatattctatgtgacatgttaaaacaaaatttttcgctgactaaacaaggtctaaatgtgtgtgtagggtggcgtgccggaggaagggagggatgaggttcaccatcaacgggcactcctacttcaacctggtgctggtgagcaacgtgggcggcgccggcgacgtgcacgcggtggcggtgaaggccggcgggggaaggaaggcgcggtggcaggccatggcgaggaactggggccagaactggcagagcggcgcgctgctcgacgggcaggcgctgtcgttcacggtgaccaccggcgaccgccgatccgtcgtgtcgtacaacgtcgcgccggcgggatgggcgttcggccagaccttcaccggacgccagttcacctgagaagatcgatgagatgactcgtacgtatagtagcgcgcctagaacgatgatgtatgttgtccattgataggtcggataaaaaaaacaagatttcgaggaagagacatcccttaaacttcagattgaaatcgcataccccttgccacttattgcataccccttgccacttattaagtggatctccatcgatcgatcaatcattaggttcgattgacacgtaggaattccactgtattgcaatagtatgttgttagtagtgcgatggatgtaatatgtgaaactgacgtaatccagacaacactaatgtaatatattccccgtcttaaattagttgtcttactggattttaaattttgtttcaaaataattattattaaagtactacttatctcatcaatgaccccatataaatttctttccattttaccccaaccaccttctcactacaatacaaataagggcactataatttttccttccttactaaaccttaatttatgctaaataacctagaacgataaatattgtaggatgaaggtagtatgtaataggagaattgatccatgtgtcagttgcatgttgttggtgtactgctcatatgtttttggtggtgcgctattttctgtgcttgttaggtactatatatggatttcgcaagacatatcgagaa

SEQ ID NO: 12475 - DNA, 1180 bp, Oryza sativa
ccaaaaataccatcgccgtcaaggtttcgtccattttgcgccattaaaacacactgttcatcatatagaacttaacagcacggaatggacggaaacctaacggcgatggtatttttgagacaaagtcgtttgtacgatggcatttcttgaaactcacacttgtcgatggcatttctgggatttgaacgcttgtcaatgatatttcttggattatctctataatcaaagagtaaataattcaaccaaccaagtggatttaatgaaaaataatggcatatgtggtgcataatcctagttgataatacacaaaacaaatttaaaacgcttgaaaactacaaaaaaaaaaccataaacagcatgaagccaaaggtattgctcataagaaaagagcacacatatgtggctattataaaaacaatggcagccaactgcattataaaatatatgctaaacagttcttattctctactattataaaatttgaagatgtttttgccagtagtttggtacatcatccgtgtatgagtcagtttttaagtttgttcgcttttgaaaatacatatctatattagagttggattataagtttgttcgcttttggaaatactttttaagaaatctttttaaaaaaactcgcatgctaatttgacatgattttctagaaaaatatatattcaagcgaattctcacagtgaatttcacagtgagtaataataagattaaatagcattcacccgttgtaacacacgggcacttttttctagttaacttcaatatagaaaagttatagtataagctgtaaagttcactgtttgcctcctctttgaagtgcattataccaacctttataaaaaaaattgtgtaattactaaaaagaggatttgaaaggtattggacacgtatccactcacatagtgcaaaaactaatatgcttaaaccctaaaggacacgtagtaggccacacctgaaaaatgggttttaaattgccaatgggcctcaacccaaagatagccatttaacgatagccttaaaataatcgcagcgccgtccgtcgtcgtcctcgccagttcatcttctaaaatttcccctttcgtactcatattaaccgccgccgccgccgccatcctcaaatccagagcaagaaaagaaacctaatccaagttcccactcatttcacctt

SEQ ID NO: 12476 - DNA, 1501 bp, Oryza sativa
agcggagcagtggtcgacgacctcggctttcgctccgggcgtgccctggcgtgctggaaccggagcgtgcttcgatgacgacctcggtgcgtacggcgggcttgcggaggcggttccaatcgtgtggaaaacagagggagtaggagtccagccggcggcctgggatgacgacgaacaccccgagaggcagcggccgcagtggcgagcctggtgggcgccagatccgtgacgactggcgaggacagccggagcggcgcaccggatgtggaggggctctcccggcggtggtgggtggatcaacgggtcccctggagtggcggtcgcggaaacccggcgtggcggtggctgccctgcagtgccggcgggaaggagctccagtgtgggcgccgacggcagaacaccaagttagcggccggcggggaggagcagatcagatcgacgacgaccgtgggagatggagccagcaaggagatgacccccggtgaccgaggtggactcgtggaggtagctggtgctgttgctgtttttgcgacgacgcgaagaccaccacgcgatgaagaagtagaacacgaagacgacgactaagataggaaaaaaaacaggtgtccacccacgggagatcggaactctcccggggcagcggcggctctaggtcgcctgctctgatactatgttgaatagtatagggagagagaaatactgtaaatattgatacattgtattaagcatcagggaccggtatatattgtaatacatggattggatcttacggcccgtttggttggagggagtttttaggagggattgggagtttaaagagatgaggctattaagtgttttgtttggttgggagacatgacaattttggtgcgataggaatggggaattgagggaggaactctctcctttttaatacctgggtagaggcaggtaattgggagggaattccttctttactttgtctaagcaaatctcagccatctgtttttattaatgacctaatctccaactaaactctctatcaatttccatcacatctaccaaacaagatattgggattaaaaatcaaattctcatcttaatctcatcagcaattcccttgtgtaaactcccaatccccttccctcgagttactaaacaagccgttaggtagatttggaaactaatcctattctaccataacaaaccggatacaatactatctcatccatataccctagtagagggtgattgatccgtgcctgcccacacggggcgtgcgaccagagccaaattcacaacaatatcctggttattttgatgcccattgtacctgtgtgtgtatatatatatatatatataatataatatgtgtgtaaactttgtatatatacgtaaatcaattttttacatgtatgcgcatacacttttgctgtataaaacatatatacacgtataaaaagatatacaaactttgtatatgtacattatcgacgggtgatacccgtagactggatataga

SEQ ID NO: 12477 - DNA, 349 bp, Oryza sativa
tttctagccgttgcagagtagcacggtctgaccggccacatacctccggtcagaccggcagagcacagagttgggggatttcgcccccaacggctagttttggtgggtgggagtataaatactcccccaccagcagcaagggggctctcttggcacccaattcaatttgcacacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgcttgttagtcttggaggttgccgcctcctaga

SEQ ID NO: 12478 - DNA, 864 bp, Oryza sativa
ggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaa

SEQ ID NO: 12479 - DNA, 1501 bp, Oryza sativa
aacgaaccccacgacggcaacgagggatgtggcggtggcgggagcagcggcggagtcagtggtggtagcgttggagaaagaagagagaggaaaggggatagagatgaagagaaggagatggggagagaggaggaagaaaggaggggtgagaatgacatgtgggtcctaccattttttattattttatgtgtgaaactgacatgtaggtcccatgagtttttattatttttctggatcaaattgccatgtaagcggcacgtgaatgccatgtcagatgaagaccgagtcaaattagccacgtaggcgccacgccagccaaaaccgccatctaaaccgctgagggacctcatctgcaccggttttgattgttgagggaacccgtggtatctggatttccgattgaaggatgaaaatcggattcgttgacaagttaagggaccttagatgaacttattccgtagggaaaagaggtggggaagggagaagggagaggacttcggcccaaataaatgttttctgaattttagaagggctttagaaaatttggtttggatagaatttgaatttggaggaaattcacaaaagaaagattttccaaaagacatattatctagtttatttgagtgcaatattttgagagaaagaatacattggactaaatattaaagcactcaaataggaggggaaataaataatatgattactcacaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttgttggtatttcttaatgatattactagaaatataattcccagcaatagcgtagaaacactcttcgtatattatggttacagactttatctgcaagcgcacggatataacattgtagcatttcacccgagagtatttgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccatgaattttcggagctcgagaaatagttttaatagcacaaagatcattgcatcaattaaaataaaaagaaaacaattaaaatcccccttcctctc

SEQ ID NO: 12480 - DNA, 1501 bp, Oryza sativa
tttccatgcacactcttttcatactactaaatgatgtgtttttttcaaaaaaaattatatataaaagttactttaaaaattcatattaataatgcactaatgagccactccgtttacgtgtcgaagagcttactccctccgtcctaaaaaacgaatctagtactggatgcgacacattccagtataacaaatctgacacattctggtatgtctaaatttgtaatagtaggatgtatcacatccagtggttggttttttatgggatggagggagcagttaccaaccatcctgaaggaacacagccatttaatgtctttctatttggaaggaacaaatgtactccctccgtctaaaaaaaggcacacctaggtttccgtgtccaacgtttgaccgtccgtcttatttgaaaaaattatgaaaaaaattaaaaagacaagtcacgcataaagtattaatcatgttttatcatccaacaacaagaaattactaatataaaaaatttttatataagacggacagttaaacgttggacacggaaactcaatatttgtctttttttttgggacggagggagtatagccagtcaattacgtgcgtgcatgtcttgtactaatattttatactgaaagtgtgaccatggctagatgcttagtaaaatacaaaatattctttggattttcttcatgcccgtaaaaataaaaagggttaatttcatccatgccactgtaaatgttacaaatcaaaaatatgccactactattcacgttatctgcttggtgccactgtgaatttctaaaattggaaccatgccactccatcactcttttcgtcctcatgtctcccccccccccccccccgcatctcccctgccgtgccccgtttgccgcagcatggcccggcatcggtgtcctccgtggcagcgccgttccccgacctgatgcggtacgcgcggagttgcagctagcgcggcgctggcgcagatcctggacttcgcggcgcagcgactcgtcggggtctcgctggcgatgccgtgcccgctgtcgacgatgacacgatgtcatcaccgagcgcgtagcctcacgtcgtcacggagagaggatggggaggacaaaaagagtgacagagtggcatagttccaattttataaatttataatggtactcaacagataatgtaaatagtggtggtatatttttaatttgccgcagtggcatggatcaaattaacctaaataaaaagggtgtgcatctctataggtggcagtcgtaaattgcaatgacactaataagacacatcattagtgatgggtgcatgttgggaaatccagcatctatgtgaagttttcaggtgactagtcgacaacggctaggtaggttattacatatattatacttgtatgattttgatgaataagagtaataccagctttagccaacatgagtaggtttattaccttctaatgaagaggcggaaccttttgttaccttctaatgaagaggcg

SEQ ID NO: 12481 - DNA, 1501 bp, Oryza sativa
actagcgttatgtctttttttaaagtaagcatcttgacttgacgtcaaaaccagtgagttgagcttatcattttgggatgagctaattaactagctaagttgctataccaaagttttcagttcaagcagtgttaatgtgtttggctagcttgctagttaagttgctaatgtgtgtttagcttgctaagtaggcttcgtcagacggcagtagtgtgcaaatgcaagatggctaatattgttctgacgatcctccacttgatctccacaactgtaggagggttgttccgtcatgacagcaccactggtgcagccagtgtcgagttctgggtggcggcggcgacaacgctgctgctgatcaagttcgccgtcgattccatcggcccccgcttctcctcccagaagtacatcaaccctgctgtccagctcctgcggatactgaaccattatgctgtgagctacaccctggggctcatgccgccgtcgtcctcccatcaaggtaccgtggcgaacgccttcttcaaggtgtgggccgtcctcatcgtcaccatgcaggacagcatccgcatcggccggccgtaccagcccaaggagatgaccctcgtcgacatgctcacctcgctgtggtcggccaaccagcttcgggcgaagacggcgatacacctcagggtgcctctctggctcatgtggtccatccacgcctcgcgcatcgtctggtactacatcacctccagcgcggctgccagagctagagatgatgacatgaagcttgtcagtgactacatggcgatgccgacgcagcacacgtccaacgatgccaacccggccaccatggcggggtacaagtacatcgttctcggggaggagaagctgaagcagcagataaaggtcgaaccacccagcttcacacagacgcaacttgcgcaggaggaggtcatcactgtggagaaggtctggagccaagggagcagcgatgccctgctcggtgaggccggcgacagcagcaaccggttcaaggacgtgtgcctctccttcgccctgtacaagctgctgcgccgtcggttcttcaacttccccatacatgaggccagccatgcaggcacccggcagctcgttgtggacgccatcctagatgacaagaagggctacgagagggcgttccgtgtgacggaggtagagctgtccttcctccaggacttcttctacagcaagcacgctgatgtcttcgccagtggcttcccttgcgtgaggttgctgctatcgcttctgatgacagcagctgcctcatacctggcctacgcagtgcatgatatgcctagtgttagcacaggcctcactgccaagggccgcctcgctaggatcagccatggagtgttcgtcacccactgcatcatcgccatacttgtcattagagagctctgggagattatcgtgcacgtcttctcgcagtggaccaatgtcttgatcatctgcagctacatcaggttgcgaggacgtcaaggct

SEQ ID NO: 12482 - DNA, 1501 bp, Oryza sativa
ctttatcaagccggcccaaggcatgatggcccggtacgatagaaagcacggtccgacacggcccgtaaatgggctgggccggcacggcccgtacgtgagccgtgcctgggcctggacaacgggcacgacgggcggcacggcacggcacgaccactgggccgtgcttgggccggcacggtacgcgaatggctgctgcagcacgaggtcatcagtcatcacccatccacggtcaaatttcctatgcagccagcaggtagcagcaagtagcagctcgttttcttcatcggctcatcggtagcacgtagcagcaaccagcaaggccagcagcccagcaggccagcactagcatttggcaagattgttggctgactcacgccgccgcgccggtgggctacgtcgccgcgacgagccgacgaggaggagcaggatgggtgtggctgtcactgccgcgtcgccgcgacgggacgacgaagccgcaagccaccgctgccgcgtcgccgccagagtttcttctcagcgcagccggcctgctcccatcttttgggccgtgcttgtgccggcccggcacgaataggcccgtcgggccattgggctgtgcttgggccgcgtcctgaagaggccgtgctggcacggcacggcacgacgagtggggcgtgctgggccgacacggcccaatttggcacgaagcacactgggccgtgccgtgctagctctgcacggcccaagtcccagctttttgtgagcggtgagtttcttctcaccgttgcactatactgcaaccctgatctcaccacccagttcttcaatctcccgccagattttctttgtgagctgtgaatagacattttttagatctgaaaataggcaccacattggcactctcagtactaaaggactacacgaccacgtgaaatccaggtacgctagatgcttatcattagcatagaaacagtagtagctatgaccatacaatgttctaacatgcctacatgaaaaaaacagttgcaaaaaagtaacaaacaggcttcgaccattttggcatttttgggggaatacatgttgcctattctaatgcagggaaattacgagttcacttggtcaccctgcaactgcaagcattatttagttcttgtcatgcattgtttagatatagtacggaaacatacacctttcctctgtcaggtgcaccctcctccctttttcaaaaatgtaaagagatatcaatacaagtttacaagtgttctgcaattatatggttcaattcatgccattgctgtgtgataaaaggtttgtaggatttttaataatgcaattgtgatttttagcattgcatattttggtttggatggtgattacaacataatggtaaggaagaaagatctgttagttcatgcttgctctaatatctctccctccctttggcttgcacaaatttatgattggttagcatgatacattgactgattaaattccttggtctctccatcttatatttttgcag

SEQ ID NO: 12483 - DNA, 441 bp, Oryza sativa
tccccctagccacttcagcatcgccccgccacgtcggcaggggaacggcgccaggctggcgccgtcctgttgaacgacggcgccagccactctggcgccccaaaaaggactattttttgggataagtttttttaggggtctatttacgaaataagtttttcaaaaggaccaaaatgtgaaaaatccagctcaactgaccaccgaatctaaatcgtatccctcaaccgcaacaccagaaatctcgaccccctgaacttataaaaccggtacaatttgctcccttggtggttttggagggcggtttcactgacgtagcgcacacgtggcagtgtttacctgttctttgttccacgtggcattgacgtgacgcttacgtggcattaaaattaaaaaatatatgcgggcccatttgtcattcacacaaaaaagtttttgtcggac

SEQ ID NO: 12484 - DNA, 1501 bp, Oryza sativa
ctataacagtgagacctatgtatcaatccatcacttttttttttcggaaatccatcactttatttctctccttctccttcctcccacgtcccaaccactactccgtacctccatcctcaatgcaatatcctcccaagtgccaaccactaatctattcctccatcctcaatcctccaccctcggtagtagtggtgggagggcgaggacgacggcaacattaagcaagccgctacacttgcgtagagtgggtaggcgatggaggaagctagagttgaggatgaagatgtgtaagagggcagggagatgtatagataaatggccaataaattcaaaatcaatatttgtttagtagtaaaaagtaggccacaatggtgataaagctattagcgcatgattttatccattaaagctcaaatcctactgctgatttgcatgtattcctagagaagttgtaaagcctatatacttccattatcttaaaaataataataataataataataataataataataataataataataataataataaacaacgttattaataagtcatactacacgttgaattcaggcccaaagttccagttgaacccaatacaggcccagtacacatggataacaccacgtgcgtttaggtcttttaaaatacaccgaattgccgaataaaaaaagcgttttttcggcccaagtggcacagcgttaggcacgtcagcccaaaactgacctcaccgccgcacgcggcagcccaccaacttaggtcgttcttatccaacccaccagctcatcgcaagccagtactagtagttctagaacgttcgagaaactgaaccatcgcgcgtcgctgcagcggctcgccggtttccgagacgtgggcccacacccacttgggcccttgatgggccctacttggtccaaagcgagcgcggcttccgccactggattccagcgaaggacacgtacaccgcctcccgcacgtagggcccatttttgttcgagaaaagtgaagaaaaaagaagggaagggccagggcccacgaccatctcggcacacgtcgccttccaccttatcgtcacagcgatcgtcacacggcacacgataattttcgtcgcacaaatcgtcgcctcgtacgtgtggttcccttaaaaagggaaaacgtcgtacgcgaggactgaagaaaaggggaaccaaagccgttgcaattaccatcctcctctgactggaaatatcaacgacccctttctaaaaaaaaaaaacaactaatgccaacatttacttgattgatcaccgtgttttaccatagtttttgctctgaagctacgtggcaagaaaggacagtactgtatctctgtcacgtatgagccgtggccgcatagaaactcgaacattgtgacaaggtagtactgtacaaacttgagttgtggagtaccaaacagtatctggtcggtgacatccaaccaaacagctgttgatcctatctaaggcaagtagtactgtac

SEQ ID NO: 12485 - DNA, 1501 bp, Oryza sativa
cataaaagcacccgagatcatctatccacaatagaaataactttccacaggactcgatgatatggtaacggccacatctacggctatcttcttcttcgtccttgatggtacccaactgttgtagctcgatcttgccatcaatcacgtctatcgctatgagattagaagcgaaatcataaatctttcctccatagttgcgcataagagatgagaaactgatgtcgtcatacggggacacagatttggtccacatctcatcgccagggtggcagtgaagaaggtagcattcttcttctgcctctgtcgagctggcaactagtattgtgcagttcgcgctctccggagactcgagcatctcgtatgtggataggaacagcggaggctggtgcaacggcggcaactgaatcttggtccgcgggttggtggtgatgcggaggaggaagcagtcggcggtagactcgtccagcatcagcagccagtcgccgtgcatgcagcccaagcacgtcttccctcgaacctcaggaacaacggtctcgtgcaggctgaggtctgacacatcgacgaaagtcagcgtgtcgccgcgtgatccctgcaccagccatggcctcgtgccgaagcccggcggcagcgaattgtcgtcggatttcgcggccatatgtgtttgtttttctggttttcttttactctccaggtgtattgatccttctgtcttggtggttggctggttgcgttttatgcagcagggagccaagagatctagcaatcgctagtccctttcagtttcaggaatcagagtcgtggtctatcgtgattgcgctttatacagcagggatttcgctcgatctggaaacggatttgattcagaaatccgagttggtttcgtccgtttgctgatcagaagcgtgtgctggccggaggctttgatcgggcgctgggactgggtgggacggcggctgacgtccacgtcgccgcctcagatcgcaaaggcctctcccgcgtcgctgccgccggattactgcctctgccgcgagccttgagctgtctcgtttgggagtccgaattgaagtagaattgtaccctctctttttttttttgtctatagatcgactgaatcggagtccaatcaggatttgtacacaaaatttgactgcttaaatttgagtatggtaattccccctcctatctaattgtccgatcagaattgtacctcttttgcctagcaaactttattactgcatctgaatccaatcagtatttgtgcacaagatttggctaggcttatttttctacaaagtagtgctgctctaagttttgctcgcggctgggcgccgacgtcgcgatcggaagagctagcgcggtcgtgcactgtgtccttcgtatgtttgcctctcaggtgtattctactttggactcctgttcggttcgataataagctataagcagaagaaatccttaagaaaaaaggataaaacaaacagaagatattaggagaatacacggt

SEQ ID NO: 12486 - DNA, 790 bp, Oryza sativa
tttactaaaatagaaaagtaatgcggtgtcaaaaaggaaaccagatggagggagggggaatccgaatctgatcgctaggggcgatcgatcgccccttagcaatctcgctgtctatctagagtttggttgacagggcggctccattcatgcgaaaattctcaaacttttgaaagcccacctagcacttatttttctgaaatgccaaaactacggaatgtcatattgacgaataaatttaggtagtttatttagtcttcttaataatcatgaaaacacaaggttgaccaataaaagtgccaaagagaaactccctaacccaaaaggtaatttataatcaaattctataattcaagcgggattttcattattgggcctttaaggtccaagacctacgaacccgcaaaaaagagcccagaaaggaaaaaaaatatactttgactcccttaactatcgcccgagtttgattcttgtccttcaaccataaaaccgagtatatcgactccttcaaatatcaaaaccggtgcaaacaatgtccctcggtggttttagaggtggttttggctgacgcggcgggcttgaccgagtctttgtcctacgtggcgcttacgtggcactagaataaaaataaaaataaaaaaatatgtgagacccatatgttattcacacaaaaagtgtgcccactgacatgtgggacccacatgtgatcctctctctccttcccttcttcctaccccctctctcttccttatctctctcagaactcaagagcggtggcagatggggatgaggc

SEQ ID NO: 12487 - DNA, 1501 bp, Oryza sativa
gcgtcctcgccctcgtcttcgtatgccgaggacgagcgccgcgttgaggccttccaccagcggttcggcaccggcgcgacggagatgccaacttgcttggcaccgctcgccgccgccctagtagcagcagcagcaaggcaaattagcgtgcacgcgacatgcgcgaccgtggcaacgacggcttgcgagccggcgagctgatgccgtcgctccggcgcgccatgttcgagctagcttctccagtaggcgcgatgttcgagccgcaggagttgcaagcgaaaaaaccctactagccaccagcccacaactggcctggacgcgccaccgcagctggagatggagatggaggacatcgaggacgtgctggggctggctaggctcaccggcggcgaggcgccttcggggctccgtctcccgctcgccgccgtcgccggtccgctcgcccacgcgacatggaggacgctgccgctccccatccgccggcgccgtgcgcgcgtcctcctgccaccaccgccgcttcgctggtcgccgtgcgcttgcacgctgcctccgccggccgccgcttagccccgctcgccgccgtccgttgctactccgtcacggcaaagagaactaaaaaaagaagagaaaaaaaaaagaaagggaaaagttggcgtggcacgctggcatgtgggtcccatgctaactcagccgtagaccaaaaccggggtcaaagccgctgaaggatctcgggtgaccggttttgtatatttaagggaccccgcatatctgggtttgtggtttgaggatgtttttaatatcccgatgacaaattgtgggaccttcggtgtactttttccattagtaagttctctcgtggcccaatactctcttgatgggcctgaagcctcggcctaccaacggcagcgaactccccaaatcgccactaggccctccccggctggattgttcaccctttcttttcttctgaaaacttattttataaatagattaaaaaaattatttcgagaatagaccttttccacggtcccaacgttaatgatattgttgtccaacatgacggtatcagacattgatagtgtccccttaattttctcgtggaagctaaatcatttacataaagggatggcttgctgctgagaacttatgtgtttaaagacttatttttaattataaaatattttcaaataggttctttttgctaacaacactagcgccaatgaagttggagctgcgaaaagatccattctagaatattttttagggatctattcgtaaacaaactttcaaaaaggtgtaaactaaaaaaataatccatcccacaatgattcaccccgatccggttcgccacgtcacccccacgcaccacgctacttcccagcgtggcattgttcgcggagatcccttttcctcgcacgcgcactcacctcacctcactttacacgccgcctttccgacgctgacagccgggccccaccacagacctcgacggccatggacc

SEQ ID NO: 12488 - DNA, 1501 bp, Oryza sativa
tgaagtgataagaaagccaactatacacaccgagctgataattctctccaaaatagtctgtgttcatgcgcgtgccatcaatggagttgttgactccgaggatgtctgaacgatccgcttgcatagagcatctgataaactggctttatcctcgctatgaaaaccacactcactagggttccacagcaacaaacgatggcacaaacgtagaaggtaagcctgaaacagtcaggcccaaggcaggttgaaggttccaacacgcctggctgctgcttcgccgcttccttgtcatagatataaccagcgagaagagctgagaagaagaatgcacctaggggattcactaacaacatgaagttgtacatcaacccaaagtccttcaacccaaaaagttctgagactgtcgggatcatgacagcaaattggacaccgtaacatatgcccagaaatgttgttgacacataaatcaagctatgaaggccagttgcgaaaaggaggaaggttatcaccatgattatttgtgtgcacatcatccagaaagggcgaggaagcattcttgacctgcaatcaggttttactcgaatcattttacagaagcagcaactaatagttatcaagcatgtagcttaacaacaagagtaaagaaaaaatcataggattgtggatgactaggaatatgcaaagtgattgccagtctgcaggagataaatatcagcggccagctcatctgagtagtctgccaggatttcacaggaagtgctgaggtgatagtggcttttggcctcatatggtcatatggagtaatatcagtacatcacagtaggcaagaacagaaaatgttatgtctttggcttatgttagttgctatatatgtcagctatgcaatgatagaaattgaatgaataaagtaattgcaaagtggttaaagggagctgaccttacgaaatattcagagacagacccaccaaggatacggccaacaaagttgcagaagccgaagaggcacaacaagatagtagtatcatcagcaccaacagccatcccaacctgagctaggttgttcagaacagtgacaccagttccaactccacaaaagtacacaataaatagtagccaaaagtctgccttaaccaatgcttctcggaatgtgaaatcgtccccccttctaggccctcttttctttttcaaattcacggctccctcaccctcggccaaaagaagatccacatcagtagcctcatcagaatcgttggctccagtgacaaatgttgaagtgccaccaagaagtggttctgaattctcttgatccggaccagacaaactatcagtcgaataagacagtgcaagggtgctagtcttttccctttttggtttgtttggataaatagtcatttttattggtattgccagtggagaaaggagcaaaagtatcattataccaaacaaaaggtaggtaatagcgtcacttagttttaaagtatcaccgagaattgtagctacc

SEQ ID NO: 12489 - DNA, 1501 bp, Oryza sativa
gcacccaacccaaccccgacccgattcactccctcgccatcaatacaccttacgcatccacatgcgcatgctactagctcgcgcctgaacaagagccggccatgcatgtttatcctttttcaaaagaaaaaaaaacacgaaacatgcgtgcatccgggatgccagctttaccagctagatagccgccattaagagcaagtttaatagtaaagcgcgctgcttactataagtcaatcttagagttaacttgtataataagttagctataatgttaactttattttttccattctctctttctcactctataaatttgatgtatgtttcttgaaagttgtgtgaagctagctcttgtatgagagccttatagcccattattatccttgctctaacgggggagcccgagctaaggtaaagcacaagtacacgcgagacacgggtctcctggaccagctggtacggccggggaattaaccggcctcgccgtgttgacacgaaactttttctcgatcgcatgctgccggagaatcgtacgtgtaccgctgttcgaaatccatagtacgtactcctactatagattgtcccagccgaccgtccggtatgtcgtcgtatgctcgtacatgagtccgtctagtgtagcgcggcgtcggttgtgcgtcccccgatttataatggatcgcatcggcgcattcgctatagtggttgctgctgccggtgcgtccaccgtcgttaatgccggcgcgcgagagatacatgtacgcgactagtagattctctacgccaactcgatcgatcgctctctgcgtccaccaccgaaactatttctgcatgttcatcagctgctagctgttcttgcacatagtggtggtggtgtagtggtgtgtgagactgtgagtgattgtgcgctcgtgagcgagctcagctgggctggctagctcatgagcatcccgttctcctcggctgcaagatggatcagatgaggcggcagcggcggcgggagtgcattggtgttctttgctcggcgctgtttttctctgtcctggcagtggccgtcgccgcaggctccggctcgtcgtcgcagccgccgtcttcgtctccggcgccagctgctagctcagcaacgccggctgcgagggcgccttctcaacggacgccgccgacgccagcaacgccggcaaaggcggcatccccaccggcgacgaactcgtcgtcctctccacggacacccgcggcgccagccccgaggcctccacagccgccaccggcgacgtcgccggcgccaacaaagccgtcgtctccacccgcgccgaagccaccttcccctcctgcgccgtcgccgtccacaacgccgtcgtctccacccgcgccgaagccatcttctcctcctcctgcggcgacgccgaccacaaagccgtctcctccaccgtcctcgccaccggctccgagaccgtctcctcctcttcctcctcggacgccaccgccaccgccgccggcagcggca

SEQ ID NO: 12490 - DNA, 1501 bp, Oryza sativa
ggaacagtacggagacccagatctgcttgggcggcttccccttatcatcagtcagttatcttctgctgtctgctggtcctccatgttcttgagaattaacacctcacatctcgctctggcattcaaagtagggagtaatggtgcaacgatgcattgtcccccaatggctccaaaaatgtaggatactgttgggccactgttccattcatggtgctcgtacttaccaccctctctcggttcagagtccatatatatcccccactagtttgacttgagtttaatttgctgggctcctgtgacaagatcggaagaaactctccaggccacaagattcaagtctttgaaaaaaaaattaaggccacaggattaattgctcgatatatgtagtccatggacaaagctaagctatagcaaatgtacttgctgatacgagtcttgaaaatctgaatttatttttgagatattggaatattgtgagtatagaggccaagtggttcgacttaaatttttccttaattaaggtgaaatattgcctggatttttgttgtcctgataaagtgatttgatgtgcacgcgctagctggatgcagataacaatgaagtttggctaagagtcggtctactaatgacatagctagagaaggcatgcattaagtttacagtgcaactagtcatgcacggtgagataatacaccaaaaactagcaagtgtcaaatatgctagtagctggtttctctgctgaaatgggtgaggtctaagtgaatgcattgttttttttcacaaatttaaatgtatatatattgtgaaagtacctaagttagtatgcaatattgcatgcgataagtatagaatttatgtgccgatagttagcaattgatatttttaactgctcacttcaattcatgcatgtctaataggaatatctcagatagcatattgttctagctaggttccgtggcaatttcagttgttactggtccacttgaaagtctatgggtcgtagttaagtcacaccttatcgatgcaaagtacgatatctctcctctcttgttcatttttccactgcccataaatatcttgtttataagtatatatcaaagaatcagttactaacactggatcatggatcttacatgcatacctgctgctggtttttataagtcaagaactcgagcatgcacatgaaattgatcattcatgcataacctaattaaagtcttttcacaaacatgttaatgatcactttgctgcatctaattttattggagtactccatgcatgtctctatcttatgcatgccacattatctttttttttaatccaacaattatatatatatgactatctcttggattatcgatcccccctcgattccatggcattaattaacatcatgcacgaattttactttaattttggccacttactaattagttctagtaaattcttggtttatgaccggcatccttaatccatgcgtttgattaaaaaaatgggagga

SEQ ID NO: 12491 - DNA, 1501 bp, Oryza sativa
gcgtcctcgccctcgtcttcgtatgccgaggacgagcgccgcgttgaggccttccaccagcggttcggcaccggcgcgacggagatgccaacttgcttggcaccgctcgccgccgccctagtagcagcagcagcaaggcaaattagcgtgcacgcgacatgcgcgaccgtggcaacgacggcttgcgagccggcgagctgatgccgtcgctccggcgcgccatgttcgagctagcttctccagtaggcgcgatgttcgagccgcaggagttgcaagcgaaaaaaccctactagccaccagcccacaactggcctggacgcgccaccgcagctggagatggagatggaggacatcgaggacgtgctggggctggctaggctcaccggcggcgaggcgccttcggggctccgtctcccgctcgccgccgtcgccggtccgctcgcccacgcgacatggaggacgctgccgctccccatccgccggcgccgtgcgcgcgtcctcctgccaccaccgccgcttcgctggtcgccgtgcgcttgcacgctgcctccgccggccgccgcttagccccgctcgccgccgtccgttgctactccgtcacggcaaagagaactaaaaaaagaagagaaaaaaaaaagaaagggaaaagttggcgtggcacgctggcatgtgggtcccatgctaactcagccgtagaccaaaaccggggtcaaagccgctgaaggatctcgggtgaccggttttgtatatttaagggaccccgcatatctgggtttgtggtttgaggatgtttttaatatcccgatgacaaattgtgggaccttcggtgtactttttccattagtaagttctctcgtggcccaatactctcttgatgggcctgaagcctcggcctaccaacggcagcgaactccccaaatcgccactaggccctccccggctggattgttcaccctttcttttcttctgaaaacttattttataaatagattaaaaaaattatttcgagaatagaccttttccacggtcccaacgttaatgatattgttgtccaacatgacggtatcagacattgatagtgtccccttaattttctcgtggaagctaaatcatttacataaagggatggcttgctgctgagaacttatgtgtttaaagacttatttttaattataaaatattttcaaataggttctttttgctaacaacactagcgccaatgaagttggagctgcgaaaagatccattctagaatattttttagggatctattcgtaaacaaactttcaaaaaggtgtaaactaaaaaaataatccatcccacaatgattcaccccgatccggttcgccacgtcacccccacgcaccacgctacttcccagcgtggcattgttcgcggagatcccttttcctcgcacgcgcactcacctcacctcacctcacacgccgccttcccgacgctgacagccgggccccaccacagacctcgacggccatggacc

SEQ ID NO: 12492 - DNA, 1501 bp, Oryza sativa
ggaggggagagagaactcaccggcgacacgagggagatggggtttcggtgggattccggcgacgcaaagcggcggccgggaaaggtcttgcggcggcgaagctaggggtggcggtggcttagcgcggcgacggctctagcagcggcggcacacggccggagtgcggcggcgcaagcagcggcggcgcgagctcggtagggggcacgggatggagcggtgagagcggaaaacgagagaggagggcatggggagcattttataggcggagggggaggcggacgtggccgggaggcaccccgatttcgccggcgacgtgggggaggagagagagaaggtggggacgattcaaaatcgaatcctgcccttctcgtgcgcgggcgcggccggaagacgcggggagaggggggagtgggtgcgggaggtgcggcgcatgcgcgggcgtggccgacgtggcccggaggaggcggaggcgtgggcgcggcggtggttgcgggcgcggcggcgcggcgcgaggtgggagacgggtccgataggtgggccccacctgtcagcgacccgggtgagaggaggcgggcggccggcccgcgcggcctagctgggccttggccttcggccggcccagcgggaggagggggagaaaaaggaggaatgggccggcggcctattcaaaggaaaaggggaaaagaaaagaaagaaaaaggaaaaagaaggaaaaaggatttttcataggattaaaattgcatgtgctcaattttaattggttaaaattatttcgagagctctgaaaattccactaaaaatcttgttagcgtatttcgacatgtagaactcaaaaaaaaaattccacatgccaatttcgattattatttgcattaatttattaaggttttctcttgatttgcaccggcattttcttagggtgatttataaattcaattttagacttaggaggagaacttcagggtgtgacagagataaagagagagaacggggagagagggaaggggaaggagagagtgaatgacatgtagggccacatgtcagtggggcccacaatattttttatgtgtgaatcacatgtgggtccatagattttttttttaattctaatgccacgtaagcgccacgtgggacgaaaactaggtcaacatcgccacgtcagcgccacataagcaaaaccaccctccaaaaccaccaagggagtcaaattgcactggtttcaatagtttagggagtcgttctatccggttttgtggttgagggtcacatattagattcgggttacttttaagggagtcaaatttaagggagtcaaagtggacttattcccctctgtttctagaccaaaaaaggccggtaggcattgtttaccttcaaagcccagaggacattccatgtggtcagcaaagcgggatatagtaggttgttcaacaattccaacactgcctttttatgttgagaccatctccaaaaataattatctccacgagccatatctata

SEQ ID NO: 12493 - DNA, 1501 bp, Oryza sativa
gtgggggaggaagaagaaagagagaggatgacatgtcagtgggccccactttttttatgacaaatgggtcccacatatatgtttttaattaaatgccacctaagcgccacatcaagaccagagtagatcaacaccgccacgtaagcaccacgtcagcgaaaccaccatccaaaaccattaaggaagtcaaattgcaccggtttcaatagtttagggagtcgttctatccggttttgcggttgagggtcacggattagattcaggttactttttaagggagtcaaagtggacttattccaaacagagcccgagtacccaaccatacgccctctacatgggcaacggcccatcagcgtggccagattgcagcggtcgcggccgaggccgagagcccgataatactcgtgggccttatccgctaaacgctcatggggatcacggtagtctaagcccatagaaaacggcccatctgagtgggctaaatcgctcaggtgctggcggtagcccatatggtgatctgagctttttgttattattttttaaacaaaaaatacataaatataattttcttttacaaatttacaaacatcatactcctttcaccctatgggagagtttttttttcataaattgcctctcaaaaggcggttctgatggagattatggtggttgaatattgcgtacatgcctttcccatgctccttagaggcgacttttatatgccacccaacccaaagacagtgaaattaaggcctatatatgcttgcgagaaaaataacggtcatgagaaatttgcatagactacttttgttctctaggtgggcgggatatttaaaattattctctaggagtgtgataaggggctatacgcaaatgtcccatgcctaatgccacgtcatcagatctgccctctagaagggctgtttttaaagcaaatccctaaaaaaacactcccacggtgaaggagtattttttaaaaaaatttacagaagcgaaaaatatattcctgtaatttaaaatatatattaaaataaaaaataaatatttgagcttccatttgttagttaccatttttggaataaaaaatggttggatccataattttcttcatttaatgtatttcaagcatatcatgtatcgttgtattttcaattatatttttcaaaaggagttttataaagcaccctatgtatcgttgtatttttaattgtacatgcctaatttctcttttcgagggtacaaaaataaatcaaagacctataagaggaaaaggtgaaaaatacaggcatagggatttatgcatcagtctaatcccaaattttgtagcttccactcccattaatgtttgggaatccgataatgacatatccatgtttatgtatttattgtctttttttctgtaaagagatttagaagcattaaattaagcaaaacatatatacacgtacttcatttattgtggtgaagccaatagtgtgcacacacactcctacccacacca

SEQ ID NO: 12494 - DNA, 1501 bp, Oryza sativa
ccgacgtcgcgcggtatgtcgcggatggttgcgagggcaggttccgtgggaacaaggagaccctgccgctggttgcggagtacgccgagtttagacagagtgcgtccattgctctcgcattgatagaggcgatatcaccaccgagtgatcagtgaatgtgtgtttttactctcagattttgtaagccaaacaatgtagatgaataaacatggcaattatcaatctattgttttcctgttactattatctttgtttattttctatttcatttttatggccgagttttgcgttgaaaaccggttatgcttttgaaaaaaaaaagatgaagtcaccctttgctactttgtttagaaaatagtcattcatcgtcgcataagtagaatagttatctttgctaatttacttataaattaataaattgtgtgatttgataaaagtggattaatcttaaaatatgctccgctagctaatttgatctattgattttaactactccgttaattataccgtaaatcatcagttgagtgtgtttggcaaaaaaaaaaaaaagcgtcaacaatgttagtagtactttcgatgcaaagtataacagccaacaagcacttgaaatatagtgatatgctacctctacaccaaaataagtctatttttgagatagattaatacaaatacaaactaaaaagtggactaaaatacaaactattttatcaaactaagaagactaaaatactttgcacttgagatagactaaaataactctaatttattaaatatcaatgcaattatttcttattttatccacttccaatgcatatatcaaacaaatactttcacaaacttcaatgcaatgattactccaaaattaacttattttactagaaacggaaggaactaaaaataaacgtatccttctcttgagatagtatctatcaccactgttggcgtttgcaagatttgtgtatctacatcatatctgttacgggccttccagcccactgcccacgccaaattcacctctccaaactgcaaacatccggacaacggaatttaaggcccaggtggcaactatcagttattctcttatttcacgattattaagcagactctgtttcgtaataagagattttcgaatttcgaccatgaatttgtaaagggaccttttggaacttcccccgattaagactctggcagttcgacatgtggtgtctaaacatttcgtcatgacatgaaactatatagattagatttggctcgaaaggaacagggaccctgtcagcaggtggctgatcctaatttctgaagaagagcgatcctggttcctggatcccgagactcgcggcaggcgtgaagagactgcgagacacccgccaacgtttcagcaggcgtcatccaggaaatcctcttgaatgaatgaatgaatggtgtaatatctcgtaatgattccagtgcaatcaacagctggatcctcttttattgttcagagattaagatgacgatacct

SEQ ID NO: 12495 - DNA, 1501 bp, Oryza sativa
ctgatcctaatttctgaagaagagcgatcctggttcctggatcccgagactcgcggcaggcgtgaagagactgcgagacacccgccaacgtttcagcaggcgtcatccaggaaatcctcttgaatgaatgaatgaatggtgtaatatctcgtaatgattccagtgcaatcaacagctggatcctcttttattgttcagagattaagatgacgatacctgctagtataaagttgttggttctaccacgaaaaaacacaccaaacaagtaaccaagcggcaccaggacaagaaaagccatgacgaccatgaagcttgtgcgatcgttctctcctctcatcgtcttctccttgctcctcctgctcacctcctccacgacgtccagagcctccctcgtggacgacgcctgcacgtcgttcgcggctagccacgcggacatcggctacgcctactgcgtcaggttcttccagtccgacgagggcagcgccaccgcggacaggtacggcctcgccgccatcgccgtgaagatcagcgcggcgacggccaggggcaccgccaagcgcatcgcggacctgcaggacctggagcgcgacaagaggaggaaagattgcctgagcgcgtgcggggaggtgtacgactccgccgtggacagcctcgacgaggcggccaagggcatcgcgtcgcgcagcgccgacggcctgcgggacgcggtgaccgtgctcagcgccgcgctggacacccccgacacgtgcgaggacgggttccgcgagctcggcctggcctcgccgctggtcgccgaggacgaggagttcagcaaagagtcggccatcgctctcggtgtcacatcggccttatcgccgccgagctaggatgacgtcacaagagttacagcgtctgtaatcctataaatcctttgcgtaataaattaattactctggaaaatcacaggacaaaattacattttctcactaattccgttgtcatataattttccatttttggaagaaactggttggattccttgtgcacctattctgagaccgatccggccattagccatgagatgcacgtacgattgttgtttttttcccagtggaacgcacacttaatttacggcatatcttgtgaagaaattattgcatttcagctaagatataatcggccggcatctttgcttaaaaaacaacaatctgctgggccgttccaacggagattggcagctacctcgccctgtaaacgtcatgcacgtctccacggatcacgacgtgacggcgtccgaggctccgagccagcggcggcgcgagctttggtgatgcaatttgttgggctttctgcttgccttacctgggccgacctgtatgcacgaattgggctaaattcccaaaaggaatccaaatctcccttcaaaaaaaaaggaatccaaatccttttcgttcccgggggagagggataagggatgaagatttgttgaatacttggagcaagttttatagctaatttcatg

SEQ ID NO: 12496 - DNA, 1417 bp, Oryza sativa
caagctctttatgggcggccaaaattgcaattagccccttgccgccctttgtatggccggcaagggcctaatcgcaattttggccgacggcggcaaacggcgcggtcgacccaccgtctgccacgtcagcttgccgcccaccattagggcggcaggggctatttctgtaatttttttggtcgatagattatttctgtaaatattaaaaaaaaaaatctaaaaacgaaaaaaattccaaacacgattcggttccgagatgatttatggcccaatacaaaagcccattaaaaatctagggtttaaaggtgggaaaaagtccactttgactcccttaaatgtataccgaatctaattcgtacccctcaaccagaaaaccggttaggatgactccccattttactaaaaccggtacaaatagactccctcggcggtttcaagggcggttttgctgacgtggcggtgttgacttggtcttcgtcccacgtggcgttgacgcggcactgatgtaagattagatttaaaaatatatatgtgggaccaatttgtcattcacacacaaaaattataatagaatccactgacttgtgggggtccacatgtcattctctttccaacctttatgcctccctctttctcccttatctctctctttctcttcctgtcggcgagcagcgcggagagcttgccgagggcacggatggcggagcagagggcggcgagggaacggagtggagggctccaagggagtgcgcgaagctgtgaagccgtgaggcggcggtgggtggagaaggccggcgtgaaggccgggcggagcagcggcatcgagagctgccagtcaccgcggtcgctcctgtcgcgtatcctacagcgaggcgacggcgacggcagcggtgggaagatcgggtgccgggtgcagctgccgtggcggtacagctccacctctgtgttgatgcgatgttgttaacactccgccgccgccggtagtggcggcggcggcgtgggaagttcgggtgctggatgcggctaccggcgccggccaaggtcaaggtcatcgggagggcgccggagttgtccctcgacacgccgcggagttcttgtacactcgacgaggggagaaatggtataattcttgccgtgcgcggcgccggtgcagtgccggagacgagagcgacgacacggaggaggtgactgacacgtcggcgtccttcgccgccaagacagacgacgtggcggcaagaaggccaaggacggtggcggcggcggcgcggtgctggtgacggtggatggcgacgtggagctggagatggagacgctactgaaggcgtcggcgtacatcctgggcgcggcgggcagcagcatcgtgtacatggcggtgctggacgacggcgccgtgctggcggtgcgcaggatcgatagc

SEQ ID NO: 12497 - DNA, 1501 bp, Oryza sativa
tcgagctcctctccttctctacgctttccccatcgagccggcgagcttctccgcccgcccattcctctccttgtcgagggcagacggcggcgacctcgatggcgggacagctgcgcgcgtggcgaggtagcgggtcctgcatgtgaagcatctagtcccccgttgttaattttggtaattaatgacaagcactaattgtggactaaccgttgtctttgagctatatattttaagttaggttcacgtcatatgtgcgcatggatgattatcgatggattaaaattgacggcgcaaagtaaagggaaaaaagacggtaaaactagtgcttttgttttgaattaatcgaggtgtagggcgatcaaatttgctagtttatttttagtttcgacgtactattaagaggggtaatgatctagcaaagagatgattttaattgccacattaggtcattatgcatttagacttgtgctcacatttcacacaacacacactaacaccttgtattcactggttttcggcctgaccaagggcggtcagaccggccaccttgtggcggtctgaccggcggtccctggccggtctgaccggccccaagcgggcagtctgaccggcgcacaaggtcggtctgaccgacggcacttgtgcggtcagaccggccccctgaaggccgggatggtgttgctcggggtggccgatatagagccgacggagccgtattcggtcagaccaagttgagggcggtctgactggccaccccatgtcggtctgaccggccaggccgattgggccctctgacagggctacaacggctagttttctagccgttgcagagtagcacgggctgaccggcctcatacctccggtcaaaccagcagcacacagagttgggggatttcgcccccaacggctagttttggttggtgggagtataaatactccccctccagcagcaagggggctctctttcggcacccaattcaattgcatacaccccttgcatctctctcacacaccttttagcttagtgttcatccattgtagtggttgaggttgttctagccaagagtcaagtgcattgcttccatttgtagagctagtgtggcacttgattgatcatctctacgccgggtcattgcttgttactcttggaggttgccgcctcctagatggcttctggaggagttgcccggtgacttctccgagaagattgtggaggaggcccggtgccggtttgtgggtggtttggagttcaccaacttcggagtgaaggaagaactaccccgagtgatcgaggcttgggtagtcctctccgtgggtcggctcccgccttgcccaccccttgacgaaggaggcgtgcggtggcttcgtggttgagcggtggagttgggctcgcctcaacggggaataggaaaccggcgagtttccgaacctcggtgaaaaatctcttgtctccttgtctcatttgattgtcgcatttacatttgtgcaatttacattccta

SEQ ID NO: 12498 - DNA, 1501 bp, Oryza sativa
gaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttcttttgatcgctctattcccattccatttgttgactatgagctgattgttagattttttttttacgttgactacattgtacttgttggtcataagtaagtgcttgcttaaaaagcataattgtcatgtgaacaaatttcaacaagaaaattgaaagtgaaatagtaattagttgaccccggatttaaaaattcttatatgaaatttgataaatagttttagactaaattttacgaaatattaaaggatagtttcactctactctttccaaagaaatttaaagtaggttcaattttacttattttttaaaaaatacaaattttatttatgagtggaagataggaaaaatggtgatccgtgtaatttcccttttaaaatttcaccaaatttggttgcaattcactagaaaaatttaaattttggttttcaaaatttggaattttggccccttaaattgttgtataattgaagcttttcaccttgataaattttataaaattacatatattttgatcaaactattacaaaataatatactttaaagtggtgtatcataaaactatagatttatgactgaatttatataaaaaaaactacatatttaagatgaaattatcccagaactatatggtttgcacaaagtacagtacaaaactacaacatttgtaactacttaacataatagtatgtagtcgtagggatttaaattgtaaaacctatagttttgtgatgactgtagtattaaaattgtagttttgtgatacttggcattaaatatgtagctttgtgataaatcttgcgttaaatctatagttttacgatacaatatcttaaatatgcagttttacaataatttaattaaagtacagttttgtaaaattactcctacatatttataacaaggtacacacaacttttactactatataatagcaggagacaatataatcattttatttttaaaatgacattcacgtatagtgattggtttggtcggaaatacatgacgtcataactgctaaccacaattccctcgtaccatcacatggcaaacacgcgcgaaatctgacacgcgaaatagtacgaccgtgacgcgccacagctctccccctatccgatccgacgaccagcattgagcgcgctccccctgccacgtcaccgatccgcgtactctctcctcattggctgcctcctcctatataggattactccccctcccgcttccacccccaacccaatccactccactccaccgccgctcgctcgccgccgccgccgcgtcgtcgtcgtctccggcctccgcttcctcgccgacggaatcctagcttagcca

SEQ ID NO: 12499 - DNA, 1501 bp, Oryza sativa
gagagaagcatacatcatagatatatgtaaataaacaaataaacaaataagaattaggcagttattttgctacaatacaatccttaattcatcatgagaattatgattatccatgtatgttttttctttgccaagtagtattggcaaacaatcatgtaaaacacgtataaaactataaattctatatactgagtataattgatgtacgaatgttatacacctctgaacccaattttgtcaattcattactttaaatcgactcaaaacttaaaaataatactgttttcgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttactaatgcaatcatttgtagtgtgccaatggtgaattgagtgttaaaattgtaatttaagatggtatttaggggcacggttacatcgatgcgagacccgtgtttcaaggcattatgtaagaaagcctaggttggctgctacggtcgacttcatctgttagaaaatcattcatgaatatttttaacagtgttatcgtattatctagtagatatgatatttttagacaatttatacatagaagtgaaaataagttatgcataccgggttatgcagtgtagatgatattttttgtgtataaataatgtatcatttattttagtggtacaaatacagtttcttttattaaaagtgtacctaactttcaaaaacaatgataataagtagtggtgataaaagacgagtttatatatgaccaggacaaagggatttttacttaaatctaatagacattctatcacatttagtaatctataccgtctattttacggcaaatatatttgtttttttatttagggtaatctacattcccttacagggtatatgtattaatgtatatactaagatatgatttattttagcattctttttcttgaacaacaaataagatgcccgtgcatatgtgcgggtttcctttccgatttatattatgaaaatatcctccattttatattttgtccttacattgtttgaaacatagcctatgatacatgcatgcgcgcgcgaatgcgcgggctaccttcctagttagttcataattagtgatacagtaacccatatgtgctaataacggattaattaggctcaaaagattcatctcgcggtttctaggctaagctagttataaaattagtttatttactcatatccgaaaatctcttccaatatccggtcaaacatcagatgtgacacctaattaataattttcttttggctagctaaacgggcccttgcatacttggacatcgtatctgttcttttgaatatcacacagccttcctcacagaccagacgacagagcgtatggctagagggcacgaaccgagagttactaccattaccatga

SEQ ID NO: 12500 - DNA, 1501 bp, Oryza sativa
agatttcagagggcgatttaatagcccggaggatcaaacaaggccaatgtattttgtacaaaattttttttgtgtagaagttgttttaaaatatattagataaacccacattttagtttaaaataattaaaatttaattacatgacttctttcgctttacatgcccgtatttaatcctcatcttcatcactaccaaaagaagcctctcccttcgttctcaaatactgacacgctgttaacaacatatctgtaactttgcgttgttttttccagattatttactggattatcggcacatgtttatttgctctatactttgaaaatatgctttttgaaaaaaaaaactttcttctactacattttttagatcagcagttctaagatatttaaagtcttttctttaaaaaaatatttgatttaaccatctaactaattaagtagataacatgcaacgataatttatttaataatctaaatcaaacatggccctgaaatttgtacgattatactatgaccctacacatttcctttaaaaaaagagcacccataatgactaatcatagactaattagacttgaaagattcgtctcatgatttttatgcaaaccgcataattagagcaggtacaatagcaggctataagccagctgcaaacttattttaaggagataaataagaagagagaagagcagcgggctacagatttgtagccagctgtagcacggactccaagatgcagtgtgtgtatgataagtggtactaggtattaataatgtagtatgtacttattgtatgaatgagctattagattggttatagatgaattgtagctactagttggctatactattaaacttgttggtattttttttatctatatttaatattctattccaaaatttttccggaaccacagggccgaagtcaacagacccccaaatccccaatccacatgccatcttacatccgggacccgttaacccgtttgcccaccaccgtcctcctcctccgacccttctcccccatctcgcgccctcctccttcccggcgccgcgtcctactccccctccccgcaggcgacaccgcgagagccgagaaaacgaggcctcgcgccgccgcctctctccactccggcgcccctccacccacgacggcctcacagcccacctctaccgccgcgtccccgccgtagccggccgtcgcgggcgccacaatggtacgtgcccccccccaacccccccgcggctctctctcgctctcgccttcccccaggctcgcgctgtttaggtttcgccgcgaatgggggatcggtgtggcgaggcgaaccgttcgacggccgcgcctcgccgcgccgtgccgagatccggtggctggagcgtcgaattccgcgtggatctggggttttttgtttgttgcgtactgacgtgattgcattctcgctcgtgttctcctgtgattttttttctctggcggcgaactggcgatggctgtgaatgttggc

SEQ ID NO: 12501 - DNA, 1501 bp, Oryza sativa
ggcaacaagctcaacggcaatagtgagcctcttcctctgttcggtggataaaccattcactcctggcagtcccaccagtgctcccctcagtgatgtcagctcaacaagttccatgacttcttccacaaacatctgcatccgtgaagtgagtcagcatcacaatgcaaaatgtgtaatgagctagcagagtaaaggctgtttgactaacctttcttgcttctgagtctacttcagagggtaaccggagccatgctgagtacagaagggactcgtaaacagtgacatgtggagagtggatatcattttgctcacagtaaccagcaatccgagcaaaggtctcttgcttctttgggtatccagagatggagatgtctccttcaatgtaaccgcctgttttccttcccgccagcacatccattagagttgttttaccagctccgctaacacccatcagtgctgtaaggactcctggcctgaaagctccgcttacacctttcagcagcagtagccgatcttcagtaacacctttatctttcatttcctgtcaaaaattgtgcatcgggattagcataatagcatttggtggtatatttgttacacacagggaggcttccaatgcttgcttacctgaggcatatccacagagtatctgatattgtcgaaggtgatcgacagaggagtaaatggaagtaccattcctctcttcctggtgtcagctcctgtaatctctcctcttcctgcatttgctatacttgttaaaaggacacaacaaaatggcatatcttgttcaatgccataatacagaggaatgtactaaaaagactgaccatcagaaggtgaattctgggaatctgttccaagagtcagcagctcaacattttctccggtacggtttacatgtttttccctcaattcctcttcagaaacaacagcctgaccttttccaagtgctgcagtcataatatggtgtcaatgccaaataaatgatgtttgaatatgctaatctatgtgtttcagagctgagatgatactcacggtcaagccattcaaggaacagaatgaagaggatgttgaagagcatgatgtatccaagtaatgcgccaacgccaatccagtaccagtttgcatcgacaaatatgccacgtaccttaaggacttggacaccaagcgtgtcgttgctttgtgtcggatcaacaacctgcgcaaagattaggttgcttctgagttatctaaatccaaacttagattgtcaggtttgagttggtgcaggagacactgcattaccttgttccagctgtggccaaggaactcattaactgctatggcattctgtgcatacatcagaggagaggaccagtagccccaaatccaccatttcttgatgttttctgcaaaaggagaactcagtacaatgctcttgttactactggaacaatatatgagttacttggcatacctctagatatcaagaaaccaccgagaaccagaagaataagctgag

SEQ ID NO: 12502 - DNA, 1501 bp, Oryza sativa
tcctcggcttctccctttctctctctctctcggctccctgctacctggggcggcgacggcgaccgagcaaggggaggaggcggcggcttaccaacggcggtggcggcgacggcggcgcgacgacgtcgcacggcgcacggtgcggcggcacgaaggcggcggtgcggcggcgcgagggcggcgcgacggcgacggcggcgcaagacggcgacgcacggcgcggcggctccggggcgacggcgcggcggcttcgaaggtggcggcgcggcggcacgacaacggcggcgcggggcacgaggcggcgacgggacgcgcggcgaccggacgttgacggcggcggcgacagcggcggcgcgcggctcggggcgggacgcgacgggcggcgacgcgacggtagcgcggcgcgacggcgacggggcgagatgactggcgagcggcgatgggacgggcggacggctcggggcgcgaggcagcgcggtacggggcgcgtcgcggggcgacggggcggcgcgcggcgcagggcgcaaggccggctagggcggcgcagcagcgatggcgacggcgacaggcggcgatggcgacgtcggcgcggcggcaggcgacggcgcgacgggacggtgacggcgacggcgcggtagcggcggtgcggggctcagggaatggccgggcgcgtggcagagaagggtctagggctagggaccaaaatcgaacacctatgaggcaatgaacagtgacttttcctatttatcccgattttagtgtattttccatataaatttgattccacaattcctaattttacatatatgcattttactcaatatttgtgttatcttaactaatgaattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaata

SEQ ID NO: 12503 - DNA, 1300 bp, Oryza sativa
acacttcctagtgctacgaatctggacacacttatattttgggagggagtaattacctgaaatttgatgagacatatcttaatcaaaaatcggagtatatgtttcattgaatcctagttaccgaggtgtatggatgcgatcgaccggtggacgacatgattttacgtacgggataagcagcctcgcgtatcgcggcggtacgaacggaggccatcatccccatcttgcaactttgcaagacgagcaaatatttaacggccaaccaccatcttttggaatttaattaacttactaaatgggccggagcatcaattatatgcggaataagttcattttacgtccctcatctatggatcattttacgtcccttgaccaggtatttcgtatctcttccaactggtaaaaccagtgtaaatcaacctcttcaatagttttgagatcagttttggctcatgtggttgcatatgtggcaggttaacttggtttttatttcgacatggcactcacctggcatcacaataagaaaataaaaattagaatttaaaaagatggatccacatgtaagtcttaaaaaacatactcgctccatttcatattataagttgtttgacatttttctagttaaaagtccttaaatttgatcaagtttgttaaaaataataacatttttaatacaaaataaatatattatcaaaatatattcaatattaaatttaatgaaactaatttattgtagatgttgctattttttttataaattagtcaaaattttgacttaatatgaaacggaggagaaggaccgatgtggcagcgcatctcttctctactattataaaaattgaagatgtttttaccgatactttggtacgtcatccgtatatgagtcggtatttaagttcgtccgcttttggaaatacaggtccctatttaagtcgggttttaaattagttcgcttttggaaatacaggaggagtcgtataagaaatctctttgaaaaaggatttgctataattctggtgacataattatcaccagattacagtcgattatcaccaggtgacataattctggtgccgctaacgtagttctcctatgcgccatgcccttttttttttttgcggggaaatgcgccatgcccattgaacattgcacaacatacattcatcatatttgtttaggcaaacagcaacatgtatcaccatttaattacccatcaacatgaattcatcatatttatttaggcaaacagcgacatgtatgaccatttaattacccatcgtgttaggcaaagaaaagagtt

SEQ ID NO: 12504 - DNA, 1501 bp, Oryza sativa
tgtcattaagaagggatttagagtggaagccatcaccttcactcctctgctcaagggcctctgtgccgacaagaggacgagcgacgcaatggacatagtgctctgcagaatgacccagctcggctgcataccaaatgtcttctcctgcaccattcttctcaagggtctgtgtgatgagaacagaagccaagaagctctcgagctgctccaaatgatgcctgatgatggaggtgactgcccacctgatgtggtgttgtacaacaccgtcatcaatggcttcttcaaagagggggatccggacaaagcttacgctacataccatgaaatgtttgaccaggggattttgccagatgttgtgacttacagctctattatcgctgccttatgcaaggctcaagctatggacaaggccatggaggtacttaacaccatggttaagaatggtgtcatgcctaattgcaggacatataatagtattgtgcacggatattgctcttcagggcagttgacagaggctattggatttctcaaaatgatgtgcagtgatggtgtcgaaccagatgttgttacttgtaacttgctgatggattatctttgcaagaacagaagatgcacggaagctagaaagattttcaattctatgaccaagtgtggcctaaagcctgatattactacctattgtaccctgcttcaggggtatgctaccaaaggagcccttgttgagatgcatgatctcctggatttgatggtatggaacggtatccaacctaatcatcatgtattcaacattctaatatgtgcatacgctaaacaagaaaaagtagatgaggcgatgcttgtattcagcaaaatgaggcagcaaggattgagtccgaatgcagtgaactacagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgt

SEQ ID NO: 12505 - DNA, 1501 bp, Oryza sativa
atttataatacaaaataaatacattctcatgacctattttaattatggatttaataactgatttaacgttgcaatactaaaataaatacgttattaagagctattttaattatagatttaatgaaaatgtttgttaatactggtgtattcttttttacttcccctatttcgcactataaatcgtgttgagttttgaatagatttacgtgtggatttatgcatatgttttacacttcctctatcacataatacaagggattttagaggatatgacatatcgcattactacgaatctggacactatttaaattcgtagtactagaatgtgtcacattcctttaaaatctcttatattgtactctctctgtctcacaaaaagtccaatgtggatataagaggataaacaaaggaacaaagtacccctaattaatagcaaagttatattgatgggtgggtaggtgggggttattgaagatataaaacttctcgattttacagatggatggtaggtaagaagttagaaattgtttattttggaacaaattttaaactttagaagttggtttattttgagacggagagactatatgtgtttggatcgagggactaattttttttgtctctgacatatcggatgtttggacattaatttggagtattaaacatagactaataataaaactaattgcataaatgagagctaatccacaagacaaattttttaagcctaattaatccacaattagcacatgtttactataacattgattaggcaaatcatggattaattagtctcaataggttcctctcacgaattagtccaggatcatggaatgggttttgtcattagtatacgtttaatacttctaattagtgtcgaaacatccgatgtgacagggactaatttttagtccctggatctaaacaccacctggaaaacatcatataacgtgaaacggagggaggatatatagtcagggggtgatgctacagtaaacatatgctaattatggattaattaaatttaaaagattcgtctcgctaattagctttcatttatacaattagttttattattagtctatgtttaatactcttaattagcgcctaaatttccaaagtgacaaggactaaaatttaggccccgtttgatgtgaactactagagacaaatttttatggcacgcaaaacgagaaagcttattagcacatgattaattaattattaactattataaattttaaaaaatagatttattttcttttttaaaacaacttttatatagatattttttttaaaaaaatataccatttaatagtttgaagagcgtgctaacggaaaacgaggaagctgaagttggagttggagaaatagaactcacccttgctatgcaaacaccccctcaatgttagtactgtaacatgggagtgagggataaaagcattgccctcactcgagcatcaaacgtgagggcacccctcccttcccctggcgcccgcgg

SEQ ID NO: 12506 - DNA, 1501 bp, Oryza sativa
tatatatatatatatatatataaaggattacaactgaatttacatggaatccaatccattaaagacataaatgaatctgagtaattctctggacagtacactatgtgttcacggtaatctttaaaagcttatagaatcctcagtacatcgagttgcaattttgcatagataaatacaattctctaagaaataggaatgaataataagaaatgttagtggtagcatatgaggcagctgtggaggcacaaatggacgcgccaagaaaatgtaaaaatgtgctatcaattgcaacttagtgaacaaatcttggagaagaacaatagtttattagttcagacaaaaatgagagttttaacttctatactgagaaatggaattttatacaaaaaccatatacctttgaagcatgaaaaaaagggtcactcctatgatcaccaggaaaaaggcaacatcaaatgagattgtaattttatagtgatcaataggattttagtacttacctgattatttgacagtctctgttcacttggtaaaagagttcacaattcaaattaatctgctttagtcactactcatattggaacactattccatgtatataccttgagacaaattccaggcctgatgatcgattatgaattgaccagcacatttggactgcagtgaaaacagaagaaaaatgatatctcaatcaataaaaaagccaacgtgtgagaatagccagtaaattagaactaaactgcacatagatattatactgctcttccttcctaatatctgaccatgtactgatttggctactcccaagaatcagatgggaatgattagaacaaaccactgtgtacaactatgatatgaagtatatgaaccgttcatatctaaaactctgcattgcaacaagactacctgaccaaactgatccgtggaagcaaatctgaaaaatgcatcaaacttaaccaatgtaaacaaagaaaaaaaaccgaatgggatgctcatcagccgggataacaccagataaaatatgacatgctcacagccatcaagaaagaatgttgatggcagtggcatgcatgccaggagatacttaacgatcttctccaccaagaaacaacacaacccatgtcataattaacatgcagcatggatctggctaggccattgaatgaagagtaccctgagctaaatcttagcaagagggaaatatattaggtacgaataaaggttttatcctaatgaaattatgttgctaggctatcgagaaaaataaattgtatttaccattagcttccaggtgttgataatccatcaatatatgcatatttccatccaaatagttcctttttgaatatcttctgttgttttttgatatcttccactaaattgatgcaaaaggaaatactaatagtgattctcataggtaaattaaaaacatcttattacattgcactaactttacttgacaactcatgttatagttttaatatgcagagctagctgacga

SEQ ID NO: 12507 - DNA, 1497 bp, Oryza sativa
gggactaaagtcccacccctatatatatatatatatatatatatatatgtctttttcctcctccagcccgagcaagcttcaaaatttcttcaaaaaagaggggaggtcatgccaaaatttctagtgaatttattttggtgattatatacaaatcggaggtgcctaaaaggttagcaacttcatcctccaatgttttttttgtcatattacatttggagctatgttttgcacacttttttgtctccaaaattttgttgtaagttgatgagagagaaaatttgtgtggggaagaaagaatatatagaaatttagtttatttgctaaaaaaggttttataaaatagttgagaaggaaaatatagtgaaagttaatcttgaataatagaaaacaaactaaaatgaaaattaaaagaagtacaacacattaatattagtttaaaactttagaaatagtaaataagaattatttggtgcaatatttcataatttttgtatgaataatgatatgtcactattgtgtgactgttgaaagagtttgtaattattttataattattgtatgaataatgatatgtcactattgtgtgactgttgaaagagtttgtaattattttataattattgtatgactgtcattattgtacgaataattatttgtgtacgattttttttcatgtcatgtagatggatcggcaatggatgtacgctgaccggcggtccaaagagtttattgacagcatgcattattttttgagagtggccgaagctaacaggcaaaagggttttatttgttgtccatgcaataagtgtaagaatcagaaggagtattctgcatccaggactattcatttccacttgtttgagtcggggtttatgccaagctataattgttggacatcccacggagagcaaggtgttgaaatggaagaaaatgaagtggaagacgacaatattctggactttgctcagtacgctagatttgaaagaaatcaaacgggcgaggaggaaagggatgctgatggtaacgacgttgtggatgatcttggtcagatgttgcaggacgccaaggaggactgcgaaagtgaaaagggggcccataatttggacaagatgttagaggaccacagaacatcgttgtacccaggttgcgagcaggggcacaaaaagttggataccactctggaattcttgcaatggaaggcaaaaaatggtgttagtgagaaggcatttggcgatttattgaaactcatcgagaacattcttccggagggaaacaaattgcccgagacaacgtacgaggctaagaagatagtctgccctctaggactggaagtttagaagattcatgcatgtccgaatgattgtatcctatatcgcggtgaggagtacgagaacctagaagcatgccctgtttgcaaagcactacgatacaagattagacgagatgatccaggagaagttgacgggcagctaacgaagaagagaattcctgctaagg

SEQ ID NO: 12508 - DNA, 1497 bp, Oryza sativa
ggtgtcgtcggcatcatcgtcagctagctctgcatattaaaactataacatgagttgtcaagtaaagttagtgcaatgtaataagatgtttttaatttacctatgagaatcactattagtatttccttttgcatcaatttagtggaagatatcaaaaaacaacagaagatattcaaaaaggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcatgttaattatgacatgggttgtgttgtttcttggtggagaagatcgttaagtatctcctggcatgcatgccactgccatcaacattctttcttgatggctgtgagcatgtcatattttatctggtgttatcccggctgatgagcatcccattcggttttttttctttgtttacattggttaagtttgatgcatttttcagatttgcttccacggatcagtttggtcaggtagtcttgttgcaatgcagagttttagatatgaacggttcatatacttcatatcatagttgtacacagtggtttgttctaatcattcccatctgattcttgggagtagccaaatcagtacatggtcagatattaggaaggaagagcagtataatatctatgtgcagtttagttctaatttactggctattctcacacgttggcttttttattgattgagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactgtcaaataatcaggtaagtactaaaatcctattgatcactataaaattacaatctcatttgatgttgcctttttcctggtgatcataggagtgaccctttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagctgcctcatatgctaccactaacatttcttattattcattcctatttcttagagaattgtatttatctatgcaaaattgcaactcgatgtactgaggattctataagcttttaaagattaccgtgaacacatagtgtactgtccagagaattactcagattcatttatgtctttaatggattggattccatgtaaattcagttgtaatccttta

SEQ ID NO: 12509 - DNA, 1501 bp, Oryza sativa
gtaacttatttaacttccttttctgtatgatggttgcttcagaaaatttcatcactggaaagtgtttttgtgattggaaatggtggtcgttcaggttaacgtcctggttttttcagttcagacttcagaatgattttcttcctggagctgcttaatgcatcatttataagaaaatagaactgtgaattttggttttccttagtttggacttcaaagcttatttggaaatgtcagcaatttcatgtgggcaaattaattaattccagaataaaatccctgtgaggaaggcaccttgagtgcttggatggacgctacgataaagtaacatgtttagaacccttttgaaggaaaataaaaataatgtatcacatcatgttttctctattttatttatcgaattcttctatcatacaaatgatagtttttatcttcttcatttgtttaaatgtatgatattgttgactatagtcggtcaaactttaaaactttcaccatcaatagctctttaatataataaaagaaaatcatatgggtagatttttctttataaatatttttacatcattataattttgcaattttgttatatcatagtagaaaaatattggcataagttacacatcaaagatcaaataagtcatcagtgttaaaacatgttaacagaaattgaggtgatctatgtacaaagctcatgtatgtgttctttctcacactttctcaacctgttaattggtaatattttataggacaattgctttttaaaatcatagtaatcaatttccaaattttattaagctaatctttaattaaacatacgttaattcaccgcatgatttagcgtgccggttccccccagccctatgcaccgaacacaaccgaaagccagcagagtagacaaagcgatatactcgccacgtgtccaccaccttcccctgccacgtacaccccgcatccgacggcgcaaatccatccatacccttaccactcccacccacgaccgtccaccacccctccacaccactgccaccgggccccactcaaccgtgggccccacgtgtcatggacacgagccccgtgatttttccttttatataagctcgagagtggaagaggaaaagagagcgaaagcgagagccgcgagctcacctcacctcactcctcgcctcctcgcttccattccccgatcgattccggccgccgggagcatgatctgaccccggattccggcgattcgatccgcggagagcaagatcggtggtcctttcgccggaattggcgatgtcgtcgtcgccgttggtgcttactgtcctcttgtttgcgtcgctgacctggctggtggttcttgccccgcgctcctcgtcgccgccggcgacggcgacgccgtcgccgcctgtggtgggtgatggggtgggtggaggtggggaggatggtgatctcgcgctgttccggcgagccacgctggacggcggcgagggggcggcggcgatggcggtggcggagc

SEQ ID NO: 12510 - DNA, 1501 bp, Oryza sativa
ccatgcatgcagcggctcctaattagttttgcatgccgcatagcctgaccaatcagatgcatgcagtgttcgttaggaagtgtcattaacgtccttcacaggattttcatcgcctctccaccgtaatgcgaatatcaaaatggaattatcatttttttcaatacgatgatcaaaagggaacggagggagtattccaaattgatctacatatttcataggtacactaagaccaagaaaagctaataactctctcatactatatttactctagcaacaaactcaatgcatgcaccatccccactatttcctagctaatagcaaatcaagatattgcatgtggattataaatgcttgtgatgcatgcatcaatgtcaatttactccaatgcacaaataacgaatagacctaatgaataaacacaaatatgtactaaaaaacgagtagatcatttagaaataacctaaaaaaaactatatatagatcaatttagaatggagggagtatttaaatggataataagtagaatcacttatccttggtctgtgtgtcaagatgaaatatgactatcaaaagtagatggagggagtatcttttatagtactggtttccgtgtctaacgtttgactgttcgtcttatttgaaaaagttatgaaaaaatttaaaaagataagtcatgcataaagtgttattcatgttttatcatctaacaataatgaaaatattaatcataaaaaaatttcatataagacaggtgatcaaacgttgaacaccaaaacctaggaatttagtctttttgggacggagagagtatcagataaccagaacattagtcaaacgggccaacagtcattcagtcaaacgacaatgggaataaaattctggaaaaacattcttgactttgctctctaaatttcatttttttttgacgaggaatttatgcatggtcgttgctcatctcagtaaaaatacattcttgactttgctccctaaacctcaatttttttgttaatctaatactctttctatctagcgaggaatttatcatgatcaccggcagtggaaagaaattctttctttgctctaaatttcaaatttatggcaagtgcaaaaagagttctgactttgctctagattttgctaagagtaaattgcactttgcacccgataaagcacgcttagtttcactttacaataggtttagcgtatacatgttgccttcaaataagtttcgcttagaaccaggatatacatcatcaaatctatagaaatttcataaaatcaaattttataagatatggatgaaactttgtgaaaacatggtctttatttttttaaaaaaatcgtaaggttcactcatgatttataagattttgctttagttatatgacacaatctagtgcaaattgaaaattattttgatatgtcctgatacaaagtgaaaattgtcagggtcatgggtaaggtataccctctacccttggatgtatgttgtatactgata

SEQ ID NO: 12511 - DNA, 1501 bp, Oryza sativa
ccgggtcggcgtgcacgtacacgttcagcctctcgccatgcccctcgaagaacctctcccacagcggcgcgaacgtgagctccgagttggtgaggaacaagaacgccaccttaggctccgccaccgccatcgccgccgccccctcgccgccgtccagcgtggctcgccggaacagcgcgagatcaccatcctccccacctccacccaccccatcacccaccacaggcggcgacggcgtcgccgtcgccggcggcgacgaggagcgcggggcaagaaccaccagccaggtcagcgacgcaaacaagaggacagtaagcaccaacggcgacgacgacatcgccaattccggcgaaaggaccaccgatcttgctctccgcggatcgaatcgccggaatccggggtcagatcatgctcccggcggccggaatcgatcggggaatggaagcgaggaggcgaggagtgaggtgaggtgagctcgcggctctcgctttcgctctcttttcctcttccactctcgagcttatataaaaggaaaaatcacggggctcgtgtccatgacacgtggggcccacggttgagtggggcccggtggcagtggtgtggaggggtggtggacggtcgtgggtgggagtggtaagggtatggatggatttgcgccgtcggatgcggggtgtacgtggcaggggaaggtggtggacacgtggcgagtatatcgctttgtctactctgctggctttcggttgtgttcggtgcatagggctggggggaaccggcacgctaaatcatgcggtgaattaacgtatgtttaattaaagattagcttaataaaatttggaaattgattactatgattttaaaaagcaattgtcctataaaatattaccaattaacaggttgagaaagtgtgagaaagaacacatacatgagctttgtacatagatcacctcaatttctgttaacatgttttaacactgatgacttatttgatctttgatgtgtaacttatgccaatatttttctactatgatataacaaaattgcaaaattataatgatgtaaaaatatttataaagaaaaatctacccatatgattttcttttattatattaaagagctattgatggtgaaagttttaaagtttgaccgactatagtcaacaatatcatacatttaaacaaatgaagaagataaaaactatcatttgtatgatagaagaattcgataaataaaatagagaaaacatgatgtgatacattatttttattttccttcaaaagggttctaaacatgttactttatcgtagcgtccatccaagcactcaaggtgccttcctcacagggattttattctggaattaattaatttgcccacatgaaattgctgacatttccaaataagctttgaagtccaaactaaggaaaaccaaaattcacagttctattttcttataaatgatgcattaagcagctccaggaagaaaatcattctgaagtctgaact

SEQ ID NO: 12512 - DNA, 1501 bp, Oryza sativa
taatgttgattagaatgtgacgtgcatatgtatagtgagtatacataagatgtgctatatttataaatgaggaatttcatatatttcttacccttttcatatatgtctatgctatcactatatctcattttatcttttcattgaagaggtgtatgtctaaatataaatcttctcagatatgtgtttatcctaactagtacctaaatcaacaggattagccatatagtgttcttttagccttggtccaaacgcaccggacaagttcatgtaacataacgagcattttacaagttagtgcactagattgcacctacttaacaagaagttcgtgtactgctaatacaatttactcttcttttaattattatgtaggtacttattcgatcatgagatgttgggtgcgagaataattagccgtttaatatgtatcgtttacgcaagttctcctaatatagcttacacaatcctccatattttttgcgccttacacgtagggcccctttgaatcacaggaatgaaaaaaatagagaaataggaaaaacatatgattctaacaggaataagtgtgaaacagaggattacaaaacaaaaaaaacataggaataaccgtttgattgagccacaggaaaaacataggaatttgaggagagataaagattcaaaggattcttaacatgaggtagaacctcatgttaaatttcctccaaaacttacatgggaaaaggtatttcataggaattttataggattcattcctttgattcaaagagctatatagggaaaaatcctataggaatgaaatcctttaaaattcctatgaatttcctttgaatcaaagggggccgtaaggttcgtttcaaatttttcacacccaaattatagtcatacaagaaagttagtgtttctcaatgtcaaatttcatgtgatataacaatcatatatataactagcctatatgaatttaagttatttaagttctagatttaacatagttattcgcatttacgactaattattttttcagtaagagatgacatatctcttgataacagacacgtatatatcagcctaattttacggagatgtatatagtgtaggatgtacgtgtgtgcgcgtaggtgtaagtgtgcgtgtgtcgtgagcaccggcatttcagccgtatttctaaaaggaaaaaagtttaaaattttgcagcttttatatcccgatttggacgtggattaatttccagctcaaaagtcaaaaaccaaagagtccacagccaccggtctcatcgctaaccaccaacacctaatcgtcattatccgagactgttagatccccgggcccacacgtcagtctcaccccgcgaaataatctaatcctttaaacagaaagtcaaaagcgaacgcgaagaaaccgaacagatccctttcttcctcacgactcctggatttttataaattacacccccgaaagatttcttctctcacaatccagtcctcgaactcgaacccagcca

SEQ ID NO: 12513 - DNA, 1501 bp, Oryza sativa
tagcttgagctggctctcgagtgtacattagctagctctagctatttttttcccttatctttttcttcttcttttttccttttattttttttcttctgtaaagttcaatttttttggcctataattgtttgggattttgtcaccagaaagcaaaatgccctgggtatgtgttccccaaaatctacttctcaattttgataaatacgccaatgacactgcttttttttcagcattttttagagaaatatgcaagatgtcgcccccacaaaaagaaagaagaaagagaatgatccttaaatgtgattgattgcgtcatgagtggggtactatactataacaacttgagctgagcagccggcacacaggctgtagagaacaaggtgatatgctgtatatgaagagggagttggagctgtatgctactctgcacctgcaggatactcacagataatctctgtgtgtgaccgggcatcagctgtacataggagcaacttgcagggaaaacaacaaagggagggagcaagtttcaagggccccttttatttgcatgcaccacaccatgtttctttcaagcaaacaatgagatatcattagatatgccagtgcattgtatactagctctctgtgatcatgtagaaaaaaatcagagctaattaattagtattagaattttcagtcaattcagaggaagggcctctgggtgtagatttttcagatagtttctgctttgatttggtaaattccaaactgccgtatttgaaacggggacaatttcgtcggacgactttgaaatttccggcggatccatgatgatttttactcattcttaaggctctcatagtttgtcttttggcttatcaggcgcaacaaaaatttaaaatttaaaacttaatttcagggttgatggtgtgattttttatcgtagtttatttttagcattagcttttaaaatcactaaagaacataaatataaccctctaaaaaaggaacgtaaatataaaattttaacccataaattatgttttaattaattcgtttatattatctttttcacggcttattaatgaacgatctaaccttaaaactcggcccggtccactaataaaaaatcagcccaagccccaacgaccaacggccttccttccgatcaacagccgacgcttcccgcgaaatccggcctgcaccgttataccttacctggtcccactgtcacatggtccccatccttagttggtcccacaaatcagcgaccaattcccgcccacccgacgcttctcctcggtccccgctgcaaatcccaatcggctctcacaccgacacgtgggccaatcgagccagggccccacctgtcattgacccttcttccaagcccccacccctcgcatcattcattcactcgtcgacttttcgtcgtcctccgcgacgacgcgaacaaattgcgacgcgacgcagcggccgggctagggctagggctagggtttgaggtcgggcgcgcgcggca

SEQ ID NO: 12514 - DNA, 1501 bp, Oryza sativa
gtcatatattaaaggatggagatagtataacaacttttgctatatagcaaaaaaaaaaagagttgtattttttgaacggttagtaaaaaattaaaatgctactagctgcacagaaaactccaaactgtttgctacagcgaggttaaaaacgactctcaagtgagaatcagccaggttgtgccacctgacatccaactcaggagcttcagagatgctgctgatttcagatacacatctgctgaaaatgagagtgacccgtgactagtgcctaaactcaaagtgctactgtagtacagacagctcacggctgttagcaatcttcccatttttggatcgtccgagttattagcagaattgattgcaattcttataacgtgatttaaggagaggaccgacgagatttctgacattttggctttcagacagtggaagcttaattgcagttcgtcctggtcttcttggctggagtaactactatacttcagcttggtagtggtaagctagcttcagtaacaatttgtttgggtgatcaaatttgtttactccaagttggttaattagggaccagggagggtgaccaccatggagatcaaattgagatactacaagtaaacaatacccatcgagaccatgatagataggctttccaaacttcctagccagccaagcataatctgaactttttagtatctgtggaggcagagccaatctgtgggtgccacgtcacttttcacacagaggcagtacaaagtactacaaagcagagctggtagattgtagtacgtggtagatacttacttactcctaagtcacgaaatagtttaacttaatcaacaagagaaaacgactaatgagaagtaaagtccggatttcgtcctttatcttgaaaaaaacgaaaactaatgacagcgagcgaaatcgcctttctcctcaccaagctgaccactctctggaagcatcagcgccactgccaggtgggacccacgacgacaccctgccacgtgagcaagggccccatgcgaggcaagcgccgttggccccgtccgacaacgcaccttccgcccccgttactctgagccgagggacccacacgtcgactcaccccataccccgtacacccagccagaaagagcccactgaccggtgggccaggaggagagtgtgccccacatgtcagtgatggtagaacagaagggtctaggcgggcgcggggtacgacgtgttccgggtgtagaaagcgacagcgcccctcacaacgctcgcctccctcctcctccgtctcctcctttcatctcttcttctgtgtgtgcgtgtctgcgaagcgtgagagagaaacgtacgcgacgcgacgagctcctactccgatctccccgatgcgatctcgccaaaccctaatcccacccaccaccgcgccggagtcctagcgccgcccgcagccgccgccgccgtccggatgctgcggccgtgacctcctcctcctccgcctctgacatcccagcca

SEQ ID NO: 12515 - DNA, 1501 bp, Oryza sativa
caccaaaatttggtaaagcttcaaacataacatgcatgcatccacgagaagactgtggggatggtaattaatggttattgatttggatctttcaaggatagcaacacctgtgtgctagcagctcttgcactgatccccccagcaatggtatcgttggggtgcaggtggctggcagtttgcatgttgcacaacttctatttcgacatatccactaccaatgactcacactgaagtgtgtttagttcacactgaagtttggaagtctggttaaaatcggtacgatgatagaaaagttgtgtgtgtatgaaaagtttgatgtgatggaaagttaaaagtttggaaaaaaaaactttggaactaaacatggggtgcatgtattgctggaaggaggaagctagccggtgactggtgaagtggtgaggggtataaccttgctattccaattgacttgaagactttctgggccaagcatggggcgaacgaatttgtaacaatcgtgtaaaatacatgttatgtttgtttcattgtaggtctcaatattgcagtttggtctgagttattgtctccatttactcattgctaatctgcaaaagtctctagaagtagcatgtagtgatgttcagtttcttggactttcaaatgtacatgctgtcttgagcattgctaatttgcatgccagtctcttgactttcaaatgccaagtcctgtcttgagtatatctatcacttagttgtaatgtaatggcaacagtctctcaaatttagatggcatgaaattaattgttgtttaatgtctctatcagtctatctatagctcacagtttctgacttctgaaagttcattccttcatgccataattttgatcttttctctggtttatgaagtgtttgtattaaatactcaatgttatcaactttatgtttcctctgaatttaacgaagtaaagtaattgataggagtaattcacaaggaaaaaaatgttatttattctctatttgccctaccctgaaaagattatagccctttttcgttgcactaaaaaaataaacagtaaactgctggttcacacaatgtacatattgtcttgaacatgccatgttatattcttcataaagaacgtaaacggtcattttctctagttcagtttccaccgtgaagatgctatccttagacatatgaccatttcttcatagcattatataattgagggaaaatatgtattgtaaatcacatatatgttacaaaaaaaaactatagtaggataaaaatatgggcatctaatgcttatccatgtcatggtaaaacttttactatggttaaatctgaaaataattttttcactcagggtaacgtggacaatttcagacgtccattttttttattgtacgatagttttcgggtttacattatatatatggtttacacttatatattttcccatataaccgtatggtatgaacaacctatgctatacactgtccccaggggtagaagcaaatga

SEQ ID NO: 12516 - DNA, 1501 bp, Oryza sativa
ggtacaaatgtaagaaggcttcctgaaccttgttaacattagcaatataatggtggtggaaaaggacaattgtgttgcaaaagcatgcacccgttttcatatataaaagtaagaaaatcttgctgcaaagcatgccccgattttcatggtgaacttttgcttgatctggctatgagtagctggcagaatatgaactgttgtctactcatagtcgtctagcttttttcttaatcaaagttttttgtttgaccaagtttataaaaaaaaatagcaacacctactaaattagtttaattaaatttaacattaaatatattttaataatatgtttgttttgtattgaaaatattactatatttttctataaatttggttaaacttaaaatattttaattaagaaaaaagtccgacgacttataatatgaaatggagtatgaaatggaggaagtagatttgaatgtgctgtttaattcactctcagcaaaatacctgaaatttgtatttgaacagttgggtgtatttggtgtatgattcattatcatctcctctatcatttgagatcattaactccttttttttttatacacaaagcgcatatcattgtattgaaattaggaaattggtttcgctcagatacaaactatgtacaaaagataagaaaaggaggtacgagaactgcgcctagcgcagtggacagggtctgaggtggtgcgccctatggcctacgctcgattccccgcgaacacactcactcctctcttagggtgtgtttgaggaggaggggattgaggagattgagaaaatacgcaaaacgaggtgaaacattagctcatgattaattaagtattaactattttaaatttaaaaaatggattaatataattttttaaagcaattttcatatagaaaatttttgcaaaaaacacaccgtttagtagtttgggaagcgtgcgcgcgaaaaacgatgtgcattctcactccctatcacccaaaacgaacgcagccttaatacatatcgatatgaaagccctttcgacatgacgatctctcgcaacacatttttgaatgactgagcacaccatccagacaggtactcccatatcacgccagagtactgccacctctgcaacttcccgcaatgttttgcattggtcattcaagacccaatcatttgtttcgctcttttcaaattgtcaaggcaactaggatgacaaacgcgtcaaatccccgccacattgatgttgtggtttggctttgcctgtcgtctctcttatgctcgcgtttaataatttgtcactggagagaagtgatttcttaactatttatacatacgtggcatgcccacgtggaaagcaacatgaaccccacccgtcagccccttccctcttcttctccacctttggccatcgcatggatacttttatactcacataatcttacaagggtatgaattaatatagccaataaagatgagataatttttttttgtttttttttaaga

SEQ ID NO: 12517 - DNA, 1495 bp, Oryza sativa
ggcattagtatggagcccgtcaccgatgagtcatctgtgacgggccctacggcaatacccgatagagatagattaatctctatcgggcttaaactaaggcccgtcaccgatgactatttttccatttttccatttcaagtatttgtatttgtgagtgcaaaatatatagctgctgtgtaataattcattttattagtcataatatatttccaatagtaaatgatttcaaatgtaaatatggtcaacaacaaacttgtagagcctttcaagatctacaacttttattttggacatttttctatataacttttttcctgacagtttgaaattgaatttgaatatatgacaaatttaaacaacatttgtaaatactaaatgatttcaaatggaaatatggtcaacaacaaagttgatcctctcatcaagatctacaacttttattttagtcattcttctatataacttttttccaaatagtttgaaattgaattttaatatatgacaaatctaaacaacatttgtaaatattaaatgatttcaattggaaaatccataaacagcaaagttgtacaacttattaagatctacaacttttattttggtcacttcttcatccgacaaaatgacagttatattattcacaaaaatcacatttctctcatctggtttataaacatcaatacagatatgtcaattttgtaaacattggtactatcactttgtcggatgaagaagtgaccaacataaaagttgtagatcttagatatgttttacaactttgctgtttatggcttttccatttgaaatcatttaatatttacaaatgttgtataaatttgtcatatattcaaattcaatttcaggctgttgggaacaaagttatagagacaaatgacccaaataaaagttgtagatcatgatgagaggatcaactttgttgttgttgactttttcatttgaaatcatttaatatttacaaatgctgttttaatttgtcatattttcaaaatcaatttcaagctgttgggaacaaaattatatagtcaaatgaccaaaataaaagttgtccttgataagctctacaattttgttgttgaccatatttcgatttgaaatcatttactatccgaaaatgtattatgactaacaaattgaattattatatagcagctatatattttgcactcacaaatatagacttgatgggaaaaatagaaaaatagtcatcggtgacgggccttactttaagtccgatagagattaatctatctctatcgggcattatcttagggcccgtcacagatgagtcatccgtgatgggcctgagtgtcatctcaatcgggcattagtatggagcccgtcaccgatgagtcatctctgatgggccctctggcaatgcccaattgagatgactcatcactctactataactagggtttctcatatcggatcgaatttttttctaagtcccgctacagtttcctgcctccttaga

SEQ ID NO: 12518 - DNA, 1501 bp, Oryza sativa
gccgcagccgcgccgccacgccgtcgccgcgccgcgcgccactccgccgccgcgccaagccgcagccgcgccgccacgccgccgctccgctgccgccacaccaccgctccgctgccgccacgtgaacgaacgaacgatcgtgaacgaacgaaacgtacgtgaacgtgaacgaacgaacgaacgtgaacgagaacgtgaacgaacgtgaacgaacgaaacgtacgtgaacgagaacatgaacgcgaacgaacgtaaacctaacgtgaacgtgaacgaacgtgaacttaacgttgtatgtgaacgtacgtaaacgaacgaacgtgcgtgaacgaaaagtgaacttaacaagaacgcgaacatgaacttaacgtacgttaacgtgaacgcacgtgaacgaacgaacgtaggtggacgaaacgtgaacttaacaagaacgcgaacgtgaacgatcgtgaatgaaacatgaacttggtgagaacgcgaacgtgaaatacaatatatgttactttgcgtttatcctaatacatctttttgtatgttgcagaaaagacgtagtcgtcgtcgtccctcaagccggagtggtagctaaccctcgaaggaattcgcgcaggcaagtgatgtaaatatatgattgttagatttttaatgcaattaagactattagatttaatatacgacacttggacttagcatatatgattatctaagtttgaaatgtacgacacttagacgacttagcatatatgattacctagggtcctaatatacgacacttatacttagcatagtataagattattagatttgtaataagacagcatataagattgtgtagggttctaatatacgacaattagacttagcatatatgactatttgagttttaatataagattattagagttctaatacaagattatttgagttttaatataagattattagatttgtaattagacttagtatataattattgtctagggtcctaatatacgacacttagacttagcatagttgactattacagttttaatacaatattatttgagttttaatataagattattagatttgtaataaaacttagcatataagattgtgtaaggttctaatatacgacagttagacttagcatttatgactatttgagttttaatataagattattagagttctaatacaagattatttgagttttaatataagattattagatttgtaattagacttagtatataattattgtctagggtcctaatatacgacacttagacttagcatagttgactattagagttttaatacaatattatttgagttttaatataagattattagagctttaatataagattattagatttttaataagacttagcatgtaggattgtgtagggttctaatatacgacagttagacttagtatatttgacttagcatatatgattgttagcatataagattgttaaagcaaaaatgacctatagacttagcaaatatt

SEQ ID NO: 12519 - DNA, 1501 bp, Oryza sativa
gtcagagaccagagatctacctcttctgaacgtaccacctactacaatttttaagattgtccttgtaagtcaagattgaagtcctttcatgccccgccaaaaaaattcctttcatgaatgccatgttatactccctccatcctcgtcttatttaaaaaaattatgcaaatataaaaataaaaagttgtgcttaaaataatttgaataataaagtaagtcaaaataataataataataatttcaaaattttttaaataagacgattggtcaaacagtgcaaacaaaaattcaaaatcccttatattatgagacggagggagtaaaaaacttgtgggttatgccagggccatgttataaaaactttttattattgattcacaatttgtgttcgacgataaccttttttcttggggaatagtaacattttagtgtgtatgagctgttggcgactaatttttacaggaaatttaattttcatcactaataagtttggcagttatccaaatgtccctttagatttgctctcttttttaccactctaaagagatggtttctacttttgcccacgtggcatgtgaatgtggcaactgagcgtgaacaatggtgtgggacccagtagttagataggtgaagagaggaggggaaggggtccacgtgggtcacacgctgactcaactgccacgtcaggtaaaaccaaggataaaaccgtctaacgacttagagtgatctggttttgtaagttaagagatgcatatatatatatatatctgtttttttcggtttatgaacgattttgtaactcggcggtaagatgagggacctccggtataccttttcccgtcaagttgaagctcggcccactgcttgcttcttggcggcccatatgcagaactaatggtttggtcgttgttcgtcaaatcaaaactactccaggtggcatggatttcgttgacaacaagagaaaacgacaaggcgcaccagctagctggagaccaccaaatctaatcatgcagtacgagcgccagtggtcaaccagagatgaaaagacacgagtcctcagatcgattgccttctctcgaagcttccgtaatccaaactgaagtgctctgcatggactcatctctgcatgcattccatcctacagatttacctacattggctcacacgccccaacatgatcgaatacgtcacactcgtgcgttcaatcgattggaagctagctagccgtgtttagtggatcgaatgatcgacgtacgattgatcgatcggtacgtacatgggttgatcagctcggtccggtctgccttacgtacgtgtcgctcggattgctgaggagagcgcgcccaaatctgcgggacaggccggattgctccactacgcgacgccctccgccggccgcggccacaacctcgcgacaccgacgcaaatcccactaaaaccttacgacacgacgagccgcgctagctaccgcacgcatgcgtaccaccacaaccgcgcgcgc

SEQ ID NO: 12520 - DNA, 1045 bp, Oryza sativa
agtggtcaaataatgcaaacaaaaactcaaaatcacttatattatgggacggagggagtatttgttaaaggacacaatgaaaacacggatttcattacatccggtacaaacgcggagagtaacagcgtggaaagtagtaaattactcatgtgttgatctgtttgtaaggtgattgggtctgattcaaatcagaccagaccattctgactctcccaatccagtccattctcactctcttagtatgggtccggtttgaactagatctgctcgggttaaaaataaataagccctatggacaaacttatcattttaaaaagtttctctatctgtacttgcaacggatataataaaataatctgttcgtgtctagtaactaattatcatgtttttacggtgtcctatagcaaataatgtgaactttgactattttgttgtaaattttaccgtgtatatgactcatatatttgagggagccaaatgggccttttcctggctgtagatacacttcgatgatgccggtccagatatggcccatttattcatcactgcggccaaggctgggctctggactctcgacagcgcattctgggtcctagcgttggcaagtttacaaatggcccataaatttaagagttttgatttatggtcgagatttacaaacggcccatagagatttgatcaccaacggccataactgttgcagagtactaccatgaaatgtgcggtatcactcacacggtcacaccatgtttccacattgcatttccttctgttttttctttcaggaccacagcataaataaagttcatggatgtcctgttgcccatccgtatttcctttccagtaaaaccgacaaaaagaaagaaacaataaacaacaaggaacacgatggcgtcgatcagcagcagccagaagatattggtcgctgcgatacaaaaaccgtttcgcaggtgcaccggacgtgtcccgtgtatttcctggacgcaccccgttcctaacgctaccttgttttgcctatgtacgcgcggacgtgtgggcgagcgat

SEQ ID NO: 12521 - DNA, 1501 bp, Oryza sativa
aaaaaatattatcacattgtcatgctaatttaaaacgtgtatgcttgtttgttttcttcaatatttttaagaaaaacgaatggtcaaacaaactataaaagttaactgtattatatatattaaaaaagtgtgtattggaaaatatggtagtaatatactccttttgtttgatgttgtgatgttggttagctcaaaattgaactaacagtgcgtattaaatgtttggaaatggaaggagtattaggttcggacaaaattaggttgtgctcagggacaagacggtcccaatcactgggaggaaatttaacagtgctccggctttgaaatgtgtgcatatatatgttggtcgatgacgtggcgtacgtgcaaagttgcttctctgccgaattaaccggcatgttaggcagccgttgtggcgccaccttggccggccatgttggtgccgtgctgctccgacaatatagttgcttatgtaaatttggttgcagatgtgtcaaattgcttgtgggatatgaaaacttataacccctaattaaactaccactagtaagtaagtgtgcacgtacaaagcacgtcatacttctcatcgtctgctttgttaacttattgtcatagcttatactcgtttcggtttcaaattaattattatcatattttagatttgtctgatcagatcattaattcttaggaatgtatgtataatttaacaacatatgatttatgtattattatgaaggtatttctttacgatgaagctaaaagtataaaattttgtaatattagaccatatgagtgcatagaaattaatggtcaaagattgaaatatttgattcagaacaaattaacctagaatgcaagtaatctgaattagatggagtactcaaattttgaaatttaattaatataaatttgattttagtttcctttttttcatcatattctattttttcgtaactgtagcttataagtcgagtacatataataaactgatgaaaaagaattcctcacgatagcttataagtcaacaacatattataattgaattgataaaaataattttagggtaccacaaaattatcaccgttgaggattttatatttacatattcttagctgttctaaagccaaacctgcgagtgaaaagaaaactttgaattaaattctaaaatgatggggacgtattgagggtggtcgactgaacttggatctcattaatttgcatgcattcctaattattggacagttatatgtccgaccaacattttactgatgtactaggcgtgctacaaagagttgtggctgatcatgtagttaattgatggcttaatatttggctttaatatgaaggagaaatggaacaataattcttcgtccgaaacatatatcaaatgaaatttgctgagcagagattaaatcaatacttacatggcatgttttactgcattattatcatacttcttccttttctaatttttatattagaagtcgtttgattttttttc

SEQ ID NO: 12522 - DNA, 1501 bp, Oryza sativa
ttaaatccacaatagccgatcagccacatgccgatgacgtatcatttgtaggttagccaatataacgtgaattatatcggcaatgataaataaagcaaaaggaaagttagatctagtcgatcggctgtagatattagcaatatataatctatagatcgagatacatttaaaccaagtgactagtatggatcggaccaagtgctgagacaacatgaatcacttatgtctaaaagtactttaatataaagattatacgtgctcatagcatagccgatgttgtagacctaacacgtgtcggctaatactccaatacaactttatactaagatatcattatagaccaaatatattgaacaagaattaatcaagtgttaaagtagattaacagattaataataagcctaatatatttaataacagtgagatcttgatataaagggcagatttagcatgttaagtaaacatgaagtaaacaaaacaactaaatcagataagatcggctgaaacccccgatgaaaccctaatcggcaaccgaaagcaggctagagattaaaattctaatcacgacttataaggtcaaacttaactgatgcagctataagtatgaggagaatcacaatatctagaaagtcaagctgttggttgattcatagagtggtagataccctatataatctaagtcaaagttgatatttaacttgatcggctgccttccagtcatagatgttagccgattgaaggttaaataacaatattgccagaaactatataggatatatgataactcaacaaacaatattagagtgtcataaatatggaagcactaatcccgagaacacaagccgccataacaagttttacctcttgtcagagatcgaagccgatgcagcccaactcgaaagcaagaactcgtcgaaaatagaacaaaacgaaagggtggcgatgcgccgaatttgattgaactaagcgttaattgtttacaagggttcgggcttacttttatacctgagatacatgatatgtccctatcggacacgacttcgagccctattacaacttaggatacgaacaagtccctaaggcggactcttaccgactcaaatcataaggaaattacataaaatatcctaactaatagatacaattgcctttccaggactcaaatcgtgtgcagcaatccatatgaagcactttgattcaacccaatgatgtataccgagtcgtattgccaaaattcggctcaatcggctaaccttgttcgactcgaactctgccaatcttgaccgcagccgattcagacttcagccgattcttactctgttttcgaaacagtttatctcttagattctgcttcgattttatccttatctcagatacttggattaccaaatttggtcgttaacacatgccccccaagtccggaatatttggtaatgtttcggatttgccatatcatatctccaagaaaatcgcacattgccatttttccaaccgttaccac

SEQ ID NO: 12523 - DNA, 1501 bp, Oryza sativa
aattttaagttgatattcccaacttttagcatatatatacatgtgttgttcccccaccctgcaaccaaccacatactgatcctatttttccagacatgagagaggcgactgagggcgcgacgtcggcgggagggagacgcggcggctccacctccactgccgagcgacggcgggcacggcatcggcggatccagcatggcatggcacggctacaggcgtggcggcgacgggcgatggcgtgagggaggtgaggaggcggcgtatccggccaccgctccgtgccccacgcatgtggatccggccgcggtcgggcgaatccgccgctgatctggcactgggaggctagcgtagcgtcggcggatccggcacggcacggctgcgggcgaggcggtgacgggcaacgatgagcgggaggcgaggatgcggtgcgacggcggatccggcactgatcctgcacggggagacgcggcggctccacctccaccaccgagctgcggctggcgcggtgtcagcagatccggcgcggcatggctgcgggcgaggctgtgatgggcgacggcgagcgggaggcgaggatgcggcgcatctggccgctgctccacaccccacgcgcgcggatccagccgcggtggggcatagccggcgcggctgtgacgggcgactggggcgggaggcgaggcggtgatggatccggcctccacgccgcctccatgcgcacggcggcgacctccgtggtggcgagctcggactccgatggataggcaagaccagtggtgccacctccacgacacgccgccgtcgatgtccggagcaagtgtaaacaaaattttaacttttgctcataaattgtgaggatgtatatgttgagtaaaacttttattgtcataccaagttaattttttacttagtaaggataccaagttaattttttacttagcccgccctccaatgtttttaaccttattcagctgcatcccgtgtaaaatacggttttgtaatgaatacgtgaaaacttatacgtgttgggatgtattttttgataacaacaaattacaaaacaatgcgaacaatcctctgaattaaagaaaaatgtcaactctacaacgatatcatcgcaccctaccacacaactgtatctcggttaaattttaactccgcgagacgggttggttgtctcggtcatggggtgtcacgagttaatttttaactcagcagtgaccaggttcaatcacatatcgttcaaaattcaacaacaactaaatttttaactccaaaaccatgtcatcgtatcgcaccacccaactgtgtttaagttaaattttaactcaaaccaactgaattaatgcataatattaactcctcaacgatgtcatcgccccccaccactcaactctatctaagttatattttaactacacgggtggtttggatgcctcggtggtggggggtttgtcgctgtgtgtcgcaccatggagttttcctggcgcacagcgcctatgtg

SEQ ID NO: 12524 - DNA, 1501 bp, Oryza sativa
ggtgtagttcaggtggttggctgggcctgttgcaacgtggtgtagcgttggacagtgtttggttaatattgattaattactacaactgtcttactgctttcaactactgcttttaaatgctagctttatgcaaaagaacctctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatttcttttccgctgcatttgtaatcttttctatttttgtaagacgtggatctgtatgtcaacaattgtcgtttgtgtaccctggctggtcctggacagggatttaatgcacattcagcttagaaattctggtttgagaatttctgggcgtgacaaatattgttctccaaaattctaaaagtaggttacattctccagatcaaactaaactacatcttacaattaacactactgtctatgtctcaattcatacaattatattctatgctctggatctacacatatgtgctgtgtgctacagatatgctaaaatatatggaactaaaactaaaacgcaacatatataatcaaacataacatattagtacaaatgcaaaagatgtattggagcaaacctgtgatgaagtgagcgaaccagcagggcttcgccgctccccttctgctgccctctcctctctctctttcgttttttttggatttttagtgaatataatgaaatttcagagagggtggactgggctttatagggggaggcaaaaatcgccctcccccagggcggcaagggggccgcctgcaaaattccatgccccctcgccgcccatttgcaggcggccccccgcacagtacaaaatcgccctagcggagggcggcaaggaggccgcctgcaaatttcgttgacggccgtcgcccgagagcgaacggccgtctgccacgtcattttcgccgccctctgggatggcgatttttaaaaatcgccctcccagagggcggtaggcgactacttccgtcaattttcaaaatggaaaattatttttgtaaaacttttaataaaaaaaattaaaaataaaaaaaattctcaatttggttcgggactaagttcatctgaggtcccttaactttacactaaatccgattttcatcctaccccaaaaccagatacaaccggtccctaaactgtcaaaaccagtacaaacgaggtccttcagcggtttggaaggcagttttagttgactttggttgacgtgacgcttacgtggctggtttgattagatcttcatcccacgtggcattgacgtggcgcttacgtggcaattatatcccgaaagaataataaaaaccgtggacccacatttc

SEQ ID NO: 12525 - DNA, 1501 bp, Oryza sativa
atttggtctaagatacagatcttgatggcatggtggtgctgagtgtatgccataattctggtgagagttggatgtaatttgcttgccttcaggataaattggatgtattttttgctgaccaactggatgtatgctttcttaaccggttttatttatatataactttagtcagcttgtgaaattatgtaaaattcagttcctgaagtactggtacttactgttgatttatttgtgcgtgcacttactgatataagatcatttgttattctctttacttacaatttcacttccagctggcaatgatttatacttcaatcataattgtttgcttaggaagtactctctccgcttcatattagatgtttgttttcttttcttagtcaaacttcttttaagtttgatcaaatttatagaaaatatattattattttcaaaagaaaacaaacatattatgaaaatatattcaatgttatatttaattatactaattttatattttagatgttaaatttttttataaacttggtcaaacttaataaagtttgactagaaaaaaaatcttataatataaaacggagggagtagcaacattgcaatgtataaatcatgccgggctaccttgtacgttatggatatattcaccaaaaaggattttatagaaataatccaaatagggtttttactatgatgtatgaaactttatttttaccttaacaatttttatggtctgcactgccttaaaaaaagtcactattgttctactccctctatttcacaatgtaagtcatttagcatttcctacattcatattgatattaatgaatctagagacatatatatttatctagattcattaacattaatatgaatgtgaaaaatgctagaatgatttacattatgaaacggaggaagtacctacatacatacattgccaaaacgtgcaagtgcacgattacgagtgctaatataaaaaaggagttcaccccctagcaatcctacgtgtgaaatcaaccactcttatcccatccgtccatccaccctctcatccaatctgagccgtccgctgtacaccgtagatctatatccacaagcgatttcgcccgatgtcatcccaccacgcggtaactgcgacgcgcaaatccccggtgcgatgacgactccgcctgctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcagga

SEQ ID NO: 12526 - DNA, 1501 bp, Oryza sativa
aaaggtccctgtccaggaaaatcgtttctgtagtagtgattcatgaagttccttctctgcttgatcgatccattttctttgtttcttttttggcatagatcgaacacttgctggtgcgctcgtcggtgttcccggtgtccagagtgccaccatcgccccactttgccattccagtcgactcgaatcatctccagctgtaccattgcgccactgacgtcgccttggtcccaggagaacgacgcccacatatgatcaagccaatacgccgccacgaacgctgtcggtcgccgttgctctcctgctgcctctgcttctcttgccgccgagtcaccgacatgtgggcccggctgtttagccacttcattaggtgctaaggactttaattagttgaaattgaaatcttgtaaggttctttttgtaaaattgctttgtttgccatgtgggcttatggacctaaaagcaattcccctaatgcccggggacctttttgtatagggtttagggcttaccctaaaacatgaaattactatttcatgcattcattatgtcgcgaccgagaaaattaccttttcccgaacgctagtgtattaatccccgtcccaggaaaagccggggtacaccaaacaaacatgatacaaaaggcacatctttattatgtcgataatatttacattattacaaaggcacttgaggcctgacaaacaaaaataaacagcagcggactagcgggcctacggctccatcttcacaggcgctcaactggggtataagccaggactccacctaagacttcttctccaaagcttctcctactgaaggggggaaagatagagcaagaatgagtataaccaccgtactcagcaagtcacaccgggagatgcatgattaatgcaagggagtacaaggagataataataggggtttagttttgtagtaaatagcatttaaaagtcatttagttgcccaaagctattttataaagatgatcctagagctacacagtattattaatcaaggccgtggacccacacgaacctgccttaacccaaggcctacgatgattcagaccgaactggcaacccgaccctgggtcccagctcatcccaagccaacccaggccaaccattccacattttagttgttaagcaggttttaagaattaaaaacactaactttggtacattgctaggcttgcccataatcgagggcgcggctattcgaataggttttactctgatcagaggtgtacatctttacccacaagacacgtcttcctcacgtgcaaccacgtgccacatgccaccacggcatatggacggaagacatgacatagtttccaacccatcctagccatagacaagagtaccgacccaaccccacctacggccggaacctccgggacaggtcggtaggactgagcccctagcagcagggcaccaaccctgtgccatgacatctcgactaccgggccacagctcgtgtagccttcatttgtcctaga

SEQ ID NO: 12527 - DNA, 1003 bp, Oryza sativa
tgttctggtcgtcttaggcatagcggtaggcgtggggccagagccccttgaagaacatggagtagctcgtaagcgggcagacgtgctcgaacttaaccacctgggacacggagctcggggaggcacctcgccgtgatgtccacggcgcagctcgactcgcgccccgtgctgaacccggcgtcgccgccgttggtcagctggaagctcaccagcatgttgaacccatcgatgagcgacaggtcggggtcgggagccgagcgtgtactctgtcagcgtggcgggcggctcgccggagacggagcaggacagcgcgccggcgcagttgcccatgatgcagcggacgtggccgccgcctgagctcggacagcccgtgcgcggctcgcttgctccgctgcccaccggcccgtccgctccccgcctccccgggaagaagagagagagaggagagggaagatgagaggagtgagggtgaggaagaagagagaagggagaggaaagaaggaaggagtgagaccgacatgtggacccatgtgagccccattatttttaaattatttttttgtgtaactgaaatgtgggtccacggtttttattattctttcgggatataattgccacgtaagcgccacgtcaatgccacgtgggatgaagatctaatcaaaccagccacgtaagcgtcacgtcaaccaaagtcaactaaaactgccttccaaaccgctgaaggacctcgtttgtactggttttgacagtttagggaccggttgtatctggttttggggtaggatgaaaatcggatttagtgtaaagttaagggacctcagatgaacttagtcccgaaccaaattgagaattttttttatttttaattttttttattaaaagttttacaaaaataattttccattttgaaaattgacggaagtagtcgcctaccgccctctgggagggcgatttttaaaaatcgccatcccagagggcggcgaaaatgacgtggcagacggcc

SEQ ID NO: 12528 - DNA, 941 bp, Oryza sativa
ggggggggggggcaagaattgattcaatcttgtcctgttgtgctactatcttaactagactccttgttttcttctcctcatcaccttttgtgtgtttgtgtagtggctgtcacctgtgtgtgcatgcatgcatagcaatagcattacattgcaatattgcatttgcacaagatgggagcatgcagtgcagtgcagccccctcctgctgtagatctgtgcaaaacattgatgcctttattactacatatctttctgagctaggaggagccccaatcatgtgcttgtcctagcatgacagcaacttggccggccttctgcacaatcacattgtgtagttgtagttctgcaggtttgcaacgcattaataaacggcgtttggcccattgtttaactcaaacctaacctgccactttgctgataaattgttgttcatccatcatcctagtgcctcgtgagcactggattggttcagagcagcagctccagatccagagatgccgcccatttgagttgtccttctcctttgtttggtcacttgggcagcatcaacttgtggattgtcttgtccccgcaagaacagtgctaatgcacagatcacacacttaacccactgcaaacaccacatgagaaagagagtgaggaaaaaaagaggacagatgaacaggagtccattggtgttgagattatggcccataatttttttgtgcaatgctgaatactcctttatttgttctatatataatttgatgatcattgcctgaggagtgcttggtgtatgcaactctctgcatccagcagttcactgcacattttctttgggtcatgcgtttggcatctgttggctaatgagaatatttagggcccctttgaatcgcagggtagaaaaaacggaggaataggaaaaacataggattctgacaggaattaaagtgtaaaacaga

SEQ ID NO: 12529 - DNA, 1501 bp, Oryza sativa
actgggtgccttgaacataggagaaaaatgttcgaacaaggttacccatattgttttgagatgctaaagtgaaagagcgtcgtagactaataacaatggaaaataattcggtagcaatctgagtagcacttgaagatatgcaccatgcactaacattcaagaaccttaagaaaaagttaaacaacaccatgcatgcaaatataactaattaagggtatgtttggtttgttactaaaataaacttactaaattttggctagacagcaaaataaaatatatgaagcaatcacaaccataccttgatttggcaactttggaagtttctactcttaaaggtccatcaaaatctattcggggtttgtaaattcgactataactacccgacaattatcattatttcaattgatatggtctgaatccgtagaactttattcgatgaacgttgatagattctgatgaaattcaagtcataaccaggcaattgtcaaaaagatcggggatggatctcgcacctccttctagcatggcaaatggctgatggatgaacctttggctcacaaatttcaagctccgtttacacactcaagtaaacctgaaggatgaaacgaagtcatcttctaaacctgccaccctcagtttcccgcttactgcgcagctgctcggaaacggctggattatggtcacatcgcttcaaacagacccactggcacgttgcctccacttgaaaggcgctattcgcctcccctatacattttttctaatcttcatgtgtttctcctcgatgttttcttcctcttatttatggttcggctgatttagttttaaacttttgtggagttcttttaaattttaattaattcaggtgagaagactctgcctggaaatggctagattatagtcacatcgcttcaaacagatctactggcacgttgcctccacctgaaaggcgctattcgccttccctctacatttgttctaatcttcatgtatttctcctcgatgttttcttcctcttcttcctggttcggctgatctagttttaaacttttgtgcagttattttaaatttcaattaattcaggtgaggagactctgccccggtgtcccttaaaaaaagatttatgcagtcgaacttgattggagatattagcggtcattttattagtccagtgtttgttttaataatgaattaaaactcaacatctatatattcaaaggatgtacacaaccaaatgcatgagatttctcatgtgtttaacttataaaattttgttaatatcattttttttgcattacaaaaaattgatatgttcatcttcaacaaatcaaacatgccttgaagacacatgaatcatacaaagatttctgccacaggacatcttggaaaccgtccaaaaccagagttcccggcccacctcagctcctcctcctgcgtccttttattaatacgcgatccatggcttcttgcatcagctgtttgccccgtccactgacctctctct

SEQ ID NO: 12530 - DNA, 1501 bp, Oryza sativa
cggttgtgtgccatcatgataccagtaactcgtctgatttttattttcttatttttttatttttttttgacgcaaaaggtagagagactctaccttgttaccattgtattaatggtggtcatttttattttttattttgtggttagttggcaatgtacaccaatcgatttctagatacacattattgtcgatggcttgggagtatctgtgtcctctacggcagtacgcatgacccacagcgtagctagcgcgcgtcaatattcactataactgatcgatgcctcctggtattatatactccgtatgtccattttgtttcggttcgggtcaggttttattgtatacagacttggcagaaaacaaagggctcgtgcgcatttttttttagttagtagtcttattcatgggccccatccgacgtcatcatcacccgaacttccaaagcaagtgatccccccaaccccagttttttgacgagattcatgagaagatagcaagcaacaaacgcgattttaaagtgcaagtttagagagccaacgcatacgttgatgcatatgcatgtatagccacaaatctgccgacgtgtacggatacggactagtaatctctccgtgtgccgcaacagctgcctgcggtatatcaaaccactgcacaagtgcagagacgaccggttttgggagcccgggcaggtaacgatcgatcgatctgcgacatgcattgcatgagccatgatggactcaaagagtgagttggtaattggtttggtcaacagcacagctagcttctccgtacgtagtcctccccaatattcacaatcacgatcaacgtataagaatcttgtgttgacacggccgcagatctcacacgcggtacaggcgcctaaaatatatacaccaacatctcacttaacaatctcatttaatattcccatcagtcgtacgtgcacaccagttccaacacacagtggattcgcgcgtgttcggactaggaggactcgatcgcgaactcgagggttgttcgcgcgcgatctgtgcacgcgtcacgtacgcgccagatttgatcgagccgatcgtttccggaaaggcaggagagaacacgggaaagccgtgcgccgcagcatgatccgatccgtctccacggacacgggagctaacgcgaggttagttggcaccaaacaccacagcgcgcgcgcgcgcgcggcagatttgcccaacagcgacgtcgtcccgtgcgccgccctatacgtgcgccacgaaacgcaaggcagacgtccgcgctttcgtcgccctctcgtgcgtgcctagctgtagcttggactcgccaacaccaccacggaactcctctcctattaaaaggcgttccacctgcctctgctcgctcggtcgctcgttccatttgggtttgacacctcattgacatcgggggaaaacacaagaggaggaatcgaagaattaatcgaagcagaggaggttggattgttcgttcgttcggacgacacggt

SEQ ID NO: 12531 - DNA, 1501 bp, Oryza sativa
caatcttaaattgttgcaagcatttttttttcatcgttttttttttctagcccaagtcctactcgaaaaataatatcttgttgacttatttatttttgtacagcatgtgagtctttttttttcatttctcatacatattgtgtttgcttccctgagccagttccggcttataagatttgagttgattccatcatctcctctctatgctacagtagctattcttaattaattgaatattgataagtactaataagttctctagatcttttttagaaaaaaagaaaagttctctggattgttgggtcagagactcatccaaatttgggccaggctctgggtcggcctgctgtcactaggccaaaagtcatgatccagtggcccagatcttattaggtccctcactgtcattaggaaaataatttggggaccaggtgaccctgcttaaaaagttgggttatgttcaaagcagggtctcctaatctcctatgattattttccggatttcaagcattgcgatagataatatatagcgggttggtcgtgaattaatctcttgatagcagattgtgtatagagagtgctatagcggctagtatgttccaacatacttcctccgtttgtaaatatttgacgccattgattttttaaaacatgtttgaccattcatcttattaaaaaaattaattaattattaattcctttcctatcatttgatttattgttaaatatacttttatgtacatatagttttacatatttcaaaaaaattttaaataagacgaacggttaaacatgtgctaaaaagtcaacggtgtcaaacatttagaaacgaatggagtattatcttgggtccgctaactttgtagtgctagcagtagaggactaccaacattatagcggtcgccattacggccactgcaaacactatattaattaccttgcttccaagtaactgagctacatgtgtagaagtctaagaagtggatctgaagtgtttgggttaaagtcactatattatttatatttactagcgtataatatccatgcgttagatcagaattaaggaaacattgtcattaatacattctcggcacaacaggcgggtcctttggcccccacgcacaaactccattttttcccttcacaacagtgtgcagggagttgatggtgtgagtgatggatgcggattgaccattcatcacacctagttgtttcatttaaattagtatatgtatacctagaaggtaatatcatggtttaagcatgaccaatgagtttatttttcttctagaaaggtataattaacaagttattactttgttacaataccaaagcgaatcgattttcttttgattcatcactgtatgtacgtagtatgtgctgacttatcatcaaatttacacttgaaaagaaaattgtgctgatctttcaaaaataaagaaaagaaaattgtgcgcggttcgttgtttcaatttgttcaaacaaggtaaaaatatgaaat

SEQ ID NO: 12532 - DNA, 1501 bp, Oryza sativa; identical to SEQ ID NO: 12531

SEQ ID NO: 12533 - DNA, 1501 bp, Oryza sativa
cgttcttcggcatcatcctcgtcgtcagcgtcggagtcagacgaagtaggaacccttcgcttcctgggggcaagcttcacttgtccgcgcgtccgctttcgcgaaggccctgcctcgtcgtcgaccttttggggattcgcccggggaggcagttcgccattgtaaacccggttcgcccgcccagccgcttgatgcgttaacagctgactatactcgacggccgaaacatcgccgatcatcctgcaggctttggcttcggcctggtcgagggtcaacactgtaaaagtagagtgtgaagctatgtcaaaagtcaaataaggcgaaataacaaagcacagcagtaaatagcaaaacaacagtcttactgttcgccccctcaggaagtatcaggttcggcaaaccgtcgacctcttcgccttgttcaaccgcgacttgccatgactgggagaggggaaaaattcgaagcatacaaaattcctccaccaagtcacggcagctaaggcgggagcaaaccttccgtagtagaacgaaccatgcctccatggtgccgttcacagcaatcttgggcctccggttcggcgcaatcgccttgcgccggcaccggaaggctttcgctgattcagaaatagcctcgaaggggatggtgtggtagaaccacctcgccatccaatggcggtcccacttcgacatggcagcgttcaccggctagagatcggaccgctcggggctaacgttgaagttcacgctcccgaacactgtttttttcattccagccggggtaatcaccgtcttcgagttcacggtggcgaaaaatatggcgccaaagagctcggtgttaggctcaaacccggaagtccagcacgcccagtcaaagatagcgatctgaacaagcgccgacgggctcagctgcggaagttccacctggaagaggcgaaggatttccggcaacaacacgttgcaaggaaaccgtagccttgcctcaaaaaatacggcgaacaccactgtccgattgtcgacaggtttcggcaccacggttttccctggggcgaaagcctgcccctcaaccaacgctccggagctgaccatcttcgccagctcgacgtcgtctacaagagagacccccagaaaggcggtgctgttgtcatcgactaggccgggatctggccctttcgccgaagtagggtttggcttacgtggggccatggcgaacggtgcgtttgcggtggcgaaaaacgagattcggcgaaacgcctgaggggtcgaaagatgctgtgaaaggaagagacggaggaagagagcgctcgcggtaaaatggaaagtggggcggtgaaaaggaaagagaagcgggaatatatagcccacccaggcgaccgttcgcctaaccactagtaataaagcgccacgtgtcgcaagggtaggtgaaatggtaaattcccatcgaccgagcggcacagtgaaaagcccacgataggaaggcttccgttcggcccaggaaaaaaga

SEQ ID NO: 12534 - DNA, 1501 bp, Oryza sativa
acggcagtattgctcgctgtcgcgtggcgcgcgcactcgcgtagtacaccgtcgcgagcacgcacgcacgcgcattgcctcgatcgatcgagccctctcgacgggagttttctttttgtcgccggtgtgtctctccttttgtttactccctcgtgggctcctgtcaatcgtcatgtgcaaagccggtcagatagatagatagatattcagatgtttcgtcttttctcaggccgggagaggaagacaggaagagacgtcgaattgcacgtgttgtgtgcagccatgcaggtgtcaatacatgtgtgatgtgtctactaccaatcgcatgacctggtcgctcctttcctcgtttgttcaagtttaaccagtaaccacaccgacaccacgcgaggtccaattaagttcaatttcgctttggttttatatcattgatatgtatgcatggctgattgtttcgctttggttttattgagtttatgattaaacaaattaccaacttcaagcagtaccagagctagaggcactatcgaccctaggcgactaatatcgctcctaggtggctaggtgtccgatcacttcttgttgatatcgatggcaccctgcacccgatagagcaatctgcagtggagatgtaatgcgcaaattaagctagcttgggtggccgtccaactatggcctagctacgatacttcaagatttatcagattttgaggggaaaacattaaaattgtggtggttaagtatcatagtatatctattaagtttacttattagggtttaaaattctcgtgcgagtagcctttggatagatatcatgtgaggtccataaaaaaaattattaagcgctatctaatgtgaaaatgcaagtgtcggacgtccaatggacccgagaaaaatcgggcgccgcaccgcccgccgcccacgcgcgtgctccaggcgtccccaccacgctccacgtgtcccccaccacacgcgtccccgttacaacagtcgtccggatataacagaaacaccctattaagggaatccgttttatttttttccaccaacaatatttcagcaagtgaactcgtgatgtttcattatgcatgaataaaatgttgcagtgggttttttatactgtttaatattttccatcttgatggacacgtgggttgttgatatacacggggtttaagtgttgaatggcttcgaatcattcgttgcatacgttgaacaaaattgtttcatctagcgatctgaccgtgtttcacttttttaaagaattgaaacattctttcgctatttgctgaaactttatttttatatagggtaaaagagcgtctgattttttggaacccgttgtttcatatgttgtagcaaaatgtttcatgaggtaatttagttgtgtttcaactttttaaaagactgaaacattttcgatctatttagtgaaacatattctgtcagggttacggataaggtataccctctatccttggatatacgttgtatgctgaca

SEQ ID NO: 12535 - DNA, 1501 bp, Oryza sativa
ctaacccaaaaaacagaaggcgaggagggtgacaaagccgagcgccgccaccgccatgactgtaagtcatgtacccttcaccggcgctggactgacagcaagacgacgcgtaagagaagctatgaatccttgaacgggtcacggccaagggggattttgtggaatcggtatcttagctgatgtctcccccttttctcttcaccttctctctcgtggagcaatcgacgggcagggacggcgacagtgggtgggagccgaagcggcggcggcggtgacaggcgggagggctagggggagggcgctggagtgtgtggcgtggaagctacccccttcagcggcggggtgcgcgggggaggcgtgcgagcacgctaacatccctccggttcttctcgaaagtcggagcagggttcctccctatctctaccatcttcggcggaatcctgtcggtcaattggttgtcagccagagcaagctgctacagttccgccgctaccgtcgcttcagctctcgccggccaccaccactctagcccccgccactgccactccagcccgtgctccccgtggccgaccgaaggggggagaagagaaagagaaagaaagagagaagggaggaagaggggaggaagaagaaagagagagcaggacatgtgggtggccccacaatttttttatgtgtgtgaatgacaaacgggtcccacatatacgtttttaattcaaatgccacctaagcaccacgtcagcgaaaccgccctcaaaaccacaaagggagtcaaattacaccggttttaatagttcgggggccgagatatccggttttgcgatttatgatcatggattagatttaggtcacttttaggggagacaaagtggacttattccacgaaaataatattattgattagttgggcttattcattccaaagaaatataagttgggcctaaattcaaaagatataaattaggctcaatttcgaacagaatttattagtcggcctctctgacagccttggcccaattgaattattggacaaagcggtgggcccactgaaaacccagcccagatggccgaccaccgatgtggtgatgtggccagcaccagcacgacaccgcacctgaccaaaaagcccagtcacatccgcccatggcttaggccagcccgcgccgacgagctcctcttctcctcccatctccaccacgcgcctacccgcacgccgagctgtcgccgcgtgtgcccccgcctcgttccatcgccttcgcgtcgcgctgtgcccactaaaacaatccggccagttaacacttcacacccccgcgccctctcgtcccccttcctacgtgtccccctccctgatcaagaacggatcaccggctcggcgccccactctcttcttggatcggggagcgggagagggggaggaagaggcggcggatcagaagatttgggcggcggcggcggcggcggcggcggcggcggaggtggtgtgggtgggtgagtgagtgag

SEQ ID NO: 12536 - DNA, 1501 bp, Oryza sativa
ttggttttgtgttagaatagatcttaccaaatgttttggtattagtgtgaagagagacatggtgcgaatgcttttggagctactgaattttggaatggttgttcgtttgtgtttctttgcagctggctgtgggtgcggccgtgcgggtgtgctgtattacagtgcaggcagtaaaaattatgttgggtttggtggtgttgttgcggctgcacagttgcagcaatctcttcggatcaaccccaaagtgtttaagcaatatttagtttgtttctttactaattatttttgctaggaatttctttactaaagtttgataatactgaaatattacaccgatactctctttcagacaaaggcatgatccagaattaacttctagctactgatgtaggtagacatggctcttctagctactgatattgctttggtaaaactgcacagaggaacaattatcaattattgggctatgttttctttccttttcagaagtcacagaccattcttgtatcgaaatggcagcccaaaataagactgggctagatttgtagggaaacggaaatctcttcctgttaccagtaataggttatattttaagcacaaatataaacttttaactgaaaaattttaagcaagagatagaaactcttttttttattatacggtaaacacataggagcactcaacattacacacacaacatcacactcacaccccacgaatgtgctccataacgcactctaatagatggaaactaacgacatatctctaatctcgctaaaattctcggcctcgtcttttcgtttatgcttatacttatcagccaaaatttgaattttcaatcttaaatctggagttgattttggggttttttttcataagtatttacttttagatcgctaagaacacgtatataaaagttttatccacaaattatttttgtttgcaaatatgccatttcgcacgtctgttgaaaactcatctacgtgtgtgtaatattaattgtttggtaaatggaatcatgcacctatgacttcagtaccacatcacttgtgctttcctagaaacttaatctgcaagtgctttctgcgaggaatcaaagatgttttcatccttatttgaaataccaaggcctggtttagtttcccactttttcttcaaacttccaatttttctatcacatcaaaacttttctacacacatataaacttccaacttttttcttcaaacttttaattttagtcaaaattccaattttagcgtggaactaaacacaccccaagttaacttacacgaatatgcatggatagtgaacgacctcagccaactgatgtatggtttgtttaatactatatgcgataacctgagtgcaagttttatagtagagatagcttctaccacctttaatctgatgcacgttatatataataaattaagaggtaatatgtactaccaatagctataatactcttatgtttttattgaagttttatgtagaggttga

SEQ ID NO: 12537 - DNA, 1501 bp, Oryza sativa
ttagaggaaatgtaaaaacaatctggatatcatctaggtggaaacgaattataatgacttggattaaaagagtagttacaacttgcttttatttttctgcaacatactactaaatttagaatacaagacaagtacaacttcatatttactcatccatatagcagcatataattttgtaagtacaaattttaaaattggaggtattaataaaattaagtcaaatgcatgtgaatacatgggttatagtattgactagtatctgaaatgagaacttcaacatggaaggagttatggtcatggactactgcaaagtgcaaataactattttgtcacaccattcaaatttccgtgttaaaatatttcaaagaaaatgtttaggtcttataatagggatcattgaatagtttgaaacaagttaccactgattgattttttaagggcatgtttggggaggttatgagagtcagagattcttctagaagctgctattactagaagctgcaccaaaccgtctagattttcactcagacggtaagaagttactttttctcttcttgaaagaaaaatatgagaattgtaagcgatatcactgaatctctacgcacccaaaactgatgccaaaagaaaatggaagcaaaactgcaaacccagaaagggacgctgaactcacctcccatggtccccggtggtgatggtggcgccatgttggccggcgacggcgccggcgccggcggcggccccggcaactgcagcagcggccggccggagaagaacgagtacgactcgaaccggaagttgcaccgcacgccgaagaccctgccgccgggcttcccggcgaaatactggggcacccacctgattatgcggccgaggcagctccggcagtcggcctccgacaagtccggcgtgcactgcgccagcgagaagatcctcgggtacgtcgcgtcgtcgaacccgacctcccccgtgccgaaccgcctgaccgggtccgccgccgcgtagccggccgtggcgttgacgagccggccggaggcggcgtcgaacgccgccgccctcgccgcgctgacgttgttgtagttccaggcgatgaaattcccctggccgtcggtggcgttggcgaggatgtcctggtcggagtagcggaggatacaggggtcgtcgaacatggtggcgcgcctgttgaacgcgcacagctgctgcgcgtcctggaaggcggtggcgacgcaggcggcgcaggaggaggcgttggtgtcgccgcggcagagcgcgatggcgtacaccacgtccggcgccgcgccggcggcgcccttggcgaagagggcgcgcgatgaggaggcgttcaccgggagagcgctggcgagggcgcgcacgttggcctggtaggtgctcccctccgtgtagtttccgccggcggtgtcgcacatctgccacggcagcggctgcgcttccgcgagcggcggcgcgtggaggaggaggaggaacgccacgagcagggggactg

SEQ ID NO: 12538 - DNA, 1501 bp, Oryza sativa
actatctgacctacacaacaactatacaaacaagagaacaacctaagagttctagattatacacaggcaaagaggtgagctcagccaacaacaatattagcatagcacaaagcaatggaacaagaaggtaaagagagtgaagatatcaccgaggtttacacgccgatgtatttcccggagttcaaatccttgaggggattctagtctccgttgaggggctcgcaaagagccgggcctttttcaaccctatcctcatgaggttgcacaaatgcactcctccttccactaagggtatctctttccttgtggaggcgagatccggccttcataaacttcttttggccaaccacacgtagatcggtggcccaagaataacacctagccgtctaggagtcctcaacctctaagagtaataagcaccacagaactcttggacaaatcctaatgctcaagatcaagagaaacacacactaggctcccaaactccaaatccacacacaaagatccaagtcacaaagaacaaggaggatttgagatagagagggagagagcttaaagatccaaagcacttaacacaaagctcaaatatggggggttttaagaatactctgcaagaggatccaaatatgggtgttggaaagccaagagggaaggcagttaaaaagctgaagcagttggctgaggcaagtggaattgttttcccatctgattctctatcttctactgatttaaatcctgatatatcttgtgaatctgaaagtgatcttacctctgttatacctgctgattgtgatatatctttgcttcaaaagataggatctgagatgtgtgagacttccgggtttcaagcttggtggacttgggagatgttcaggtcatcaagccaaaagctattggaccatccactgatgaagcctagttctgtcaaacttttagggctgctagtggcactctttaggggcatgtgtttatccctatatcagcccttttattttgtgtttaagttatgtaaactctatgctggtactatgcgttggtgtgcttgggatctgcatggattattcctgcttgttatctttctctctttaagactagttatcaaatgaattcggttatgagaaattggaatgtcctccgctggaatgttagaggtctaaattctgatgacaaatggttagccattagaaataaaattgaggaaagtggctgtgttgttttttgccttcaggaacaaaaagatcctcttttgatcattcttatataaagaagtttgctcccaaacgttttgacaagtttgctttctctccatctgttggagcttctggtggtattttcgttggatggaatagttcaatttttgttactttcacctcaaaccattctggtttggtatgtactatagtttcagtttatggtccttgcactggtcctgaaagaaataatttcctgtcctggctccaccagttgaacattccagatgatgacctttggctcattattg

SEQ ID NO: 12539 - DNA, 1266 bp, Oryza sativa
tcccaccaatccggattaaagatggaggatctttgttaacaccaatcgggactaaaagtatctttagtccagattggtgagattggtggaataaaaattgatctttagtcccggttggtaacatcaactcgaactaaagatgcctccaatgttagtttaaaaataaagcacctctatccaagttagatgtgtgtattagttgggatggtaacgcgcgtgagagctgaggtaagagatcttgagctcgaatcccacatcccacacatttttttgacttggtatgcattttagtcccggttgtttcaaccggaactagatgcgcatctttagtcccagattggacgttccggttgcacaaccggaactaaaaagggttgccaactattcaggtataattaatcttgatttcttaaatgcaaaagggccaaatgtgtagaaaatctcatcactaaccagaaaccaatcgatcattggttgtacacgaactagtgatcagtgatgatgttaaaatgatgaatctgtataatgctagtcatcctttatttgtgctagcaagacagttaattcgttgagaggtttacaattgttttctaccgagtaaactattactcatcagtagaatggttaagctagtcatcctatatttgtgctagcaagatagtttcgttgttattttgaggtttacagttacagtgctatatttcgttgttgcagttgttttgaggtttactgagtaatctgtgtcggtaatggttaaagtacatgaagacaattaatccaccccgtttaaccccatttaatggttaagcttttcattagaccggttgttgtcatataactcaacttagacttgatatattatgtcttttcttgtatgattatgtgatccatcatcttctatcgcattggaatagacggttaaaccctaacatttttcatactgagctattttcattgaaatcatatccctatacagcaaaataattattctcatggtgttttataggctgtcaattttgggtgctaagtaccgtgtaatcaaaacaccaagatttgatggacctggcggatacacataagatgttcttggaagatcagaaaccgggatatactatgcaaaacgtcagaattttcaacttcgggtgtgggcactcgacgaatcacatgagctgacaaagtgggtggtcaagtatgatgtgaacctttgtcccttaaccaagctaatagaaggtttgttctgatggcatcatgcaaagatcaacaaaa

SEQ ID NO: 12540 - DNA, 1501 bp, Oryza sativa
acagtgaaacctttattgtcatcggctaaatccaacttatatgtatatgcaatccttatgagccgatgcaacgttcaaataactcaccagctgaaaccccgatgaaacccttattggcaatcaagaagcaggctagagattatggttctaagcacgacttagtagatcaaacttaactgatgcagcactaggtatgaaaagaaacacaatatctagacaatcaagccgttgactgattttcagggtggtagatgcctaggctaatctaatctagcaacgcgatttagccgataccggcagaaaccctaaagcgagagacagccgatagagctaaattgatatgctaagactagattaacagagacataataaataggtaggcaaatatatcatccaaactagagcaatccaagaggtcgaatgtactgatgcagccttgaacgacgccgacgtaaacgatacaattgcctggggcgacggaacattggacttaccccttcgccggagatcgaacaccgatgcagccccgcatcaggtgtcaagtcccgccggacgataaaataaagtagaaaagataaaaggtggcgatgcgccgaattgtattgatcgtgacgatagattacatagagcccgggtgtacatatttatacccatgggttgatacaagtccttgtcggacaagaaagaaactaacctaaaggtaaaaggaaaacataaagtccttatcggacactaaacacaccttcctaaagataaaaggaaactaacaaactattcctaattaatagataaactgccatgccgcatcctctttaaactcggtcacttagagataagcttcctttagtagattgatttccttaaccgaatatagcaggaatgcgactattggcgacttgataactctcatcgactgattccgagatgctgcagccgatgatgtctttgccgattaccaaatttcactattaacagaacttcaatgttcgtcccgagcagatgctgcagccgataatgattctaagccaatgacgtctttgtcgattaacaaatttcactgttaacaaacttcaatgttcgtcccgagcgctccgatctctggccggttaacgcttgtcacgcctagatatttagcacaaatttccagactattttgtgtattaaatccctgtacaggaccagccagggtacacaaaacgacaagtaatttacagttccaaatgtaaataaagcgtaaaatacttatagaagaggcacttagtcctcacaccgaaaagaaagcagtagcagcggaaaaagcgatactagcggggcttcagctccactccacaggcaaaactcaactggtgtctgagccttggtcttctaacttcgtcttcggctcagaagctatacacttcttaaaagggggaataatagcaaggctgagtacaaccaccgtactcagcaagccacaccaatgatgcagacgtgcaaggggaacgcaaggatgatttgtggc

SEQ ID NO: 12541 - DNA, 1501 bp, Oryza sativa
atcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggtcagagtttaaactattcgaatagccgtacccgcggttatgggtgagttgagcaatgtttttcgtgattagtctcacactactcattaatggtaataatgtggtaattaatttaattcctagtttggaatggataattcctggttaggaggtttaatttgttcaactggggttggttgttcaaatgtggttgggcctatgcaacatgggtgtgttgtgtggtgtttatttaatattgattaattatacaaccgttttactattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggtggattaggcttgttctcggttaagatgcctgtggagtggagtcgccatagctgttccgtagtttgttatagttttttttttccgatgcgtagaatgtttttctttgagaggaactatccacctctgtaataatttattatttgcgattattcgatagttatttatttgtactctattatcaaattgtcattgtgtgcctcggttgattcctggacgagggtttaacacacatgtaagcgcttggaattttggatagaaattcccggcatgacaagttggtatcagagccaccttgaccttaggataagccaaatggtaaaccttaagtagccttcaaaatattttgaaaaaaatagaactgctcttctctagtctcttataaattaattaagttggcagcacatgcaaggttatgcacaaaaatttatttaattcaatttcttttcttttaaaagcaaaaattcgtccttctcaaaatgtttctttctctctttaccaagtcttattgatttgtcggcactgtacatccattatggtatcgatacaatcatgatagcactagtactactcatctttcctatggtgacactgtaccgtgcttataatagatcataagtattttagtttatttttgttatttgtcaaaaaaaaaaatttttttgtctctgtccaaaaaagttaaattctaaaaatatttataaaatagctttgtatgtgtcttttcttttcttcctttttggtcaaaaatcagttaagtctagttggtgcagctaacttagaaaaatatgcattaattcttctcttctatgtttctttaga

SEQ ID NO: 12542 - DNA, 1501 bp, Oryza sativa
cctgaggtgcttgacctcactgaggatgacctgatggagaagtttgcttctggtgtttctatggttgcctcagtctccctggcaatctcgtacccaactattgctgctgcaccacacatgttcctcaatgggtacaagaatgtgcttgctgttgctgtggagaccgaatactcgtacccacatgctgataagatcaaggagtatttgaaagtaatcttgtttctatttcactttatgatgatgttttcttaatgcttgataattggtctaactaagataatcaatagatagtagattaccatactaaaatgtagcatgtccatgtcggtacattaacatcttgtttggctgcttggtgcagcgctgctgcagcggctgcctagcagcatgcagctagctggtgaactggtcatttttacttatctacataattgatttagtcgttgagcattattacatagtctagtgagcaattgaatttttatggtagcaaggagtatttcacttaggctgtttgtgcctttattggttcatccatggtagcaaaatgctgtttaccacactagaaaataagttaatgctgctttggaagcggttgcatcatggtttcttacatatttatctggcttatatttctcaggaccccagcaagttcgctgttgctgccccagttgccgccgacagtggtgctgctgctccatcggctgccaaggaggaagagaagaaggaagagcccgaggaggagtccgatggtgacctgggcatgagcctcttcgactaagcctcttgccatatcgctgcaaagttgaaagttttgtttcaagttctgaacatcgaagtttgtttttaatctttagcatattaattttctactagacaagaatgtatccaacaatggtatcgttaattatgcattttggttgtgcccgtatccccctgctgtttttggtgtgcctgtgcgatggttatcgacttcatcctcctgtgcatttcatctttttctttattcgaatgcatgtatcctagaattgcgcagcgatcagatcatgaagaaagaactaatgccgtgcgtttaaccgccgtaagtttgcccttgttactggaaaatttatgcagattttcacagaaagtaactttcccatgtttctgtaaattgctgcaaaattttcacagaaatttctgtacatttcagctctattttcttgcagcaaggcaagaagtctaaagtcacttggtcagataatactactacttggtaaaataggtttttccaggcaagaagtccttaagtcagtcacatggtcagattctacatctcgataaaataggttatctgtctggatatgtagcaatcagtggcctcctatcctgaccacaaccatctctgctgctctgaacttcttatctcgaatcgaaagaaaaaaagattcagatgtcacgcaatcacgttgacacttctccttcctcgctcgctcacgctgttgcgttgcatgcgcaatgt

SEQ ID NO: 12543 - DNA, 1501 bp, Oryza sativa
agagagaaagaaagcagcctgacctatttggtgtactaaatgataaatttcttgacttggacttccgcttttggatttcagcagagttcgttacgagtttttctctgggcagcagagctgtcaacctaaattttccaggctttctctcgaaatatcgaattgatgtttttggatgattcgatcccacggtgaagtgaacgccacgtacggtttcggtcggaaaatcgactgcgagtgcactgcagctggctgcagattattattatttttttcccccaatcaggagcgagtctgctcagtcgccggtatgcaactgaacagggaacaccgttttttctgcacaggatttgcacgccacgtacgtagatttaatccgtgatttgtggcaaaatttagaaaatggttttcaacagtgagttcggattgagacatccaaggtctcgaatttctcctgcagcttctgcaaaacgccgaactgctccagctaaactggttggtcggactgcagactgccttgtctgtatcgtctgattccgatcagctgcctgccggcttgcaaatcaaacaaatcgctccattatcttcagagtttagaccatatgctgcacaaatgtgtacaggtggtgagccagcgattctggtttaggcgttacctgtaattaaccagaattcaggttttgtcagtgccaccatcaaacgaaactctgaatctcccagccgtcacaagttcagaaaagatataattcagctagctgcttctccagatgtttctagcttgtggtaggccggtctatctgaatttcgtacgctgcaggacaccaaacagagatcaacatttatgaaacagcaaagatctcgtacatgcccccatctccaagattatattgggtcatctggtgaaattaatctcctggcaaattaagtcaagatgcaccgtctgcaacacgaaatgtaatgttgacacgcaaatgctagaaaatgatttcagatatggtttatattaggacttgggagttgggacacgtatgttttatgttcagatagggtctattcagtcgtagagaagaaagtgaaattgcgagcagatctgcaaacatacattaaatgatgcatccagaagagttagaagtcatgacactactataagtcagattaagcttggattatttccagcgtttccttgccgtcgctgcacttgttttatccaagactaatactgtaaacaacttctggtttgattggaataaataaataaatattaggtatgacacgtatgtccacatcaaatcttcacgggccagcttccttccatcagatttgagaagaaacataaccaatctggactaattccaagtcaattgatttgactatagattaaaaatcatcagctagctgatcacacttatcctcgaaaacacatttctctaacctatataaaccctgccattgttatcgaatttgcaagtgcatccataagatttttattttttttttaaaaaaa

SEQ ID NO: 12544 - DNA, 1501 bp, Oryza sativa
tggagaagaagctaggtctggagattattttcctggtcttgctacttggtacatgttagtgccctttcttctgatcgtgtagaaagcacgggtagaggattattttatctagggtttggtcttcaactgttatacgccgagctcttgattatttggtttgtttgctgctgaattttatctatatatgcaagtctggttaatccatcagtgttgagattaattactggagttgtgatttttattagctgctgattcagatcgttggtgacctcacgctgcctggcaagttcagaaagttaatttgttaattgctattggtaccgtaaaagagagggataaaattagggtactcggtgttgggtaatcatcatccttacccataacatccggtggatatatttcttcaaatattggttcgttattcgacttggcggtactcgatcttttatacaaggacgagcaggttgtcctcggatcatcaatgaccacctcataacagtgaacaacatccatccagattcagcctataaaatacagccaattgctagcaggggtagattggtcatttcacgtgcctggtccaccctggcatgcatgtgtggcgctgcacagtgcaggaagtggcaaaaaattacaaaagcttctctctagtggcaaattcttaagtgcaaacctaagaagggtatttggttaattgtcgaacgcaaaagtgacaaatagttaaatttccctataaattctgcttcaccacactcccttaaatcctacactaaaatttttcactctatcacatcgaacatttcaacacctgcatgaattattaaataaaggctaaaaaaatatcgaactacgtagattgcgtctaatttgcgagacgtttaagcctaattgctccatgatttgacaatatggtgctacagtgaatattggctaatgacggattaattaggcttaataaattcatctcgcagtttataagcggattctgtaatttgttttattattagactgcgtttaatactttaaatgtgtgtccgtatatccgatatgacacgttaaaactttgcacccctgaatctaaacaccccctaagaaatcctatacttttcttaaaatacattcagacgatgatatgccatatttagaaaatgcgcaaatattttggattagatatttgatctggtctccgtcccacatggcactaacgtggcattagaattaaaaaagtatacgtaggactcatttgtcattcacataaacaatattatgggacccactgacatgtaggtcatcatctttctccatatcttcttccttctctttccctcttccttatctccctgtctcctctttctattcaccttcatctggcagcgacgagggtagcggctcgacggcgatgagggccgcacggcggcgggcatgagggcgatggagcgacgatcgcggtgggcaggcgaggccctaacaacttgccatggccacccaccaccgcagccgc

SEQ ID NO: 12545 - DNA, 1501 bp, Oryza sativa
acacaacagggaatcttaaaatgtagatatctgctcctatccaataaaaattatctagaggtacaggtacttcacggtatcaaatcatttttgatctttttaatttaacaatgctcatcctatccagttagattcaataatcggaaacgatttagtaccgtgaggtaccggtaactcgagatactttttactgtatcggagcaaatctataaaatgtaaggattgatgcatcgatcatgtatggatgcttttttattcttccaatgcagaagctttgcacgtcaatagaagctaggtcatctgcaacactcttagaagctaggtcatcgaaaggatacgtgggatacagagagataaaaaggctgtcacagacaacagaaacttgtagaggatatgcatgctaaattaagcacagactaattaatttatgtgcgttgctgggcacttggggcactttgtacgcgctgcaagtaatccacttttcaacctgaacatgtacatgcactactgctgttacttcggatgcatgcaaaatatatatatgcaagtatgcaaactaccggatcgatttgtgcatgaatctcacctaattttatgcatcagcacgcaccgaccattgaccgttccgtgctctgctcctgcgtttgggttcgcaaaaaatgctttaataatccatcaatgtcagctatacacacacttaaatatatcacgcaaatattgctcgatcccaagttaacggtcgccctgctccctgctggtccagctatatttattcagaattcagaaaccgcccctgcagctgcactgctgctctcatctctataaaaggatctagctagagccatgcatatggccatctgaccttcagtgacagagcacataaaaattactagaagttcaggcaaaatggtgcagtgcaggttcaggcaaaatgcaggcgatggagaagaagacacgggtggcagcagcagcagcagcaggaggaggagcaggcgaggtggtggggaggcgatcatggcgatcaagaggaagatgctgcagtgcagcagcgccaaggaacagcacggcgggaagaggttcaagcggagctacttggccggcggcgagcagggcgacgccgccgccgccgccatcttctacctcgcctgcctcgccgcctgtactgatgctttctcacctagctgcctctagcttagattagatagaccgaatttagtcttctccatcttcatctgagaaaccaccatggtcttccggctagctctaagactacgagatagtggattagccgaccttagtttgacgcctcactcctaattatttctttttcatctgttctctctgggcctttctgatcgcttattcacgatcttgggccgcttggccagagaaagatctgttgggccggaagatctgttgggccagcatttattgtagttgaaataagtctactatacctccctcatctcttgctcttgattcgtagcaaattgactcctcc

SEQ ID NO: 12546 - DNA, 1071 bp, Oryza sativa
tcgccgacgtggtgtaccacgagaaacgcggcggcggcggcgagagggcggtgtactgcctcgcgacgagcggcgacgtgcacgtcctccgcctccacgacgccggcggcgcgttcgagccgctgttcgacaggggcaacgcggcgttcgacgccgccgccgcgttcgcgccgccgtacgacacgatccgccactgcaccaatgccaagaacctggtggtctgcgacgacggcgacatgtaccagatctggcggaacaacacctgcaccaggatggggccattgcccggcgggggagagtaccgcgtggagtacaaccagatgttcgttctgagataccaccctcgccgccggccgtgctgggtgccagtggaggatctcggcggacgctcggtgttcgtcgggaagaacaattcggtggcgctgcgcgtggacggcggcggcggcggcggcggcgtgccggggctgagagctaactgcgtgtactggactgacatctgtccagctcgggccaaggtattcgacatggtttccggcaagtcgacgctgtgctttcatggcgtagaagaccaccgcgccatctgctggtacttcttggcgtagcagcagcaagaagcccaactctaggttcagcttgtcagcttccggaatcggattgagaaagtttgattgaattggttatgtggtattggaagtttaggctgaattctgtgataagagacagaagttttggctgtcttcgttgctgtcattccgatggtaaaaaaaaaatgagatgcggaagtaaattttcagtgctgtgaaaattaaacctgtttttcattgtttcagattaaaatagtttccctgtttttgagtgtatctgattgttgcttctgtgatacaataatgtagctgatcgaagtttctgaggccaaaagcatggccatatggtttctgatgaattctggtggtgtagctagcaggtagacttgtggataaacttttcttttctccaacaaaagttggataaacttttggatacttgtggcatgcttttcaaactgctaaattgtgtatttcgtgcgaaaac

SEQ ID NO: 12547 - DNA, 1501 bp, Oryza sativa
atcgttggcggagctcacggtggttccctttttttccggttgaaccggtggctgaccggttttttgtactaggcttcttcctgttggcggagctaatgtggtaaggttgggacgacggatcgttggcggagctcacggaggaggagctaggcagcagtgcagctctccgacgagatcgtaccagcctgtcgtctccatcttcgctgtgaggaggtcgtctcgaatttgcccacgtcggctcgagtactggccgtctcgagctcgccgcagtggacgacattggtgatgctgatatggggaaacaacaatacatggcgtcgctcgagacccctatgtcaagggcctattgggtccactaggtcttttgtttttaaaatttttcaactcaacgacatgcaggtcccgttaagtttttattcttttattgtagtgccatgtaggatgaaagaattccacatacatacgtgatcttcgctaccggcgccattgccgtcgccaccaaagccccgcaacttctgagcctgacgctgccgttgacgagctcctgagcgccggatccactgtccttgtcatcaccactgaggtcctgagcgccggatctgcctctgccgtcgtcatcgccgctagatgtccctgcagctcccaaggctagcgccagattcgttgttgttgtcatcgctgccgaggttccgagtgctggatctgcctccgctgagttcccgagtgctggatctgccggttcctgagctcccagcccgcacctaccattgccactgccaaaagctcatcaccgccttcgcaagcccatcgccccactgctggctcccgtcgcggcgccccgccgaggcctaacttcgccagtggatctagagggggagaagtagaggtggagaaaagctaagtgagagagggagagagaaggagaggatagtggatcacggtggggggatggttataaagaagagggttggctggaaagttgtttttgcatacaattcttttaagtggctctgtggagattatggttaccccatatctgcatgacggttatactttagtcggatatacggcactaaatatagatagaacatctttatgaggattcgggttggattctaaacttgtatctcaagaaaatacccgggatcctagtcggttacgattgtattctatctgtaatcccatgttccgttaggatatgggctgtactttgtaatacggatcccttcccctatataaggaggggtccgggttcctctcgggacgattcttttttctcccaatcatacaatcaataatacactcggcggaatcatccccggacaggagtagggtattactttttgaataagaaggcctgaacttgtataaaatcccttgtctctaaacccatccactttcctaacttgatagccacccccttttattattgccgaaatcttgtttcgacagttggcgcgctaggtaggggtagcgtcaagttctcgccgactaagtgcga

SEQ ID NO: 12548 - DNA, 1501 bp, Oryza sativa
agttagttctggtgtgatgatccaccatagctaaattttagtgctagatctgccattgacacaacatattaaagtccatgctacaaatctgtagtcctctcatcttttattttttttccgcatgtgtttatatttgacttatttttttccgcatatatttataagtgacttgcagcctactatgatacttgctctaatacacttccctgattgatggttacaactagcacttgcatacggcccacggccctaggctgtcactgccaagaaattcgagtcaccaatgggccgtattgcagtgtaatatctccgtctcaaattatttactccctccatccacaaaagttacacctatttcacatttgatttttttcaaataagttgttcctatttgtagtctttatgcattcaagacttaaatgaagagataaattaaatgttttattagaacccaaggagtcatctaaatactcattggttgcatgcttgtattcactccttgattttacaacatccgaggtgatttaatttctccttggtcttggtgttaaaagtaatatgtataactattgtggatggagggagtattttttaaggttgtttggcatatcctaaagtttaaaacaaatgactataatacccttataaaataatttatggttaagaacaaattactataaactttataaaataatttatggttgatgatagaaaggtggttgagaggtataacagtgaaaattttgaatggaatgtggatggcgccggcggcgtccgtcaccgcctccaccgcacgtcgcgcctggtactgcgcatccacaaacctcacaccaccaccatcactagctcaacaacaataaaaaaaaagtgcagtaatcaatcaaaacgatgatatataattcacctcgccctcggcgtgtgccttcccggactcgaaggatcgctggatgttgctccacacgcctgctgccgatagatgatttgttgattgattactttctttctgctagcagtgtaaatctagacgaaaaacaatcttcttgcctgctttgttatatcctgattcgatttgtcaggattttgggtggcgatccgtgaatcaatctccgctagctagctcattcttaagttagatggcccataaataggagctgtaatcttttcctttacatcccatggttttaatcttataatttttcttctgctctatcaataaaatttcgcaccgtcttatgcgagtcgttaaaaaaataagaaaaaagtacgaattatccctccccctgaacaattgcggtagtacgatttaccccctaaactacaataccggacatttgacaccccaaactcttaaaaccggataaattataaccctaacttgattcaaagcggttttaagcctacgtggcacacacgtggcgatacacacagcaaaaaccgctgggacccacctgtcagtgttttttttcctctccttctctgcctttctctctcggtgaacaga

SEQ ID NO: 12549 - DNA, 1501 bp, Oryza sativa
gccggaaaaggttgagtctctgattgcatcggctacacatttttggtccgatactctgaacacaccttcttgttcaaccatgggccgatcagtcccaccttgctcgatatcgtcatgctaactggtttgaacatcacttcatcggctaatctttgtagtctgagaataaaatgtgttaacaagctagagaccaaatgtgtcagcggctggtcagcttgtatcaccaagcatgccagaactggagcagtaaccgacagagagcatgtggcctttcttaatttctgcttggagagatttgtcttctgcagtgcgactattggagggtcagcccatcggccacttgggcagtccatggtggcttgtacaactctggcttaagttctacaccgtcaaaatcactggagtgcacgtcactgaatcaagatttctggcttatttcgcagaaggtgatgaaaaatctcttcccagatgcacgtcacttggcgaagcagcaatcatctatcttagcagcaaccttacgcttgaaaatgtcatgctctggttcaataggttctacactggtttccctagggctgcaccagaaactggttcccttatgaagaattcgaaggctatgaacttccatcggacttcaatctgaacaacattaactctgatgaagcaagccgagagatatttataacggctatcaccccttgcattcttcagaccggcatttctatgggacaccactctcatatctcgtatgaattctatcacccattagtggtggcccatcaacttggtttcggccaagtccctatcaaagtttacttcatcaaaaagatacaaactcggggaacgatcacaagtgcacttaagtgcgattgtctcccaaacctcaatggtccaaatcttggtcccttcattgactgggacagccgtactatcggcagtagaccatggatcaaatggtggggtgaatggaagcgtcaccttttcaacctccagtctacaacttcctcgctttacttgatcctaaattcgttcctgatgatgctgaggtaaaatctttgtgcactcaattcttcctctatttcaagcactgatcatctgtccatttatatgcaggaagacgatgacactcccatgaccagctttagtgctctgccgataaattatgttcccttatcggtatcgtcaagacttggtgcaggtgcccctcccacatcttgcttacttcaagaggctatgagggagccgataccaagtctgaagactaagcgcaagaagccggccatgtggcacaaaagcaagacgcgtgttggtatttcttaatgacattactagcaacataattctcagcaatggcgcagaaataattctggtatattatggttacacatttcatccgcaagcgcacggatataccattgtagcatttcaaccgagagtattccaagggtatcgtatttattttatcccgtgggaagatcatgtagagagaactcaactaataatt

SEQ ID NO: 12550 - DNA, 1501 bp, Oryza sativa
cccgctagagttttgaggcaatcaaggtgcagatatacccgatgaaatttgttgtcgagtattgtagccgaagaatcttctgccgcttaactatacaagcagctctgcggcagcagcaccaactttagtgtacggtgtcttcaattctgaacgtactactaggagtactccatctctgtagtttgagccaaaaaggagggcattgccactgcagcactgccatgctgcatgcatgccatcccaggctcactcacacagtcatccttcggactcgtccgcggactctggatgaatgagagcaggttttcatcactgctctactagtgctctcgacgccagaaattggcatcaactgaggcatactcctatcctacctggccatgggccacctggggcaccatcctacgactgctcactggtggattccttcgtactcgtcggtacggcgccgaagccttgaatttcgtatcaggccgtgaatgaatccactcgaaacaagtgaacaagcctttggaatacggatatgtgttctgttgatccaaccttagtacagaagtaaagtgtactccaatcaagtactactcctccacatcaacgaacttgacagttgacaagacatagaggcacttgacagccgtgttgccatacaaggagagccaattaatcagttcacaaaagctcagttcaccctgctgcgattactcccgtaaccatcgtgaacaatgaataaacaaaccttcacgaaacagccaaccaaacagctgccgagtgtcaccaccaaccaaccagcgcaagatctcgcatgaaatcctcttcctttgtctctccatcgcgggggctatttgctgcgtcggcgcaccgtcggccgcctacagggccaacacctggctgcatggcccgcggctgccgtgccgtgccgcactcgcgcgacgcgcgcttccctccggggctaagaaatcccggggaaaatccgcaccgagcaaccgacgtgttccgcggcgattcgagtcgccatcaagtcgcatcttgtcgtggggacatgggggactaatggccacgtaggaaactcaaacacccgcaccgtcgaggccccgcctttgcccccacaaccgcgaacctgacaggcacacgaaccggacgagcactcaccaacccgctgcgcccaacgcgagcgtcacggtcagtcgcacacgtccgaggcctataaacctaaacctgccaccactaaaccctcccaaatcaaatcattagccaaggccaagcaggcgcggctgcttagcttataaagagaccagatagtactactcagcttagcacacccaaaccgcgcgccatctcaccaaaccaagggagaagcttagctccgccaactagctcgcgctcgcgtgtagcggataagcggagtatcgatcgatggatcggacgtcagccgtgccggggagagtgagcgacccggggtccgcgtggttcggcggcggcgagaggagctcgtcggccgggc

SEQ ID NO: 12551 - DNA, 1501 bp, Oryza sativa
gtattaatagtatagtaagcaactattgtatgaattgactattacattggctatagatgatttgaagctagtagtgggctgtactattaaacttgctctaagggacctaattagcccgattagactgtctaactaggtgcgatcaaatcataagggacctaattagcccgtggtacgaatgtttgtttgaccgacctttaggcatatactatttttttttcaaatttagattaaattcaatctagcatcaaattttacaatcaaaatatttcatttgacccctttgccatcaccgctgtctataggagcttgacaaaaagtttttgcttagggacacctataaaacgcaacaatgaaaaactataggaataggaaacatgcatgaatatgataggaacatacgtgtacttacgtgtaacacagatgattaagacataaggaaaatgtaagatgggttgttaacacatgaaacttacaaaacaaacctaaattataattcatttggttaatgtatcattaacttgtgtcaatttgttgttttattacttgagaaaaggaatgaaaaaaaatagatgtttgtaaatgtttcaattcatattgatctatggcaaaggaaagatattccctatttttcctatgctccatccatcaaaaaaatgaatagtgcaaccctagaagaatttaattaatctacttttcctacagaattcgtataaaccaaagagtcatactttattagcctatgaaccacaacaaaatttaaattttagaactcagtttcaagttgattttagagttatttcatcgtagactcgtagtatattttttaatatgaacttctaaatcattaatactattttacttagaaatgatttttgttatttcttttattattttcatggcggtagcttgtacaaacataggcctaaattaaagaagtgcaggggactttctacgtataaaaagcaacagactaattcttagttcagactacagggttgtttaaattgtagccaaaataaacgttactaaaatttggcaatggcagtatttcttatatatttatcaaagtttatcaagaaattaaatatatacgaatatttagcaactttaaaaaaatagtatgatttgaaatggcattaatatgaatggcccctacaataaaatcctagtactaactggtttcgttcaatttattttacatcttatcagccgtaggttaaataaaacagagaggactaaaaagaagtagagtggactttctgcgtaagaagagcagcaaattaattcttcagagttcagacaaattaaaaccccactggccactggcgcaagaaaaccgagcaagctcagctcagctgtcacggtgtcacctgtcagcgcccacaactgctcgctccgtcctccaaagcccgcgagatccaaagccgaacgccactagctagctgagagagaagcgccggccggcgagggggctagtgcgcgggaatggcggcgggcg

SEQ ID NO: 12552 - DNA, 1501 bp, Oryza sativa
tgtagccgccgcctccgcccgccgccattcccgcgcactagccccctcgccggccggcgcttctctctcagctagctagtggcgttcggctttggatctcgcgggctttggaggacggagcgagcagttgtgggcgctgacaggtgacaccgtgacagctgagctgagcttgctcggttttcttgcgccagtggccagtggggttttaatttgtctgaactctgaagaattaatttgctgctcttcttacgcagaaagtccactctacttctttttagtcctctctgttttatttaacctacggctgataagatgtaaaataaattgaacgaaaccagttagtactaggattttattgtaggggccattcatattaatgccatttcaaatcatactatttttttaaagttgctaaatattcgtatatatttaatttcttgataaactttgataaatatataagaaatactgccattgccaaattttagtaacgtttattttggctacaatttaaacaaccctgtagtctgaactaagaattagtctgttgctttttatacgtagaaagtcccctgcacttctttaatttaggcctatgtttgtacaagctaccgccatgaaaataataaaagaaataacaaaaatcatttctaagtaaaatagtattaatgatttagaagttcatattaaaaaatatactacgagtctacgatgaaataactctaaaatcaacttgaaactgagttctaaaatttaaattttgttgtggttcataggctaataaagtatgactctttggtttatacgaattctgtaggaaaagtagattaattaaattcttctagggttgcactattcatttttttgatggatggagcataggaaaaatagggaatatctttcctttgccatagatcaatatgaattgaaacatttacaaacatctattttttttcattccttttctcaagtaataaaacaacaaattgacacaagttaatgatacattaaccaaatgaattataatttaggtttgttttgtaagtttcatgtgttaacaacccatcttacattttccttatgtcttaatcatctgtgttacacgtaagtacacgtatgttcctatcatattcatgcatgtttcctattcctatagtttttcattgttgcgttttataggtgtccctaagcaaaaactttttgtcaagctcctatagacagcggtgatggcaaaggggtcaaatgaaatattttgattgtaaaatttgatgctagattgaatttaatctaaatttgaaaaaaaaatagtatatgcctaaaggtcggtcaaacaaacattcgtaccacgggctaattaggtcccttatgatttgatcgcacctagttagacagtctaatcgggctaattaggtcccttagagcaagtttaatagtacagcccactactagcttcaaatcatctatagccaatgtaatagtcaattcatacaatagttgctta

SEQ ID NO: 12553 - DNA, 1501 bp, Oryza sativa
tggtctgtttgtggggctaaagacattgtgagaatagcacattaaaactatacgttgtggcaagctgttttttttatatactttgggtgtgtttagttcacatcaaaattagaagtttggttgaaatttgaacgatgtgacggaaaagttaaaagtttgtgtatagaaaagttttgatgtgatgaaaaagttaaaagtttgaataaaaagtttggaactaaactcggccttcctcttccttttcctctctaatcaccgtgggtgattatgtacagttcttcctctgcttaatataaaatcagctcaggctgacttaggttttaaaaaaaaaagtaagcgccgagtcagtgcaaacgagggagttaaattgatatggttttgtctgtcaaggtgccgtttctatggttggaggaggaaaatgaaattaggggaatagaacagtcgcaatccaaaagctattgttctctcttctacggtagttgatagttcgatacgtgtgtttgatgtgagagactgagaggagtgcacggtgcacctgccccgtaaggacgcggaactacattatcagaggctaggccggtactgttatacgcgacgttcacgaatcacgatgcgtaaaaaagtgaagcatgaaacagtactaggctctccacgggccacatcatgaaaaaactggtgcgacgccacgcttaacaatttgtcggtcgtaaactcgtaaagttaaaagccccacgacattgtcaaccaatatctcagcacatgaacttctctaacgagtacaacgaaaccgcatccgcaaaagcgccgtgaaccaaagctcttgccgtgctgtgccgtgccggtggccgtgaacatgtggaacacgaagaactcttgcgcgagatcggagcacctgacctcccacctcgcgtccggcccgtcgccgtcgcagcaagcgggctgtcaaaaacgacgccacagcgcgagcgctctcgccgatccggcggacccaccctcctcacctcgcgcaccaaccggccgttcgctagtccgatcccccacccctcatcccccctacgccttgcaggttacgcgcctcgccgcggccaacgcaaaccaaaccaaatcccccgtcaccttcgcttcgaaaccccgcaaaaccccatggaagaaaacaccgaacacctgccgcgcgcacgcctcctcctcccccgcctctcctcctctctcccgttccatgtccgctcaaccttgcttccattctttccatccacccgccgatcgacgcgatgccgacgccccaaccccacccaccgcctgccagcgccaccccacctcgcgcctctgcggctatggctatatcaccatgcctccaacctccggtacgcttagcctctctctctctccccctcccattctgcgcattgctctctgcgcgcggtcgcgtgctgctgctcgcggcgccccggagcgtctcctttgggggagaggagaggagaggagaggagaggggggtgagcca

SEQ ID NO: 12554 - DNA, 1501 bp, Oryza sativa
agtcaatgcatgttaattgtgtcattgttagctcggatatatatatcgttgacgaatgattatatttagctgcttcaatttgcagcccaatttaaactctagcactgtccttttaagttggtttcttgagaaaagcttgtacgagtacatactccactgaccgaccgctgatcttattgatctatatgatggtacgtacagagcggatccgatcaatgttactaaaactaagcttgtgcgctttgtcgagtagatttgtactagaaatagaaaatcaaagtgaaatcactatattaattattcccttccgatggtgtttcacaggtatgcatgcatatgcatcgaaatgaactcgtctatattgtccatctatctgacaacatacagtgcagaacgattaattagtcgagttctacagttctacactacacatggtctgatcatggacaagaacacatgccgtacaaagcgaaaaacagaaacaaatcaagacgaagaaacagaagtggtaaacaaaattaaccgcaagatcgaacactgaaacatgcagcactgggcgatcgacgaccatacaaaaaaaaacctccttaatttgtgttgatgcagacgaggcgacgactacctacgactgagagagatcaatggtgctggggatccggccctccggggctaagccgcttggactcgtgcgccgccgcgccgccgacgacgacgaccgcgccgccgccgctcctccgccctgcagcctcgccggccgccgcggcgggcaccttcatcatgccggccacgcctgcgcggccggcgacaacggccgcctcctccggcgcccgttctctcaaagccctggccgaggccgagcgcgccacggcagaaagcatcaagatggcgcagaaagcgaacacggccaggtacgtacgtgccgccatgtcgcctgctgagatggcctctttttgggaggaaattaaagctgatggattctagctagctggggctcgagacttgggtttgggacaaagctagttctacgtacaggtcgatcgttaggttgaaggtgatgatgggtttgtgtggagctacacatctaggcctgcatcgtcttatatagcctatagaaccttgtggcgtccacgtaagatagatatgatgcgtgtgtagctataagctagtaacggacatgatctctacagtcgagggcaagctgactaagaaaccatgcaaattaagacaaaagtatgttaactttgccacctcttctaaatgctcagccactaattagagagagagagagagagagaggctacaacgaattgtcttctcggtttattaggggcggcggccaaagtgtattccgactatgataatagctatacgcagggtatgcacgcataaagctaaatatatccgtgtgtttttaggtaagcacgtatttatgcatggatcaaaaaatactccctccatcctaaattgatcatcatatatacttatacaccaagaccaatga

SEQ ID NO: 12555 - DNA, 1501 bp, Oryza sativa
gagcagcgatggaagcaccaacccttcacaagagctcggacgttgtgttatagggccagccaacgaaggcggagtccgtttctgcctctctagtcctcacgccgtcgacaacccagccaacaagagcacgattttttctgcctcctcgccgccgccagccaaccatctcgttgtgtgtccccaagtcctactgttgcgcctacttgatgttctccgctgtgacggtggcgtcgcacgtgtcatcatcgtcgtcgtgctcaggcatcctacgccttctccactgcaaaggccactgtgccgcttgccacttggttgacctgctccagctcctgctccacacatccctattgtttccccttgcttaccgtcttcaccattatcctctcctgtgcctagtcctcctgcccctatcatgcgcgccctctgtgctaccaaccagcccgccttctcccaccgcccttttctgcccttgctgccatcgggaaggatactcccctcctaataccatcagtaacttaggacgaggctgctagcttggatagagagggctgcttgttcgtcggcgctggaggagagaaggtggcggcgagcaaaaacaaggtgaggagctggcagtgtatcggtatgggaaagagggggagaagaaagagagaggtcactgatatgtgggcaccacatactgactcaggtagtttgatcaaataaaaagccatgcctgcgaaaattgctcccaaattgaccgaggaagcaaattacaccagttttaatatttaagggtcaagatatacaatataacgttgaggaaaacgaattagattggagctatatttgagggagtcaaagtgcacttatttctaacgggaagatgaggacagtgcgttaaaaccgaggcagatggttatggtccggatctagtgtgggccagaacggggccgttcagcgtagggggtttaacatggatgtttcgccttctcggtccagcggctcagtttagaagaacgcgctccgacgggaaaacgaggtaccccactggggccgtttcgtcttgtactcttgttctcgctccctcctcccgcggctagtccggcaaatcggccgatgtttgcaggcctgcagccgcctaacgttgccggaagagggcatcgcgatgaatcatcctccccacctgacccagcctcctctcctcgctaccttctctccctccgctggaagcgcgagatatcaaagtcggacttatcctttggccactatctaggtcctacgatttgggatctgatgcacgccaagcgatcggagctcagcgaacaccgtccaaggcactcgcgaggaggccccggaagcagcagatgatgaacatgaactctccacttctccaggctccaggtacaaaccaacccttttgtggctttctgcttgtacgcattgcctgatgaattctgtcaacacactccacgcagtacatgtctgaaacggcattcatcagactagaagacaatggaga

SEQ ID NO: 12556 - DNA, 1501 bp, Oryza sativa
aaaaccagtgtagatgaggtccctcggcagttttaacgacggttttacctgacgtggcgtctatgtggtaaatttgacttggtctttatctgatgtggcattaacgtggtgcttacatggcaatttgatctggaaaagcaataaactccgtaggacccacatgtcagtttcacacataaattaataaaaaattgtggggcccacgtgggccccacatgtcattctcatcatctcgctttcttcaactctcttcccctcttcttcctcctctcttccctctcctgtccccgaggcggcacgcggcgcccgggcgaggaggggtagctcacggcggccgggcgaggagggaggcggcgcgcgacagctgggctaggaggaaggcggcgcgcggcggctgggcaaggagggaggcggcgcacggcgaccaggtgaggagggagggctccgacccggatgtgaccatcaaggacgtcagcgatagcaaccggacgaggagggaggcggtgtgcggtggccgggcaaggaaggaggtggcgcggcgcggccgagcaagaaggggcagcgttgttctgctgggcatcgcgggcatagcggccgacggagtggagctactgcgctcatcggcgatctcctcctctgcctcttcctcctctggtcacctccgcgcgtccgcggcttgccaccgctctgttagcaacctcctcctctgaccacctccgcctggcgtctgctgccaggatgcatctgctgttgctccacccgcccctccgttccgcccgcggcttgctgttgccggcgcccgctcctcttcctcaccgtcgctccgccgcgaggatgatggagagccaagagggacttgtggggcccacatgggccccgccatctttattttatttgtagctgacatgtgggccccaccatttttatattaatttatgtgtgaggctggcatgtgggtcccacaaagtttattattttctggatcgaattgccacgttagcaccacgtcgatgccacatcagataaagaccaagtcaaatttgccacgtaggcaccacgtcagccaaaactgccgtcaaaaccgcagaggggcctcatctacactggttttttcagttgagggacccgttgtatctggtttttcggttgaagttaagggaactcagatgaacttattccgtccaaattctaggcctaatgcggtacgttaatatcttggcctgattacgtggctggccagaatggaggcccatgttgaagttaagggaactcagatgaacttattccgtccaaattctaggcctaatgcggtacgttaatatcttggcctgattacgtggctggccagaatggaggcccatcaaacaaggacaaatcaggctacgggcatgggccgaaatgctgatttcttggtagtatttttttttcttttttttgttgttgaaacctagtaatgttttcttcgatctacttctgttccaactagtcaaagataactttt

SEQ ID NO: 12557 - DNA, 1501 bp, Oryza sativa
agttattggctaggagactaggaatgtttgtcatatattggtcatatgttcatgagtttcactctatctattttattcatatctttgagttttgtctcgttggtatctatctattatatactaaaagaccattaaacttcctacaaacactctcaaaccgccacgtggcatcctaaaaatactcccgagtcgccgcgtggcattctaataaaatagagaaatctgaccatcgattttcacttaaatagatgggctcattattttggatcattagattatctttaacggaaaaaaaaactcctgccgtccctacctccgtgcaggatgcgtattgtacgctccctatcttcccttcttttttttttatctttgtttctttcttctttttctatccttatgaaaaaaatccctacaaatagacatcgtacgagtaagtccattaaactttttaaaaacactcttaagccaccatgtggctcctacaaacgcttctgagccgccacgtgacgctctgataaattagagaaatctaagaaattccagaaaaaaaaagaaaacatcgtaccatttattttctctttacacaccattagatctatatatgtaaaaaaacaaatgtcacgtacgtccacacctctccctaggtccctcatctcctaacatgtacctacatccaaagtacgtatgtctccccgcccctctcttcttcattccatttatggtagcaaaattttatatataaaaaacacaacaactaaataattagaatatcttataatatattcgattttaatttgaactatgtttaccatattttggtatgtacatatataagaaacatatcatttgacataaacccctttatcgcaactaaatagtaacatatatcatgccatcgtaaatgatctcctattatctctcctgctcactttcttatccatattttctagtgagcagttcagtacataaagaaccaaaaaatgctatattaactatctattatatactaaaaaatcattaaactccctacagatcctcttaaactgtcacatggttttctaaaaccactcataagacaccatatagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctaggatccaattctcatatcctatttttaatataacttatcctattttctacctaacacataatatatagaaaaataataatagctaaatgatcatgactctcaagttacatgtacttttcacagtttatttgactttttgtattatttataattaaattcaagatccatattgcccatatttactatatagaagttagataatgctgctattctgactacaaatat

SEQ ID NO: 12558 - DNA, 1501 bp, Oryza sativa
ctaattaacatgcatgttttcatggttatttttttttcacataatgaaaaactaaaattatctagaaatgggggcaaacgtgttgcctggagttgaataatcttagcactttggccggtacagttggacttgaataaaattgtcttgccccaagtgaaatcagggagttgaccgatcgaatgatcgatgcaaatgcaaaaatgcttaaggaaaatacatctttgtagcacaggggattttgccatgcaaaatttgaatcttagatttttctttcatgcaaaagttttatgaataataatagaaagagctcctattttatgccattcaatgttatctttgactagcgaaagggcctgtaacctatagtggttacaagagtctcagtagcatctgaggtcctgagttcgactccccatgagagcgaattttccaggatttaacggcgttgtgctttcagtggtagacgacgtacccatcgacagcgatgcgcctgtggtgactttgtcaatctccaggattggggtaggatagcatcataggggtaggatttgcgtgtgtgcgttcatagaggtgagtgcacgtacgttgtaagtgtctgcgttttactgtgtaattaaaaaaaagttatctttgactagttggaacagaagtagatcgaagaaaacattactaggtttcaacaacaaaaaaaagaaaaaaaaatactaccaagaaatcagcatttcggcccatgcccgtagcctgatttgtccttgtttgatgggcctccattctggccagccacgtaatcaggccaagatattaacgtaccgcattaggcctagaatttggacggaataagttcatctgagttcccttaacttcaacatgggcctccattctggccagccacgtaatcaggccaagatattaacgtaccgcattaggcctagaatttggacggaataagttcatctgagttcccttaacttcaaccgaaaaaccagatacaacgggtccctcaactgaaaaaaccagtgtagatgaggcccctctgcggttttgacggcagttttggctgacgtggtgcctacgtggcaaatttgacttggtctttatctgatgtggcatcgacgtggtgctaacgtggcaattcgatccagaaaataataaactttgtgggacccacatgccagcctcacacataaattaatataaaaatggtggggcccacatgtcagctacaaataaaataaagatggcggggcccatgtgggccccacaagtccctcttggctctccatcatcctcgcggcggagcgacggtgaggaagaggagcgggcgccggcaacagcaagccgcgggcggaacggaggggcgggtggagcaacagcagatgcatcctggcagcagacgccaggcggaggtggtcagaggaggaggttgctaacagagcggtggcaagccgcggacgcgcggaggtgaccagaggaggaagaggcagaggaggagatcgccgat

SEQ ID NO: 12559 - DNA, 1501 bp, Oryza sativa
aatattctaaaagtaatcaggagaaatagtttcctatcggaagagggtgacaaaatccaaaacctcgatggtttaaatcatgttggctagtgggaatcaaccatacagtttaggaatacatgaaaatgccaaacaatttgaatttgtaagttgttatccaataagtgaagaatatgttttctcttttttaaaataaactataattattgttataacattagtttttcttgttgcatagacggatattttttctagtataaatcaagttcttgtcattaataaactcccaaaaaaaaaaaggagaaaaaccaattcttgtccgagtcggatcatcgatcgaccaatctaagcatgcaacactagcaccgatatataaatgctggtgatttcggccaagttcgcattggttgatcgatccatcggtcctcacgtaggtaatttcacggaacaatctcctcgcgatcgtttacggcttgattgtccatcatgattgtatgattgtgaacggacatccaatatacttataatttggttaaaaaatatatgtgaagtcatgctgatcacataagatgcacacctagtaaccgactcaagcatctctaagagtggtcgaggtacgactacacacctagtcctcgatcagcgtgatagtgatcccaccacttctacaaatggtcgagatatgattacatacctggttctttaccagcgtgattacgatcctccgactatctctacaagtggtcgagctacgacatacacacctaatcctcaatcagcgtggtagcgatcatcaccgcttctactagtggtcgtggtagcgatatctcccccccccagcaccgctaagatggagtgagagcgggagaggggatcggaggtggtggtcgtacgatctctcttgtctcaactagttgtgctgggcctgcacgggattatattaagctccatgtggcccacttatgttgtgccagaatgtgttggttcggcccaagctgctcagggctttagccatcatacagttacgctacgctgtagttacaattattatatagtgtagttgcattataattaatactataatacttcctccatcccattataagcgcggccatgaatttatgagtccaattttaattatccgtcttatttgaaatttttttcatgattagtatttttgttgttattagatgataaaacatgactactttatgcgtgacttattattttggttattttcaaaaagttttcaaataagacagacgatcaaaattggacacgtaaattcattactacgcttataatgtgacagagggagtactatatataaatttacatttgaaaatattttacttaaataagtttgtacaaattttgttttttttagcaaaactgaaaaagaaaaactcgaatttggaaaagaaaaggaaaacgaaaaggaaaagaaaacagttctggtccgaatctgatcatcgatcaagctaagaagtatagatggcca

SEQ ID NO: 12560 - DNA, 1501 bp, Oryza sativa
ttttatttgtgataaaagattttagtgtgtttgtttagctatgtgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttagagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatctgagtgcttcaaactttttatgccaaggcctgccgagtggcgaagacgaagactgtaaagggcgaaaagataaagaatatggtgcatcgaatagatgcacctaattaggtgtagcccccaactatgtgattagttaacaaactaaacatatagttgagaataaaataatagcacattcatgcatcatacgacaaaagcatacgcggcgcctaaagaggcattcttgccgactgctttttagccataataaaaggaatccgagtggttaacactcaaaaaggttcacgaatgaacacacttgacaggcatccgaataaaaactctaaagattacccaccaagtattatataaattatggtaacgaataagtctaatagcctaggctatgactattcaccataatgaaaacaggcatataacataccaaggaaaggactatggtaaaaacaagtcattccaagttaacccagacagcttttgtagcctaaaaaagcttacaaaaacagcataacgcctttctgtcgggcaccttttaatttgcatcgcaataattccaaagaattatatgaccgcgtaaaaggattctatcagcatcgggcaacactattgtgcgcataaattgccaaagcaaaaatgcctaagtccctaaggaacacaatgggccacgctgtcaaatgtattgggctgaggtactgttcaggcctaagcccatttgcacctccaatacccttaacaaaaaatcccgtgatccaagcgtcacttcgtcttccccgccggaactctcgccattttgcccactccctgctacagtacagagctgcgccggcaaactagggttcaccaatccactcgaatccaccttcgaaaagttcatcaaaatccttcccgtgctccaccgcctcaatccctcacctctccctagccatccctcgaatcaaatcagcgcattcgagtaaaatcga

SEQ ID NO: 12561 - DNA, 1501 bp, Oryza sativa
cacgaaaatgataccagtatattaagatagttactttgatgtggttataaatttaacagctttaatacaccaatgttgacaaagtaactgccgaaaaacctacacattaaaacccgtatcagtatatatcttgattgacaaataaaaaaggaaatgaagaggagtaagacagtactatcattgttagtgtcctaattaggacgatgacgaaattggatggagcacattgatggcgacgcaacaccagcaagctagctagcactgctgattgcttcatccatcaccatcactcgtgccagctgatcatatcattgagttcacacgtgtagctagcttaattagcttgctcacatgttttaaatttcttttcttatgtaataatataagatggtttaaactctccgttcaacgatcaaagattcaaattctttcaatgatcaataaaagtcgtaggcagcgatggagctagaaataattccaatcctgaagaaattcaactatatcaacaacgaaaatttgaagggagtatttgacggtgtgcctgggaggttgtctaggatagccgggcttaaataaaatctacaagaagttatacaaatatgaaaatatctcgtattttaagtcttcctttagtaaggacatcgctcgtgtaaaaatcctataaaatttatgtgttctgaatcggtagatggtaaaatcagccagtcagtcaagtgttagaaaattcttgggccttttcttgccatcagcaataatcccggggcctgttattaatgataaaaaagtctactgactccctccaatatagatcgaattttgagagagtcaaattggactttttacttaatgatgaccctgagctctagttgcacaacaatacacagaacggcccaacaaagctcaattcagcccattacacagtgttaagctgctggtttgggcctattcggccttatttaggaataagttcactttgtgacccttaaaagtgatcgaaatctaattcgtgaccctaaaccacaaaaccggatatctcgacctctaaactcttaaaaccggtgcaatttgactccctcggctgttttggaggacggtttcgctgacgtggcgcctacgtggcgatgttgactcagtcttcggtccacatggagctgacgtggcgcttatgcatactagaattgaaaatatatatgcagaacccacttgtcattcataccaaaataataaatgtatagccattgacatgtggggcccatatgtcagtcatctttccttcttcctcttcctcctcccttcctgtcccttctctctctcctatttctcttcttcttcgtctgcaggaggtggtgggtgctcgagggtccgagtggccgcggcggcgagcgggagcggaggcggtgacccgacggcggcaggaggagacgccgctcaccgggtgatgtgccatcccggagtacaacgccattgagctcctcgcccaccacgacacgctccacctgcg

SEQ ID NO: 12562 - DNA, 1501 bp, Oryza sativa
gctgcgctgccggcggcggcagcaacgcgggctagcggcagcggcgcggctggcggcggcgcataggagtaggcggcgcacggcttaggcggcgttacacgacggcggtggcggtgcacggcacagacggcgtcgcacgacggcggtggtggcgcacggcacaggcagggccgatgggtacccatcgggtatgcagtgcccgacgggcatgggcacgggcataggattttgcctgatagccctttcgggcatgggtcgggcatgggcacatgggtctcgggtcaggcatggaatcgctctacccgtgcccgacccgacccgttgccatccctacgtgtgccctcattagtgtggtgtgtttgagaaaaaaaaggggaatgctaggtgacgggataccgtcccccaacgggatagctcctctccacaacgcgattcttatccatatactcactggccgccgtcgctgtcccccgccgttgtcgcgcctgtccaccgttgcctccgccgccgccgccgcgcccatccccaaccgccgcagcgcccgtcccccgctactgccgccgtcgccgcgcccgtcctctgccaccgccatcgccgtcctcgtctacaagggacggctgcagggggcgaccgcgcgtgtcgaggtgctcctcccccaacgggatgcccagccatatctagtaggaatcacctgatacctggtaggtatcatccgatacctcgcaagtatcacgtgatacatggtagaaatcgtctgatacctcgcgagtatcacatgatacgtggtagaaatcgtctgatacatgataggtatcgcatgatacctcgtgagtatcacgcgatacgtggttgaaatcatctgatacctgacaggtttcacatgatacctcgcgagtatcacgcgatacgtggtagaaaatcgcatgatacctgataagtatcacatatgatacttgcaggtatcacctgaaacgtgtgtagaatcgtttgatacctgataggtatcacacctgatacctactcgagatcatcctgttgtgtagaatcgtctgatacctgataggtatcacacctgatacctactcgggatcatcttgttcgaaaacgggattccgttatatagcagcccaaaaaaatgaaaaacaagattgggaagatatgtaaaataaaatagagcacacatcttgaagtctatctgaaggacgaaaatttgagtgtaaacaaattttttttcacacgagtgatgtgtagcaaaaacaaaaaaaagtcgaaaatgctttcggacggatgtccggacactgtaaaatatcgaacgtcggctttatccaaacattctctaccacatgttcattcttctctctctttcttctcttgctgcttcaccagcattgttggctatctccaccacacgaatcattggtggccacacagtggtagcgacgggggcaagacgacacggggtagggggaggcactagagcttgctaggagccacacggcga

SEQ ID NO: 12563 - DNA, 1501 bp, Oryza sativa
caacaggtttaaggttttcgtgaagaagtgtagttaaggttaattttaggacggagatagtatatgttaatgctaaagtaatatatggtaacaaactattgcataatttaagagtaaaatgcaccagcggtccttaaacttgtcaagaggtttcacttaggtccacgaacttgcaaagcgcacatcgaggtccctaaacttggtttattgtatcatctcggtccaaagccgtgtttgaccgtggtcttgcctacgtggcacgccacgtggacgatgacatggattttttatattttttttctcccttcttacttcttttttctcttttatgaaaagacgatgacatggacgatgacgtgtgcgaggcattttcgtcttttcgacaaggaagaaagagaaaaaaagaaggaagaagggagaaaaaataaaaaagggctatcgaaaagacgaaaatgcctcgcacacgtcatcgtccatgtcatcgttttttcataaaagagaaaaaagaaggaagaagggagaaaaaaatataaaaaattcatgtcatcgtccacgtggcatgccacgtaggcaagaccacggtcaaacacggctttggaccgggatgatacaataaaccaagtttagggacctcgatgtgcgctttgcaaattcgtggacataagtaaaacctcctgacaagtttaaggaccgctggtgcattttactccataatttaacctatgtttaataagagcagatacaattaataatgggcagtagtagttccacgtaggattttgtgatgatctggaggagagaggggaagagagagagagagatagagacaacgactaatttgttgtcgggctgcatgcgccgcttgaggagtttgtggggcctacctagatggagaagcatcggccatgccttgcgttggcctgcctccgttgccaactcccgcggccaccagaccgctgcccttagactcacaggtgccgacgcacagccgccgctgtctcccacatccgctgcacggcccccgtcatccctcgcctgcacggttgccgccgtcttccgcctctgcagcgcggcccggccaccgctatcttcgacgcccgccgcacggccaccgccgtcttccacctccactgccatctcctgcgtctgccactgccgtcttccgttgtcggtgacagcgaatcgaagctagctcaagaaagaagaagacatgaagacatgaactaaggggataggagggagaaagagaatgtgaggtaggagaagatggtgggtcccacaaaacaataaaatattcgtgttatagtatttctattgtagacattagctacactgcttactatagatgtcatggctatttttttgaagccaacagcgggctatgttattgaccttgctctaagcatgtcaaaattggccggtagaagggacactaaacaatgtacatagactgtgtttagttcgtgtgccaatttttttttaaagtatacaaacacacatt

SEQ ID NO: 12564 - DNA, 1501 bp, Oryza sativa
gtcaagatcatctcccataggagtcagcagaggtatggggaacaagtctctcacttcctttcgcaaagggtgcaccgtgcacaacagcagagggtgaaacaagtttcgattcaagggaacaacacaagtgtgtcctccctccgtcccaaaataaacatagtcatgagccaattccgtgtccaactttgattatttgtttttttagaaagctaaaaaaacataagtcacgcataaaatactattcatgttttataatctaataacaatagaaatactaattataaaaaaattaaataagacgaacgattaaagttggacacggaaatttaggttgtatttattttgggacggagagagtacaaaggaagctatactgcatgtctaacttcctttcgcaccagcaaaagttgtgtgttttgcaaagttggctgtgtagcctctcagcatgcaagttgtttcttttaatttgtgtcactataagtagtccatgcccccagcccagaactatttttgtactgtacataagtagtgtattttggtaagtttgtttcatatgtagtgaactttcatcgatgggattaagcctgtcgttttattttatctaaatcgtcgtctttataaattgttgtctctgaaacgttagatttatttaattaagtatttaactaatttgcctctcagaaaatctgacatattataacatgtgaataatacagataaagttagtcgacacaaccaaaccagccagtatattcgtttgaaaatcgatcgttagcacataattaattgagttttaattattttaaaattagaaaaaatggatttatctaatattttaaagcaacttatatataaaaaatctacgtctaataaaatcagaaacgaacgaaactaagggcctgtttgcattggttggtaactaaatttgctacatctaaccttaggcaagccacaattttagtagacagtgtttggttcttgccacaagtttattttttcctaactcttagccacctggtccacacaccggtggagaaaccctttttactcccggttggtaaccctccccggttttccaaccgggagtaagaatcgggactaaagaccgctatatttattcccggttcaaatacccaccaacttctagtcccggttgatacaccaatcgggactaaagatctaaattttttttaaccagaactaaaaatgatctttagtcttggtttttattgcgaccgggactactgtggaatttggttgatcgactaaagatgatttctccagtagtgacatgtcatacactctattttcttgccaaacattatccaagtttagtttgtcattttacaaaaagtgtggcaagattaagattagctaccttagtaaaaaaaaaatgacaatattagtccccaaccaaacaggtgactctaagattcacaatgtcaaccacctgctgctagctaggtatgcagacgatgagcccatgctctccccgtgcagg

SEQ ID NO: 12565 - DNA, 1501 bp, Oryza sativa
gccgccaacaccgtagccgatgccgccgcctccacgcccgccgatgccaccaccttcgccgccctaaccgagggcaccgccgttgccggggaggagagggacagggagagggagatgggaggatggggaggaggagagggacagtgaggataggtaggatggggaggaccataaatgagtgaggcgcgcgcgtgatgggaggatggagaggaggataagaggaagatgggatgatgggcagcacttggggtgggctattttcctgtgtggttgacttaacaaccgcacgcgaaaataggcttatcttcctgtgcgggtctgttaagtgatccgcacacgaaaaatgattttcctgtgtgggcgatggcccgacgcccttccctcattttcatgtgcggttgcacttatggtccgcctggaaacaaaagggtctagtgtccaagaaaatctttcatgtagtagtgttctagcattgacatatatatgaatgtgggcaatgctagaaaatcttataatatgaaatggagagagtacatgtatcaatagagggtaattaatgtttctatatatcatgtcatatgctttgccacgtggtggcgtttgcatagtgcctgtgtcccgcattccctaccggagaactgatcttttattgtggttcccaaaaatacaaatctctcgattctattaccaatcgagactaaagatgccgtctttagtactatttaataaccctcacgacacaatacaatctttagtactggttagtaacaccaaccgatactaaagattgtttttagtcccggttgaactttgtcagtactaccatgttaagcaccctgggctcttttgttaccaactgatactatatgatctttattatcggttggtaacaccaaccagtactaaaaattatatgccttcttcctccttcggcccgtgtcattgctgccaagaggttggagaaggaaaggaggtgttgccaaaatttttcgtgaaaataatttggtgatattacacaaatcgaagggatatgaaaggttagcaattttattctgtattgatgtatgattagcatattacatttctagctatgtttttatatgtcattatctctcaaaaaagtatatggaaaaagagggagagaaaaatatttggagaaaataagacacatttgataaaaatgttttaaaaaaataaaacaaaggaaaattgtagaaaatgaagaaaaaaaatagaaaactaagtccatttttaacacattaaaatagttagaaataagaaaaaatcattaaaaatatgttttcatttttttaaaaacttgtaaaatgtttttttaaaaggataatacatggaaaagcatatttacaattttcttaaagaaatagtcagagagatttgtgacttcagttgtgagtttaattatgatgttttaaatattatatgattatttaattattttcactttcgtggatttccttaacatttgtttatttgatgtaga

SEQ ID NO: 12566 - DNA, 1501 bp, Oryza sativa
aaacactaacctaacaaactacaactagtctaatagtatttggtttggcaatatgtgacatgtaaccagacagatccataggctattttatgatcctgtgttcaacaggtttaaggttttcgtgaagaagtgtagttaaggttaattttaggacggagatagtatatgttaatgctaaagtaatatatggtaacaaactattgcataatttaagagtaaaatgcaccagcggtccttaaacttgtcaagaggtttcacttaggtccacgaacttgcaaagcgcacatcgaggtccctaaacttggtttattgtatcatctcggtccaaagccgtgtttgaccgtggtcttgcctacgtggcatgccacgtggacgatgacatggattttttatattttttttctcccttcttacttcttttttctcttttatgaaaaaacgatgacatggacgatgacgtgtgcgaggcattttcgtcttttcgacaaggaagaaagagaaaaaaagaaggaagaagggagaaaaaaatataaaaaattcatgtcatcgtccacgtggcatgccacgtaggcaagaccacggtcaaacacggctttggaccgggatgatacaataaaccaagtttagggacctcgatgtgcgctttgcaaattcgtggacataagtaaaacctcctgacaagtttaaggaccgctggtgcattttactccataatttaacctatgtttaataagagcagatacaattaataatgggcagtagtagttccacgtaggattttgtgatgatctggaggagagaggggaagagagagagagagatagagacaacgactaatttgttgtcgggctgcatgcgccgcttgaggagtttgtggggcctacctagatggagaagcatcggccatgccttgcgttggcctgcctccgttgccaactcccgcggccaccagaccgctgcccttagactcacaggtgccgacgcacagccgccgctgtctcccacatccgctgcacggcccccgtcatccctcgcctgcacggttgccgccgtcttccgcctctgcagcgcggcccggccaccgctatcttcgacgcccgccgcacggccaccgccgtcttccacctccactgccatctcctgcgtctgccactgccgtcttccgttgtcggtgacagcgaatcgaagctagctcaagaaagaagaagacatgaagacatgaactaaggggataggagggagaaagagaatgtgaggtaggagaagatggtgggtcccacaaaacaataaaatattcgtgttatagtatttctattgtagacattagctacactgcttactatagatgtcatggctatttttttgaagccaacagcgggctatgttattgaccttgctctaagcatgtcaaaattggccggtagaagggacactaaacaatgtacatagactgtgtttagttcgtgtgccaatttttttttaaagtatacaaacacacatt

SEQ ID NO: 12567 - DNA, 1501 bp, Oryza sativa
caaagatttgcgtgtaaaattgcgagacgaatcttttaagcctaattgctccatgatttgataatgtggtgctagagtaaacatttgctaatgacagattaattaggcttaataaattcgtctcgcagtttacaggcggaatctgtaatttgttttgttattagtctatgtttaatacttcaaatgtgtatccgtatattcgatgtgacacgccaaaacttttcgtctcacgatctaaacacagcctaaattcagagtatgaaacaaagtctgatggtttacgcaggaaagctgatttatgagtcagattctagaattgtggaatacgatgggagtcttacacaggggcggaacccaatggaccaagggggtgcccaggaacccggcccaaaatctaaaataccttgttaccctcgtacctagggaaaagtacacccaaggccccttaacttgtcatcgagatacaaaatcgtcccccaatcataaaaccagataccgggcgtctctcaactaacaaaaccattcgctttaggtttctcggtggttttgacccggttttatcccacgtggcggctgagtcagcgtgggacccacgtgggtcccacatgtcaggctatccatgtcagcctcctctctctctctttcccatccttccccttcctcatctctctctctcatttttctcctcttgtccgacggagcaagcgagccatcgctcggcggcgacgatgcgggagaaggggagtgcgttaccgatgcagtgggcacggcaggcccggcgggggaggagcgcggcggtggctcctggaaaacacggcctcgagctcactcccacgcgcttcaaccgcgcgtgccggtcccaggaggctgtcgtctccgatgatggcgacaacggcgacgatggagacgcgctaccaccgccgacaacgacggagccgctccgacgatctaccaccgacagcaacgacggagccgcgcccgcgcgctcctgattcctaaaggcggtgcctgcttccgcgcttcgtcgcccgtcacctgattcaagaaccgatggctgcggcgacggcagccgtgcagcagctggccgcggacggtgaaggtgacggcgtaggcgcccacgccacgggcccgcgcgtagccgtcggcggcgtaaccggcgttgagctcgttgcagcagccaacgatgtggaggccgggctcggcgatgaggtggttgagaatcgtgaggttcaagtccccgggcacggcgaagacgtcgctgacgcccacctgcacgaggcggtgtgccaagtggcggccgagtgtggtgtcgccggaggcagcggacggcaccaccgcctccttaggagatcctcctccgccggtggtctccattgtccttgttatcgatcgatcttaattactccgcatgcgggcgtatatatatgcatgatgaagagatgatgtgcgtggtggctgttgtaaatatgtggttgtcgatcgatcttaattactttgcatg

SEQ ID NO: 12568 - DNA, 1501 bp, Oryza sativa
ctaaacaaagttggatatcatatttttatttaattgtaattgatatgtaacaaacacatcaactataaattttattttcaagcaattaataaaataagaaaaaaaatcacaatatagcaatacgataacaaactcctttttcagaactacaacaacaaactcaaccttaacatgcctgctattaatacagtctaatttttaactgcaaattgaggtatcaatattcatgtggtggtacctatttacccgactcgaatcatagacttagcatgagcatttgtatttattagaatttaatcccaagaggtactacatgtatgcacacgggtgtgacaccaattaaagcacatgaccgtactcacgcgaggttacgtctctaatcttgtcaagactacatgtgtacacgttggtacatgttgtatgtatcaaagtgtaggtacgctttcaacttgtacttcaaatatcatttaatcctaaaagagaaaagagaaagttcatatcattatactttcaaatgtgtgtgtactttcaatggtgtgtttgactcttacactccaaacttcacagttaattaacttaactgaggatggcgatgacatctcatatgttcttgtcacgatcagttaaatattacttcatctgttttacattataaattaattttatgtattttaaatcaaacttgatcaaaactataaaaaaagttagcgacatctaaaatattaaattagtttcattaaaactaacattaaaaataatatattttctaataaacacgatcaaactagaataaggtttaattagaaaaaaaaaagtcaaaagtcaaagcgagtaaagtttctaaagccttaattcagagacatagacttggccaacgtccagcaatcaattaattgaccaagttgctttaattccctcctatctggacgatgaaaacgatagagtagtgtactactaattacagtgtcgatcacatcgaccaatgttaaaacgtgaagaaattgcgagcctaattaactgcagagagcgtcaccatagaagaatattgtgttcaaatatatggtaaacatctttttacagacagttcccccggtcatatgtactcttccagtgtcatgaattaaacacgtcgctttagatatatatggacgcaattgtcaaaatgcaaaattgacaattcacttccacactacaaattttcgtcagaaaatttcagattaattagaaaatgtccaaagtactttataaaagtaccttttggggcaaatatataattatcattttcaagtatccattcaattaaataacatttctgaagttactcatccaaaaaaggcatgctttcattgctggacggagtacgattttacaaacgtgactttgaaatatatattgtaagtgataggtagcattatgtcgtaccatctctcttctgaaaaggacggtgccctacaacacgtgtcgtcaaatctcaaaatctatagatgcaaatataccaaga

SEQ ID NO: 12569 - DNA, 654 bp, Oryza sativa
cactacatatgtgatttgcactacatattttccgccgaaaaagagtatatattgtagcaacttcaggatgaaggtccaatgaacttagcatattttcttcatggcgatgatgtgttccagggaacgatggatggataagtcgttcctcgatcctaggttgaccccaaatttttaaatttaatttctggttaacttatcgctgtttataacagactgcccatatttagctatgggagctactgcactgtacatcattgagttggctgggggggatagctacaaagatcaaaaacctttctgattaatgccactccatttcatattatatgttattttgacattggtcaacgtcaaaactaagtttgtagaaaaaatgtaataacattttcaacccaaaccaaatataacataaaactatattcaaatatcgatttaatgaaattaatttggtgttataaatattactatatttatctacaaacttaaataacttatagtctgaaacgggggagtacaacttactacactccagccttacaagaaaataaaaggatggccattagctagtacatcactgatgtgtcaaaattagaacatcattgttgtgatgacacaaaattaagtcaaagtgcagtgacagctgaaatctatcta

SEQ ID NO: 12570 - DNA, 1501 bp, Oryza sativa
  unsure (1)..(1501): unsure at all n locations
ccgaatgaaaatcggggcgttacagtgcgaggccatcaggcagcagcacgagcaactccggtgaggcgacccgctcgccgatgtagccaaggaggagatgcagcggcggtcgcgaggggacttcaaatttttgttaatgtgtcaattttgtgatgcttgaatgctaaggtgaatggaaattttttactataaattgttgatataaatttctgtggaattttgaataaatgcttgggtaaatttctgtgaaatttttgaatggtggagcgttgacggagacggacggagcggtcgtctgtcgttttttttaaacttggccagtattaacactggtggctagcacagtgaaacccaccagcgataatttattttcgctggcggccgtcttaaggcaaccgccaacgaaaatagatttttgctggcggctgccagcaaaaatgaattaccgctagcggttattgcggtcaataaccgctagcaaagatattgatctttactggcatttactttgtggcggctgcaatttccgccaacgaaaagctaaaatagccgccacgaaagatgatttccgtagtagtgattcctgttcagattcattgtactagaaaatatctcatccggttataggttcttatattttaggacggagggagtatatcaaattgttaatctgctgatggatttctcgtttgacgtgttaacttaatctttacttttatcttcatcagtactagtatgacccagcagaaaaactaatatataaattttcaggcgagaggcatgcatgcgtggcatatgtatactgacagttcagtaacatcagctagcttggtatattttacatagtaatatagtactccagtatattcaggcatggatgcgttatatgtacatgcgtatatacacgtgtggcattggattagagtggacacgtcacacgtagtacagtccactagtccagccacatagacacgtacgtattccctccataaaaacaaaaaaaaactcttagaagaaaaagaggtgactcctccaaatacaacgaatctggataaaacgttgtccagattcaatgtactaatctcctccttgtttagtctttttggacggcggggtacgtcgagatcgatcggacatcatcatcatcccatttgctcccctagctttcgtctctcaatgtcagtatcggcccagcagagtgctttcgccgttggtgttctttctgatctcaatgcatttcaccgctccaccggaaattctcctctgcccctacgcgtagctccaagcttggtagtgctccactcgccttgtccatggtatgagccctaggacttagacggcggaccttgaaaagccactctacagannnnnnnnnnnnnnnnnnnnnnnnnnnnnnnnnnnnnnnnnnnnnnnnnnnnnnnnnnnnnnnnnnnnnnnnnnnnnnnatccctcagataccgtcattgtttcttctccgagaaaagaagttgacgacccgtgg

SEQ ID NO: 12571 - DNA, 1389 bp, Oryza sativa
ctagcatgtgatctgttgggcccacaccttaggtggcctgtaccccaataattcagaaatttatcctctttgtcagatttaacttgccctccttaaggtgcatggcccatttccagtagaagcagtagtaaggcctggtttagctcaaaaaacatcacatcgcctgcatgtcgactctataggatccccgcattaaacatagataaaaacaaaaactaattgcacagtttgtatagaaatctcgagacgagtcttttgagcctaattagtccatgattatccataagtactacagtaacccacatgtgctaatgacgacttaattaggctcaaaagattagtctcgcggtttctaggtgagttatgaaattagttttttcattcgtgtccgaaaaccccttccgacattcagtcaaatattcgatgtgacacctaaaaattttattttcacgaactaaacaaggcctaagatgaatcagttcattattatctggaactcgtcaccatttcaccaaatgatattttctcttttctttatatttacgcctagtcgggtctgcgccggcagcaccgcaatgcaaccgaatagactaatatatttctaagacagaacaatactcactctaacccaaaatataaggaattttatgtggatatgacacatcccagtataataaatctggacacgtcacaataaaataaatatggacatgtgtccagattcatcgtactagggtgacgtgtccagattcattgtactggtatatgtcacgtccatccaaaattccttatattttaaaaccgaggaagcatgtgatatagctatacatcatacatccatacaaaatttcactgtcgcgctttatgtaatttaataatgcgagcatgagattgatgatttaattttatactagcaattgattatgcttgctttactggttttagacgcattaagctgatcagtgtgtttttttccggtaggttatgggacattaatttgtgaagttaaaagttatgtaaagtttgtgctgtttttatcctcacaaaccaaattaaggcacgaacttaactttgaaactgaaaagttaatttcagtacgggattctgaacgtactccccacatcccataatataagcatctttagcatagtgtcaggtcaaccattttaaactttaaccattaatagcaagaaaataaaaaaaatacttatattcttgttatttaaaacattttatttttatagatattgttggtcaaagtagcatcttaaagaccgtgtcaaagtcaaaaagaatacttatattctaggatggagggagtaagtaaaatagaaaagaggtaaatataccaaagattaaaaaagagagagggtaggcagttaggcacaa

SEQ ID NO: 12572 - DNA, 1501 bp, Oryza sativa
aatcaaacaattattcctatgttttgcaatcatatgttctattccttctttttttttctttcatgcaattcaaaagggcccaataaatcaggttatttggtctgcacgatcagccaaggtaatgcatgctgcacaatcgtagggaatggctgcctagtcatccttacaatccaaactaaaattaccattattccatcccatttactatgttcctctaatatttcatgtatcgcctacaacattttttatgctaactattgtggcaatgaaaattatttggcttgatcccctcataaataactctattttgccaaatattggcatgattaattaatgatgaggtcgacttaaatcaggtatatagcctctgtggtgagaacccacaatctataaaaaaaaattatggctagctagtctcgtcatatcgaaccattgatattagaaaaaaaaaacgaaaagggctcataattgtgaggaaaatgatagagggaacaatgataacaagtaagcagacttgattaaatgctacggaagggagaagccttattcttagctcgcatgattgcatatgaagagcatttgctatatgaaaagaacatcttctgatcaagactgttgcttgtccaagatgtggatggatattaatataagccaaacaattggttatgtcttcaaattatttttactccagtttgttgtaaaagaccatatgaaaaacacattaacgataaaccagtcaaaatataaaataaccatacaataccattatatgacttcggcattaccctttcccaacctctacaccttcgttttctgcgcacacgtttccttgactgctaaatgatgtaagttttgtaaagattttctatggaaaaattgctttaaaatatcatatcaatacaatttttcaagtttttttagctaatacttaattaatcatgcgttaataagctacctcgtatttttatgggggagaatgagttataaaccagcactattgacacatccttacttaaataagcccgtaacaatattgctccaaaaatctattacactaaaaccctagagcaacaaagccattattatgcacttaaaatttggagagagttagctaccctcaacaagagcattggatataatgggttactttatttaattgtaccgtttaatttattatcacattacttctctttacatatatatatatatatatatatatatatatatatatatatatatatatacacacacgtaatttcactcagtaataatttataccgtctatgaaatagccatttaggtgatgtgaggtaagggattttctcctatcacctgccctccttttaattttcacctgagcagccagcaattcccctttatccaacagaacctggcaggtagtgtaacctaaagcagaaaaacctctcctttttagtttttctttaattctttttggaaccatcaaaacctttccagtttccaccatcttcatatttttttt

SEQ ID NO: 12573 - DNA, 1501 bp, Oryza sativa
cagaaattcagtcatttactttggccagtactaagtccaaactcaagaatcgttatcttttgttgtgacatctcatacattagttagagattgatatctttgcaaaacttaggtgtattggcaggaatcttatacgttgtgtgcactatgatgcagaaaaaatagttgtaaaacatttttctattataacaactaggaagatagcccacgcttagcgcgggcatgggtcgtatgctaagattgagacgcttataagatgaaaatattaaccggtgaacatctaccacgatttctccgtaaattcttttcatcaacattaatttcttttataattttctaacctattagctttatattatatcatatttaagtaatatcaataaacaattatttataatcttcttcatcatttgaaaagaaggtagacttattttccctagaaaacatgtcaacgaagagtaagtgcaaagtaaaactaaggtatttttctttttttaattgcatatatattatcatggtttcttcgaggattaattgggtgggacatgaagctccactaaatatatgggtttatatagcctaatatgattgatgtgatttgagagccgatccatctatgaacatttaatgtagagtgggtcagaagtaccacgcaagctaatgtgaaagccaaatataattgcacaataatattttaaatgtgatgtaccatgtatacacatttgtttttcttatataagatagctctaactgttagaaataatgattccaccggtttaaagggcataggagtattccagaaatgtagtttaaaaattatggttgttttaatattcaacattactacgaagtaaacgttggttgtgatggaattttcccactcgtgttcatgtcccagaattaaaattctttcagtagtaggtgacgtacccgtcgaaagcgagacgtacgtagtgacttcgtccatctcaaaatatgtcatcctagtctatcagaagtactcatgggggtatgtgcatgtgtgtgttcacataggtgagtgcgcgcacgttgtaagcactcgcgtttgtactttgtttctaaaataatatcaaacatattttttgtttctcttttaatttaataaataaaacaatagggagggggtgacagggttgtgtagatgtgagagtgaggaggaggtggagattttatttttctaatttttctaaatgatttaagtgagagccgatgacagggtgtttcattttttctaagaatttccaaggtcatttatccgttttttataggacgtgagacatgataacttaagattttatttttaaaaaatagatctaatagataaaatattggatacgtcaatttaattgatcaaatttaatctagcacctcgtatgtccagccacgtgtcgctcggtgatttgtagtcagtgttcgttatgttctttttttttctattcgtgggaaaaaggctgttggttactccctgtgtcaaaaaatt

SEQ ID NO: 12574 - DNA, 1501 bp, Oryza sativa
acatggtggcacacaatgtgagtataatctatgattctatattataatagcatcctctaaacacacttaactacacacaaggtacatttatataccatgcactagctacataagtatatacatgtatatcatcttttttttaaaaaaatgcatgttgcacatgatgcaggagaggagaggagactttttctctctatgcatgcatgaacttttgctgaggtggcagcagtccacatgacacacaacacatgcatagagatattagagagttgatgatgcaagggtatagccagggtgttgtgatgaggaggcaaatcaaaagggagcttagcttagctagctagtgcatgcacttacatgcatgctaattcatggttggttggtttggtggtgtgcttggatacatgagagagagagacaggtgttgtgttgttggctgtgttaaggtatatatgatatgatcatgtggtggcatgtggccttgagttaggagaacatgccctcatggcctcatcctcaagcaaagctagcctccttcctctcccatgcatgcatgcactctcacacactaattaacataacattttgtatcatgtaaagagcattatccacacatcatctaatagctagccatgtttcatgcaattaattaagcttgtgatcacatatcaataattaatctctaactttccattcatgccacctaattcccccacatatacccccaaccttccaacctagctccagccttgtaccctcctaacccccttctatataaccatctctaccccctctctctaacatacttagccattttcacacatcatcatcatcttcttcttcatcttcatcatcataatcatcgccattgttactacttcgctaatataagctctactgctctagcaatggttgcacacgccaccatcaacaatggccgttgcgacgccgcgccggcggcggcggcgaagtcgaggccggcggtgatgccgccgccggcgagtaatcatggggcggcctgcaagaactccggtagcaacaaggagaggaggaggatgaggcggtgcgtggaggtgaggaggaagatggaggcgctgaggagactcgtgccgggcggcggcggcggcgaggattccggcgaggagctcctgttccgcgccgccgactacatcgcgcggctgcaggtgcaggtgaaggtgatgcagctcatggtggacgtgctggagcaaacgaaagattgattgattagccattcttgattcattatttaattattgattaggcttaattaatcatcagaggtgtaatacatatacaaagcgtattatttgcgctgtatacgtgtacggatttttttcttttgtttttttgttctctttttttttcctttgtttcgtgtttttgacacgtataaaataggggttattttatacgggacctggctatttaatttgtttgttgattgtgtcggtgtgtatgtacatacgtatagtagtatgta

SEQ ID NO: 12575 - DNA, 1501 bp, Oryza sativa
acactgcagctgaggggatcatcgatgaacaggcatgcatacggaaatgctaatgggtgggtgatcgctcccccatccgtccagtgatcacccccctgcctctcacctatactcagatacactcctccctcctctcccccttcctcctccccttcttctcttctactacagtacactacaatttttttaaaaaaacacaaaaagttagaaaaatttatgtatagaaatactatttatataaaaaatttgaatcggttatgtaaaattttggcttataaactttggatctataaactttaggtgtataaactttagatgtatagaaataatatatatagaaaatatttgaattcaaatttaaatttaaatcggatataattcaaattcaaatttgaaacgggtatataaacttttgacttataaactttaggtctataaactttaggtgtataaactttagatgtatagaaatattatatataaaaaatatttgaattcaaattcaaatcagatataattaaaatttaaattgaaacaggtatgtaaacttttgacttataaactttgggttaggtgtataaactttagatgtatagaaatattatatataaaaaaaatatttgaattcaaattaaatttgaatcggatatataaacttttaacttataaactttgggtctctaaattttagatgtgtaaactttaggtgcataaatttattaaaatagaaaagtaatgcggtgccaagaaaggaaactaggtggagggagggagggggattgattgctacccccatctccagacgatcgatcgcccattaggatcccccgcatgcatatgccttgtgtccttccttcccctacttcttgtcccctacttttcccaatctattgcagtattgcttatcccatcctatacttccatctctaaatttatgtcaccgaacactttatcttgtgatggaattggagtttcctgccatgtttattgttgatctgtgatatttgagttggatcgtaacagtcgattttgatttgcatgtccttcaaagaaaaaacacaaaacattatagcgcaagcgaacgagaaaccgtgtgtgagagaaaagataatgcatgaatacctaacaagcgcgctgcgcgcggtctaaagatagccatccccattaagacatgagcgttgcttagcaagcttggacacattgtccacagcgagcgctcagccgctcgccatgaacgcgaccacgtacgtacggcgcctttgctcccctagtccccttccatcccaacctttctctctctagctagctagctcgagctaggccctctctctcccatggcgtacgacgggggctcggggccgtccaagcctccgccgccgccgcggtacgtgatgctcacggaggagtacggctccagctcgctggccacggtcccgcctggcgccagccgcaacatgccccggcaccgcatcacggacggtggcagcctgcgcggctgcct

SEQ ID NO: 12576 - DNA, 1501 bp, Oryza sativa
tgtatttttacagtcatacccatattgttcaatccggtgtgctgatcgtagtggcaaaaaaaaaggaagtataagagttcaaaaaaaagagaaagcaaaaaaaaaaaaaaacaagaaggattacaaaaaaaaagagagaagtgctgcggtcaccacatctattgtttatttcagaagttagtctttatttgttttgtgcaaatctggtagcccaattcagattttgagcaatcagctagcgtctctccttgtacttttgcaacacgagcttttgatttcatatccattttgtgttagctctcttcttggttgcataggtcccattatcgttgcgtgtgagtgctgtacacttcatttatatctttggtgacgggaaaaccgggacggtcgtaatagtaggtccgttatccgcaaatcgttagagacaatttaatttaaatgcaacaaataaataaaaatcagaaattgcgagtccattacttccaaaattcatacatttacatagaaattctgttaattacatctccgtagagaaaacccctgattagaaattccaacatgaaagaaaataaaattacatgactgctaaaaggctaaaaagaaaaatatatcctaaagctccagatgtcgcagccgtagaatcttctgtagatttccgtttatatgtttatttcattttgggcatattttagatgcccactaatttgttggtttttaatatcactgcgtatatggtagcaaatttatacatagcttccttttttttggcattgcgactttatttttttatacgtagcgcacatatagaaattgctgaattttcttgagcactcgcggggcatagccaggcaagtatttgctttagcgccaatattatcgacgcggcatgggattttggtacggtgaatttgtgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagctcatttgcagaaacagcatttaataaatatttaagagaatagtaaaaacagttgaataattaatcaatattaaataaacaccatacaacatacccatgttgcataggcccaacctcatttgaacaaccaaccccagttgaacaaattaaacctccaaaccaggaattatccattccaaaccagg

SEQ ID NO: 12577 - DNA, 1487 bp, Oryza sativa
cctatgcaacatgggtatgttgtatggtgtttatttaatattgattaattattcaactgtttttactattctcttaaatatttattaaatgctgtttctgcaaatatgctatattatgccatcctttgttatcccgtgcacttgcatatttgctgtgtgacttgttgagtatgtcatatgctcattcttgcaatattcattcaccagaagaggagtatctcagtgaaggtgatgatctggaggattaggcttgttcttggttaagatgcctgtggagtggagtcgccatagctgttccgtagtttgttatcgttttatatttccgctgcgtagaatgttattctttgagaggaactatctacctctgtaataatttttatttgcgagtattaaatagttatttatttgtactctattatcaaattgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatattttgaaaaaaatagaactgctcttctctattctcttataaattaattaagttggcagcacatgcaaggttatgcaaaaaaaattatttaattcaatttcttttcttataaaagcaaaagttgttcttctcagaatgtttctttttctctttaccaaatcttattgattagtcggcactgtacatctattatggtatcgatttaatcatgttggcactagtactactcatcccttttaatggtgacattgtactgtgcttatagtaggtcttaggtattttggttttattttattcacttgttcaaactgatttgtctctgtttaaaagttaaattcaaaaagaaaaaaaatagctttgtatgtgtcttttctttttattttcttcctttttggcctaaatcagttaagtctagttggtacagctaacttaaaaatgtgcattaattcttctcttctatgtttctttagatgccgccccattcaccgagaaatttgttcaaggtgttaggattcgtcagggagctgaggttgatggcttttgaggtaggatatgaagttgctcccgagtatcgccaaatttcccatgaccccgacgaggagaagtgtcgtgttcgtgtgacgttggctagtgatcgtgaagaccttccgtccattaagttcgaagctggaggaagatcgtacagccatgcttgtcaagaagcagctttggtggccattggagagttgcgtcaacgctttgaagaagagttggattcatcagctttccagtatcatcctcacaagcctcatggacaagactatggaacctatacctgtcctgatggtgaagagagtgccactctgatgcatgcggtgcatatgcttagtgctatggatgcagtaagtgtggagcgagacaaagcagc

SEQ ID NO: 12578 - DNA, 1022 bp, Oryza sativa
ccgagataaaattttttgacttcaatccaaatttttgattacagcaaagcgggagacttagtggtacgctctgtactttctcggtcgacatcagagattgacttaggcaaactcattcggtgcccgcacgaggctgataaaggaagtctaacgttatctctaaactcaccgagaacggtcacgtgagctcgataacagttcctccaaagtctgcggttgagaatatgaactcgttcatttgcatcgaagtcaggggctactgtcagggttatggataccacatacctaatagtagttgactaaatctcggcaggatccaccacataccatgtcttatacggaaactgacctcgagggagttccggataaggaaagacaaccagagttctacatggaaacgacaaggactactcaaggagacaactatgggtataaatacaaacccccctaggaggagaggggggacaatcaacacccaacgggatcagcgcccaacgggagaatcaacatacacagaggatcaacacccaacacaatcaacatagaagcctacatacgccaagacatgccgccggatatcgacttcagagataagcacggctagtcccctacggtgtctccggatactgttaggagagatgaaagcgctatctctgatctcgccggacacggattcaaggaggaaggctaccctgttgtcgactacgagtcaaatcgtcagaccgccatgtcgacaacagttagataggctaccccaaatattgtactggtgtgattatcatgaataagagcaataccggcttcggccaacaggatgtagggttattacctgacaattcaggggcccgaacctgtataaaaatccctgtctccatctcttttacctcagtctcgcgtataccctagcaccgacgatccccataccatgcaaataccagaactgcgacatcaaacgtcgacagtggcgcgccaggtagggggattttggtgcttcaggatttcgacgagatgggtttaagaga

SEQ ID NO: 12579 - DNA, 1501 bp, Oryza sativa
agcgagctaattttcagtctggcgatattgttatttgctagcattttgggacataatatataatgttgtaggattttaaagaattagtttaatcatatagtatgttgaaaccaagtgagtatcaggcatggccaaaaacttctaatgtcattgatgtaaaaaatctaagtcctgaattgactagacgcatagcaatattttacaactatttatttatttggtggagactcattcatagcggtgaaaatacaaattaaattgtaggagccgctcaacttatttcttctattttagggtggtatgagagtttcgaatttcaagaagcctcatgccttttatttcttttaccgatatgaaggtgattttttttcatgtggtttatctttcttgtctctgaatcttttcttgtactagatatttcggatatactatcatataagcatattcacttggatgaggattttcatccctatagtggatatcccctcgttgtttgtatgtcatctaaatagttatcaaaaaatttaaaaacaattaacaacatagattaatacaaaaatatatcactccacaaacatgcaagaccaaattcaacttctacaagttttagcaaaaataacaaattaaactgaaaatagttatcgcacattcacaactatatttattatttttgtaacaacttgtagaagttgaatttaaacttgcatgtttgtagagtgatatatttcatattaatctatgttgccaaattttttttatattttttataactttttaggtattatacacgaaacgaggggatgaattcgggcatgtttggataggtgccgcagtttaccgcgcctcaagttcggcgtgccacaggtagttagcatatgtttgtttgcttaccacatattagcctgccacaagaaattaggtgctcatgaactactttgccacaagtttcttagcctaagttgtggctctcaaattgttcgccaaacttgtggcacgagctagcttgtggcttggcaagttggagtagtcttcaaaacaagcccgaaatcactttccccactttacaccgaggatgctatatatccggctggtcagccagcacacatgaacgggcagctgacgagctagctagccagcgacgtgcagtacttacgtccaacccatgagcgcagtaggtgccgatttaaacactgtagttagtcactatcgccttttcctataaccacttttctctaccgatttagcagaacatatatattgtggcagagccagaacgccatgggagccgtattatttaggcagcgagaccatctaccagcaccctgctatttgcctacatgtcagacttcccaaccagcactcagatgcgacactgaggaggattgaggagaaatatacagtttttttttaaaaaaaaaacagctacatcaattcgagccaatcttcaaataaaccaccaaaagaaaataaaaaatataacaaatagaagacaaattcacag

SEQ ID NO: 12580 - DNA, 1501 bp, Oryza sativa
cctcggtgtaaagtggggaaagtgatttcgggcttgttttgaagactactccaacttgccaagccacaagctagctcgtgccacaagtttggcgaacaatttgagagccacaacttaggctaagaaacttgtggcaaagtagttcatgagcacctaatttcttgtggcaggctaatatgtggtaagcaaacaaacatatgctaactacctgtggcacgccgaacttgaggcgcggtaaactgcggcacctatccaaacatgcccgaattcatcccctcgtttcgtgtataatacctaaaaagttataaaaaatataaaaaaaatttggcaacatagattaatatgaaatatatcactctacaaacatgcaagtttaaattcaacttctacaagttgttacaaaaataataaatatagttgtgaatgtgcgataactattttcagtttaatttgttatttttgctaaaacttgtagaagttgaatttggtcttgcatgtttgtggagtgatatatttttgtattaatctatgttgttaattgtttttaaattttttgataactatttagatgacatacaaacaacgaggggatatccactatagggatgaaaatcctcatccaagtgaatatgcttatatgatagtatatccgaaatatctagtacaagaaaagattcagagacaagaaagataaaccacatgaaaaaaaatcaccttcatatcggtaaaagaaataaaaggcatgaggcttcttgaaattcgaaactctcataccaccctaaaatagaagaaataagttgagcggctcctacaatttaatttgtattttcaccgctatgaatgagtctccaccaaataaataaatagttgtaaaatattgctatgcgtctagtcaattcaggacttagattttttacatcaatgacattagaagtttttggccatgcctgatactcacttggtttcaacatactatatgattaaactaattctttaaaatcctacaacattatatattatgtcccaaaatgctagcaaataacaatatcgccagactgaaaattagctcgctcctgtccattttctagcatacataagttacgaagaggtgtctaaataatacgctttatgactgagtatacatatttcaatctgttgctgagagaataacctccttccatagccaaaccccatccagccatcctaccctatgacatgagaccttatccacaattctatggacctcctaattaagccggagagagagagagagagagagaggaggctctctggaacgctaatcttagagaaaaaataaaaatcagtaattcacaagagaccaattgttattaagtatatacttgaatacttcgattattgccaccgttcacaaacagagacatatattttttttttagaaatagacatcctttttggaagcatgcatttagtcaaattaacctcgaaatataagatcaccaatatataattgtttaaagat

SEQ ID NO: 12581 - DNA, 1217 bp, Oryza sativa
gggggggcggcgatgtcggacgcgtcgtcggatctcggcggcgcgcggcccggggccgtggagcgcgacatcgagcaggtgagccgcttcccgatcctccgcttagctcggcttgggaatgccgaggaaatcccggctgtcggtgtgttcctcgtctcggggccgcgcgtggcggggaaggcgtctctggatggtagatgcatttgctttgcgtttgtgcgttttcgtgcggctgctgaattctgctaccgcagcagtagctctgcgtgtcccccgcggagaaaccaaaattttggggagtctggagcctcggctttgctgctgcctgcaagtagggttctgtggtggaagccgatttaattactgttatttggcctcttgggttggataattccagagacattgatttggctacagtgattgtgtttgctaactttttttttggggaaggccaatcgaattgggctgtttgctggttgttactactttgctctcgtgcaggttgtatgattgagttgggagtggtatgctataacggtttcccaaccttcttttgctgttggttaatgctgcgtgcggtaattgattgagttgagctatactgctatattagttatgtcctattgctttgaggggaagtgccagtgtgttaattggatcaatacacgtcttctctgcagtaatttctgacagatactttctccttgaatgaacttgtaaaattctttgcccatttttttgagtttccattttgttctctctgtgctcacatggcacaatgaataattttaatgaagttctgagttatggtttacctcaaagagaatagcctatatgtgctacccttctaggagaatcccttatttcgaaagatgataattgtttcagagattattgatgagacctttgcatttgctgtaacatgtagcatttcatctcttgtgcattagggagtttgctttagtaattcacttctccatgtaatagctggaacgctattttcatcatctccagtattaaccgattagtttatagtgctatacataatataatgttcatttccagctctgaagtagtttcaaattgtctgaaagaacatgtcgatggccaattagaatgcatgtgattgttccattgtatttaatgcctctcctttgtggcatctaaaatcagagttatttcttgacctagttttattattttactaggatagtagt

SEQ ID NO: 12582 - DNA, 1409 bp, Oryza sativa
aaaccccttggctcgatagctacaaacttcaacgccttaatttggaaggcttgggcaccacgaaaatataaaatttttgcttggctaatcatctaaaatagagtctggacctccgaccggctacaaacgagaggctggccaaacggctccatttaccccttatgtcgtcaaacccaggagatggcaattcacctacttgcagagtgtcggtacacaagaaggatttggaagacccttgcgggctaggttgcgtgcgatcaactgcaccccaatcaatggcaacaagcacggacggtgcatgaatgatggaaaaataccatgaccttaagaggcgttccctcgaaggctctccgcacccttacattgcttgtggcattagagatctagaatgaaagaaatcacagaaccttccagcaaaaggagctctcgacgatcagcccgatggccaaaatcaaagaggaggccaaaacttgggctttggtgggcgcgaaaaacctagaagttggcttattctatagttagctagggccaaaggcctttgctttttctttctcttctggcttaggcctttgtacagtttactcctcttttattcaatgaaattagcgattctctgattcgttaaaaaaatattctaaaattaatagaaccatctaaaacgctggatatacattatgggcccctaaggtatgctactagagcaaagtgaggcttacatatcggcacctaatgcgcatacagtattgtgaaggaaaggattccctacattcaaaacattactatgaaaaaaaagctcaattgcatgtttatatataacaagtttagtgcaaaattttagggctcatttggttgtaaccaacgttgtcaagcctaatcttaaccttaataagatgtggctagtaatatagaagtgtgggcattaagctacttacttagaaaatcatcgccaaacgtaggaaccaaaacctgacaagtgacaagggcatacatgacgctgctcgtttaaaaaaaaaaaacaaaactaacaatggcatagctgcaaacctgcaaaaatcacttgggcctccacactgaggcctcccatggcccaactatcccaacccagcccaaccactgcaccgatccgggcgtccggccggccgaaacggcgagaaatccgtccgtgtcgtcgaaaccttttgaactcctcctcctcctcctcggcgcgcctgtccgtgcccgtgcccggcgtgcagcgcgccgcgcagcaaaaaaaaaaaagttcccgacaccagcactggcagcaacgcagcgtgaaaagacagaaaaagcaaccgaaccgaccacaccgcgcggcccaaatcatcccaaatcaatcccaatcaaccaatcgaccaaaccaaacccccattttgaatttcaaacgccat

SEQ ID NO: 12583 - DNA, 1501 bp, Oryza sativa
ctaagtttccatttaaggttgagttcttttgaccactatcctaacttctatccctcatttttgacgcgtaaacttgtaaaaaatgttttttttaaaaaatatagaagagccattatagaaaatcgtattacaatctattttaatttttctaatcaatttttaattaattatgtgctaatccgtaatttcgttttgcgcattaggaggaaggaatccgaactaaacacatccagatatattcccaagttatactactatttcccatgcgaaggggaaaatatgtgcgatattggaaaggtggaaagcgaggccaccacgagctcatgattgaccgcgtggccccccgtcccgtcccggccaccgctgacctgaccgacccagcccgctcttcccatcacaatattccttagccgagcccggcagaaaccatcaaaccgacccggtggatcgctcgatcgcctcggccatcccaccgcccaccacctcgtcgcgtcgcaagtcggcagcacggcgagaaacaaagaaaaatgaaaataaaggagacctcacctggcgtgaccgatcgatatcaagccgcgaataaaacggaggaagccgtagtgaagcgaacaccaccaccacccacgcggaggaggagaagaaacatcacgcgagagtacgagacgaatcgaacccgcgatcaccacttcaccgccgggttctgcctcgcattctgggctcctcctcgtctcgcggcggcggcggcgtcggttggctcctccgatcctacgtcgccgatcggacgttcgtgccagtggccacccaaccttaccctggtggtgataggggatgtacacggcgccggggaggcgataagtggcagcgtggggaggaggacgtcaccggcggcggtgcggcacggcggcgtgagggctcctccgaggagcgacaaggtacgtggctctccccttgcattccttccccccactccactccctttcttgggctccggccgccggaaagtttgcgctaatgatgatattcctcgcgtttttttgtgttgtttccaatacgttttctttttttctttttgtgtgtgtctattgccgtccttgactcttgcgtgctcctcggatcgcaacaaagctgccgcctttcgcgtcccatgggagatgggcgcatgaattctttgcgtttcgaggccttttgggggtgtcttcgggagacgagttctgcgctcctttttttctttttttgtgttcttggagggagcggttgattgctacggcttcaaagctcagcagagctttctgtgttcaacaagttttgtacacctcactcctgttgctttcgcgtgccaattcggatggttttcgctctgagtttttgaaatgggctccgggggatccattccagtcgagagcagttcaaattcggtatcttgattgctccccgctcctgcagccccgcgttgtatttaattcactgtcgcttgttgcatctaaacgagtccattttgttt

SEQ ID NO: 12584 - DNA, 1501 bp, Oryza sativa
tgattaattaaatattagctatttttttaaaaaaatagattaatatgatttttaagcaactttcgtatagaaactttttgcaaaaacatatcgtttagtagtttgaaaagcgtgcgcgtgggaaacaaggtggggagttgggaaccatggggaacaaacagagcctaaaatgttttcccataaaaaatattataattttttttaaaaaaatttcggtttggaaaaaaaaatacaaatatactcataacccctcacgccccgtcctcccagagggtgttttgtgtgacgtggcagattgttcatagtgtgacgtgatagattgttgatagctcacgttaacgaccatccgtttaggcctgtcacttttgcaagcgccacccttactattctcctatagaacgatttttgctccacctagagcgccactcaaaaaaggtaggctcgtccctctgtctccctctcaggacgaatggggctatctgtatttaaatcgttccacctagagcaccactcgaaaaatggtaggctcgtccctctatctccctcttaggacgaatggagctgcctctatttgaaatattcaaatcttaaattcgttttcttaggaagtcgaacctaggacatacaagtactacttgagtactttactactaggctacaacccctttcgcttaataaaaaaaattaaaactaaaaaattctgcaagatgacaaacctacatgcatcgttgctagcctagcccactttctcttcttccctttcctcctcttatcttcccttgtcgaccagaacaatcaagtgcatagacggttcctctttctcatcgggtaggtcgagtgtaggcaagtggtctcccactagcaagctctccctccacctttctctagcgaactccctcacgcgctctctctctctctgacgaattccaaatccaagctagcaccaactcctagccttctcacccgaccacacctccaccatcaatccatctccctaagccgccgcagcattatgtgcccccgtcctgctatctttctcatctttgatggctctccgccactagagacacccctgcctcctaactgttcggttcactttgctcccaccactaacactaacccaccatctggtgccgaccccgtggctcctgcgcttatctgccgcctccccaccatccctctaagcacaagaatccttgcttatctctttccagagcagccttctctgtaacccaaccctaaaccttgaccgtagacctaacccatagcttatcacgatgcattcatagcgtgcctatgagttaggattttcgcacatatatccatgctttcattttcaaaagtaccaaaaaaaaatcccatgtcgaagttcacctaaatcttttacagattttgaagtattataaacattttcaaaatagtttatagcaaagcaacacaatcagaggacagttgccatgcagtggcttccttgcatgcgcgcgcgaccaaacaccgcatg

SEQ ID NO: 12585 - DNA, 1501 bp, Oryza sativa
gccccatggggatagaagatctcattatgcttggctcgtactagtatagtgtattccatccatctaaaaattctaatcctaaaggatgtatctggacataaatattgtccagatacatatctataattggtttgttttgacagaggagtaagatttaaaacccagcaaacaagggattaggcattttatggttgaaggtcttaatttaaattcgtcaatgcacaaatgggggagtactgactggcctagtggcgcgtatcgaccatggttaaatctgcatccacgtatgtgcgctcgaaagattctgaggatcgatgtactccctctatttcaaaatgtttgacaccgttaactttttagcatatgtttaaccgttcgtcttattaaaaaaatttgtgaaatatgtaaaactatatgtatacattatacataaaagtatatttaataatgaataaaatgatatgaaaaaaataaataattactcaaaatttttgaataaaatgaatggtcaaatacgtacttaaaaagtcaatggtgttaaacattttgaaatgcagggagtacagactccagattgctgcattacttaggcagacgataagaagtacggagtaggccggatcagcgtaaacccaaaacagggaagcacatttgcactaggcgtcaaagaaaggaggaacaaaaaagaggcagcaacaccatcatcatcaaacctaaagcaagcagctaaccctgcctcctgctgccacacccgccagagtaagtaaaaccacgcacactttagcctaaattagccgctaaggacacccacaatggttatctataagctctctacaagagatccatgtcagcatatttttctacttggaaggtattaaatgaagagagagagcaaagctatctactaacttagagatagtctatagagaaaaacgagacaatgcatgagagatttatagataccaatgtagatatactattaaggtggtttactattaatcgaatctattgctgagatgtacatgttttatagatagcaccttactttatcattgcgggtgctctaaccacgcccgccacgtacgccgcctctgggaccccgagccgaggcgcttgcggcgaaagtccggaaccatctgcttctcctcccctcgatctcccgcccgcgcgtcgccacctccgcacacgccgacgccgcgcgcgctgcacttttttacgctttctttacccccgtctccctcgcgtcgcgcctctccggaaatcaccagaagccgggcgtccgtggcgtggccccgcgcgtacgtgtcccccctaccccttgccacacgccgacacgtgccatccccatccacccacacgtgtcacccctctccccgcctatatatccctccaccaaccagcacgttttctcctcacttaatcacagtagctctcagctagctagctaaaccagtgctaattgtgttgctaatttgtgttgatttgtgattttgatacgaga

SEQ ID NO: 12586 - DNA, 1501 bp, Oryza sativa
gaggggtggctcattgaggcgatgtccgttactccggtggctcgccgtcggcgccgccagctgtcggttgttctgtctgtgctctggtagtggcctcctcgaacgcgttactgagattggctactgattcccgtagtcgttctgtccaccgtgcgagatcatcgttgagtacgggatcattggtggtttctctcagtattgcgttgatggtcccaaggtgttgggccggcgtggccgcttgattctccacttctgcattagcgtgcgcagacgtgctggtcccaccgatagcaaatacgtcatgtggtgtactcgctaacaatgagccatagtcttcgagcaagtgtaggactgatggctcgtggggatcgatgtcgatcaccccaacgaatcgactgggatgaccgtcgctcctcgttccttgttcacatctctaggaggaatttgtgactactggaccttaggaggcgacgtcttcatggctttgagaagaatcttgcagtttgagaagtcgtgattctttgtcttgtggataggacaatagatatcacgagttggagaagtacgctgaattccatgctctttgcaggcacggatctcagcttgtgcgttgagaaaaacccagcaagcttgcagggtgtatttcctagttttgtgaataggacaccaggaccttgtcgcctcaaaagttgtccttgtcggctcgtgattcttgtcggaaggacaagatttggccgcactaagatcttcctcaggcttggatgtcgtcgacattccttctccgcttcggcgggaggatcgttcgacagggggtcgtccggggttacggccacggcattctcacttctggtcattgatggaccagtcgagaccggcaccatggtgtaaatcgggaagacgatttcaccgacttgagtacacaccagcattgttgaagtcggaactccttggttgacgatggggtcgacgctattgttgacgagatttgacgacatagtagtagaatcttgagcaccaagtccccctacttggcgcgccattgtcgacgggggatacccgtagactggatatagagggtattggggtacgctagtatgaggatctacgtaatatgacattaagcaaatagaaaacaggaattatactggttctgaccccttggtaggtaatagccctaatccagttgatatgggattatatgatggaaatcacatattacaaagggaacagtggaactcgatgataccgacgagaccgtagtcgagtcgactagatcacccggcgacttggctcctgtaggctccggcttcgtaggctatggtggttgtctcggatgtgagattcgatgccttaggtcctcccggggggtcccttttatatcgcaggtcaggtagtttccaagtaggactcggagacatcggattctacatgatacagtgacgacccagtcctatccggttaggaatcttttcatctgtggactccgtgatgaatttcctta

SEQ ID NO: 12587 - DNA, 589 bp, Oryza sativa
ccacctaacctggtcctcgtggtagccacgtggggcccgtggggaggggtcgggacagcccgtttccatcgggcttagaggaggtggccaccacctattcacgggcccgacccccttggagggagcgccacgtggatactagggacaatctcttccctctaagcttggtatcactgggcccatatcaccaacataatcataaaaaaaaattcaaataagatggacaataaaaattggatacggaaactcatggctgcacttattttggaacggagggagtacaatactacaatagcatgaggacttgtcgagcaggccatggtggtcttagagcaagtttaatagtatagccaactatcaactccaaatcatctatagtcaatctaatagccaattcatatgatagttaactacaaatatatactacatcattaataattagtcccacctgtcatatacacacattgtcttggagtctgtattgcagctggctacaaatctgtagcccgcttctcttctctctcctctcttatctcctccacgtgtgcttatagctgacttatagtctactattgtacctgcttttaga

SEQ ID NO: 12588 - DNA, 1501 bp, Oryza sativa
ctcgccgtcggtccctgctactcggccacgaacgtcaccataccgtaggggaaggggaggagggtgccccgtgccgtccgccgtcctgcatccggccatccaccgaagtgtcaccatctcattcacggagtatcaaatacgacaacatgaagaagatgaacgcacatgtgatggaggagaacgccatggacgtcgtcgcgagctctgcgcaagaaagaacggcacagttgcttacagttgtaagaagcaacgagtccattgattaactgatgataaaattggcaagaaacgtaatgccaagatcattaattacgtcattctggagttcatgtgattcccagtcaattctgatttccctccaactgaaatctgcatgacgaacagagccaaaggtgagatttttacaggaaaatgctgtctttttctgaagaactaggtgttggtttgcaattactgcccatgtgaagagcagtgctactgctatatctacaggtgtgctcccagaattatgtaactgcagccaagcaacaaaagtttagcgaaaaaaatgaacagatcatttggtgtcattttcatctgcagcagtaacgagaaaaaaaaaaagaacggatgcaggatggcggacgggcatcctcctccccttcccgtccgggcgatgttcgtgaccaagtcgcagggaccgacggcgagcgcgtcaccagctaccttacgttggggccgtccaactccggcgatgttgcggtgaaggacatgtggtacggagccgcttcttcattctgcccaagctggtggcggaagccgacgcgacggacgctgatccgacgaccaccactgctctcgccgtttcagaggagaaggaggaggagagggggcccgtccgcccgtggtacaccttcgtctagttgctctctatttatccggtttgcatggccggaggtaattcgatcgcgaccgggacggtaaatccagctctcacaagaaatacgcacacgccttggcagcgcgcgcagccaacgactcgaacgtacttacgtaccccatcgtcggcccttggatcgatgccgacgatattacgccgtacacgtacgtagttgcacgtgccaactgccattctgccaaccgtggtatatatcctcgtacgctagactacagctgtatgtgacaccgtacgtggatatggtctcagttttaggtgttgtggccaccggccgcctgttatcggcgtcctcgcagactctcagttgacaatatagctaatacaatggacctgtatatcacggtcaacattaattaataggactagctatatttatggcgtcatattttttttaaaaaaatagttggtatgtatttaaattgtaagtctctaaattacatatgtaattttagtatatttacaatgtaagttctaaaattacatatgtaagtcttaaaattatatattgtcagggttacggataaggtataccctctacccttagatatacgctatacatcggtg

SEQ ID NO: 12589 - DNA, 665 bp, Oryza sativa
tcttacatgtcgcgagaggcgacacgtacgtgcctatattatcaccgattgaaattctctcacataactttcctccgatgtggtggctgatatatgaactcgagagtgatgggtctaaatgttattcacggtgaacgtataataacgtaatgtaagattaaagtgtgttttgattcttattctgtgatgaacaattgacatctgtgattattggttttgatatttggagattatcgtcgaagtggttttggagataatcaattttcaggtgatgatcggattcactattattttatgtgaccggtccgactaggtggtgtatgccggtcagaccggtggtgatcgagcggtcagaccggccagcccgcggtctgaccggccgacgctatgtcggtttcggtttcgggttgtttctttggatatccatgattgtttcatggttatgacttctagatagataatatacgtatgtaatactgttgtttgctaacaatgagtcaagttggggatagcttggtatcggaatatggtttctttgtttatttcgtgtgtaggtgactcgatgcctcggaagagtattgcggtgatggactgagagtcggcttgatggtaagacgatgtccgtggtggtcagatatcatgcgggatactaaggctagagttga

SEQ ID NO: 12590 - DNA, 224 bp, Oryza sativa
tattttaagttacctgccaccatgcatgtgcttgctgaattaagttttcctcttcattttaccaactaaacattgttgtgactatctagatatatatatgcacatatatagaattgtattaatatagctactagtactgtatatagtgcgtcgttgcaataaaactagatagttagtttaaacacacgaaaatacttttatatgacggaacatacagaaccaca

SEQ ID NO: 12591 - DNA, 1060 bp, Oryza sativa
ggcctgcaggtgggagggagaggagcggccgccgtcgcctggaaagagagagatgaagagatgggagatggggagagaggaggaagaagaggtgaggtgagttggactgacatgtggggcccatgtgggtcccatcttttttattattattttatgtgactgacatgtgggtcccacagattttattatttttctagatcggattgccacgtaagcaccacgtcagtaccacatcaaatgaagaccgagtcaaaatggacacgtaggcgctacgtcagccaaaaccacccttaaaatcgtcaaggtacctcgtttgtccggttttcgtaagttggggacgggtcgtaccggttttgcagttcagggacgaaaatcagactgggcgacaaatagagggacctaaaatgaacttattccttcaacgtttgtgtgctgacagagtgacgagcctcgattttctaaaaaagaaaaggttacaggcctcgaacaagatgctgttaccaaagttagccacgaatttggactagaaaatagctaaacatgacggcttgatcgaagattacgcaaagttttagttcgactttcgaacttataatagttcaaaataatcatctgctgtcatcatctactcaataaaaaccgaaatcctctgtcaccatcaaaacatagcaaaaatcaaatgccattaaaaagtgccaaatgacagttgacagcccaaaataaaaaagaagaaaaaaaaaggaacactattatattccagatttccagctgcaatatcaagctaccaaatggatccccaaaaaaattgcaatccattccatgaactgagcccaccatgcaccacacaacccccgctcctccacgcttctcgggctcccgtagaccgggtccacccgccaatccccccacacgtcgatatctccagcacccaccgcacccactctcctcctcactccgctcccctcctctcctcctcccttctcgcggaggccgccgcaaccaaaaaaaaaaaagtctaaccctagatccaggccccgcgtctccggcgatctcccggcca

SEQ ID NO: 12592 - DNA, 222 bp, Oryza sativa
gcgcgaaaacaacagtgccaggcgctagtatgcccgacgttagtggacgcggcgggaggaggaggagaagttggaagtcgctcggcgtcgcgcggccaagctagcggagcggctccgacaagtgatggccgagagccaggcgtggtgtaggttcacacggagcaacgtgaccattgcggtggggctccacgtcaccctcgaccacattcttgtccacgtagc

SEQ ID NO: 12593 - DNA, 548 bp, Oryza sativa
ctcaccattgtcgtttctctctgtcgggaccatgttgttgtcggccgcgtttccattattcttgttttcttcgtagccaaccgccaccatcaatggatgagtcataatgtggaacacgtccggccaccttacttaccgccgttggtcgctggagcactgtcgcccatcttctctcatcttttgtttcttgtgttggctagggaagacgacgaatagtattagtcgttttttcctatgtgtttaaggaaaaaagaatcctctcgtccgggaacgtgttttgacacgcctgcatccagtcgtgttcaccactaaagctcgtcgttgtcgtttctctttctatcgggaccacatacacgtcctaccactttcctcaccatcgtttggtcactggagcactggcgcccatcttccctcctcttttatttctcgccttgagttagggaagacaatgaacaatgtctgttgggcattattccttcttagtctagcccaaccatgctactgaaccactcacataatattaagaccatatgagaatgaatagaaca

SEQ ID NO: 12594 - DNA, 1501 bp, Oryza sativa
ttagcagcaaccagcttgtaaagcgagagaattgaagtgagggaaggaaattcgctttccttgtacggatggaccgacggaggaagaagaagggaaagcaagtcagttgtagaaatgggccgtgaaaggccaggagaaaaggcccaaccatcccgagcacctaacaattaattgggctggacggcctgcttcgggagaaagttgggcctcccctatctggcccatccagtatattggtagtatatgtacatgttgggccggcgtctcttgtttttctgtgggatccttttctgtgtgtttctgttcggaataagttcactttgactccctaaagtgacccgaatctaatccatgaccctaaaccgcaagaccggatatctggacccccaaactattgaaaccgatgcaatttgactcccttggcggttttggagagcggcttctctaacgtggcgctgacgcggtggtgttgacctagtctgtgtgctgacgtggcgcttaggtgacatttcaattaaaaacatatatgtgggacccgtttgttattcacacacacaaaattgtgggtcccactgacatgtgggttccacatgtcatcctctccctttcttcttcctcccctcctcctcccttctctctttctttctccctctccccttcggccgtccgccgggagcaagcggcggcgggcgggagctgaagcggtggcggcgggacgagagaacgcgaacacggggaacgccgccgagctgaagtggtgctgcctcgccgattgccacacggccaatcgaacagtgtgggcgcgggcgcgagttatcggagtgaccatttcgtgcgtcgatttgacatgcctttgttgctgttgatttgaccaaacgttgaaggaacaattatagatttaccacttattctaatcggtaccgtaaagacaataactgtaacttaaaaaaaaagcaaacataccattaaaattattattcgagtggcatctttataaaattaaaaaaaatcagtgacagatttacaaatgtccctattattttactggagtagttagtataatttttaatttattttttttaaaaagaaacaggacctgttggttcgttcgttggtctgtgtcttgttgtctgaagcctcaagcagaggagagagagagagagaggcagcgaccgacgaggcaccctccctgacttgaccaaatcaaccatcgtctcaattcgacaccacacggagacgaccattctcttggtctctcccccaaattccaattccaatttcatcatcttcttcgtctacctccagctcgcctcgcttcccccaccaattgcttacgtacgactactcctccacgccccaaatccaaaattccccaatccgatctctcgcctaccaccaagctcatctcgtttcgttagctacctaccaaattaataagggtagctacagacagcgtagcggacgaggaatccaaatcaaatccaatcctcaatcgaagaaa

SEQ ID NO: 12595 - DNA, 1501 bp, Oryza sativa
gatcacgcatcgtcgcggtggtatcgcgctccccaccccacttgcagttacagtttactccgcccgaccgcgagcccctcctccgcctggaaaattccaaaaatccgaaggccgcgtgctgttcgtgttctggtcagcgcatgcatgggccgcacgcctggtcgcccgcacgcatccgcgatcgatcacgcgcgcgcgtgcgtgtgtccgcgcccgcgcccttctcctccccggcacggtggtggactgacccgacccgaccaggccgagtcgctcgtcgtcaacaacggcggctttccttccctcttcttccaacaagcaagagagacccacgagattaacttctaaaccataggaaaaaaacccgtgattaatcgggaattagtttcagacgtgtcgattggtacgttactaatcgcagttatactcgcagctcatacattgagcagaaaggtagtagcaagggtttaagggttggtttggtttatggtctagataggtcttaccaaattttgttaatgccaaattttggcattactaattttgataaggtaaaattgtgtttggattgaagccaaaatagcctaagtttactattgaaatgtcctattttcttaggcatgccaaaatttggcttcaaaacaaatagacactaaacactattaaaattaccaaatattggtaagcctaatttaggcctcaaatcaaaccggccctaacttttcgatatcaaagtaaaagccgctcctcattagtttactgaaatccaatcaaaaaccgtaaaaaccgataaattttgatcaatgtcatacgaaaaccggcaattggtttttcatatctgacagattcataaaagccggtcgatttttacgaaatttcatcagttttgtgagggaaggaaaatagtacaagttgtactataaaggagaggaagaaaattcagaggccataaccaacgagccatcgtcagtcggtccatcaccctgtgtcccccgtgtggtcagcagcagtggcgaagtttgaaaccccaattaaaaaccgagaaaagaaaaaaagaagaagagaggaatactacttgtatgaaacagcgacggccattaccttacccggttcaattcaacgcagtcacatgtcgcttattaggccttaaataacctccggtttagcactcaaaaactttatccttttttttctaaactctcatctcacttcgtcagttcgtccctctcactttcttctttctatcttgccactggaattggcgagacggagtagcagcggtagctgaggcggagacgcagctagcacatgaggattcgtcctcccgcctcgtcctcgtcgtagctccccttgttcttccatgattctcgaaggcgtgccatgtctcccctgcttcttggattcctctgcttactcctcttcgcaggtagctctctgttcttggtttggtttggtttggtttgctcggttttgcgcggaatttgaccgaattttggtgaat

SEQ ID NO: 12596 - DNA, 1501 bp, Oryza sativa
ttaacttttcgcaactcttacaagtgatgataacagatttgccactggacccacatgccatacacatatgagggtccacatgtcatagatagcgagtgacaaatctgttatcatcacattttaagagtggcacatagttaaacccgtagattagtggcctccgtttttttttcagaattgcaagtaattaacatggttttttttcatttattttagtgaaggcttaaaagataaatattttttttctttgggtaccctctcggtgagatggcgaccttgtgaagtgacgaacttgtgtttgattttcgcagttgcatttgtatctaacggccggcattgtggaagtgaggatgagattgatcaacgcaacctactcctatcactcgacacaaaggattaggatgtatggtggatttagaactactggagccggcgctattgtggagcctagtgacaaagatctttcgtattccgcaacaattttacaagttttccagattcaataataaagcattccaacaaacagaatccatgctcatccagccggccaggagcaatgacaaagcctccgacaccgctaaatctaatcggctaatagcgtttctccatgagttagggcattattggttccatgggctaaacattagtccccaccttttagctctaaattagccctcaaggatctaaacagatgggctaatttttggctaaagtgaattagcccccctcaaaacattagtccctccaatgggtgctaatggggctaattttgtgtagggaccatcaaaaagcagctctctctccctcctctctcctctctttcaactctctctctctccaccttttagctttgaattagctcatggatccaaatataccactctaggctaatgtttagtctaccaattcatgactaaacattagctctcaaaattagccctgggctaatcttccaaacagagccttaatggctaatgcctaatagtggtacatgctctgatcacttagatcccattggttaacctaacaagtaaaagcaaaagccaaaatttgaacttttaaatgtgatttctaagttggagtaaaaaggcagaatctgaacatttaaacttgattttttaagttgattttaagacattttaaacataactttttagcagtagattttaagtcactatgagtaaatatataaaaggtttacatatatgggcaactgatgaggctctcgatatacagcaggtaggtaaggtttcgctgaaatggctaatcagctgagtttttaactcattaacatattcccttgcattttgtagtttgtgttacttggatgatctcggattttccccttttgtctctagccggatggccattagctgacttgaccagaaatcggccatgtcatgatcacataattaagtactaattaacccatataccaacctatggaattcccagtgcagcaaaaccggtcgttcaaggcttcaagcccagatccaacctc

SEQ ID NO: 12597 - DNA, 401 bp, Oryza sativa
ggagggagcgatcaccccccattaggagtacccattcacttatgcaagatggataatttggtcgttttctgtagtttccgcgaaggccttccatataaagtcaggcccggcaaagcctttgaaggcctgcattacttatgtaacacaatgtggactctgtttgtttgtctagtactgggcctcaattagctcttttggtgaattctctcgtcgttcttttctggacctaatcctcgttgagattctctgaatatgacatgttactagctccttccacacaaattaattccctgtgcatcacgttgttagtaggggctggtttggtgagaattttcagaatatgccatcgaatacgcaccgtttttaggatagcccactcaatttgtactactctcaaaaca

SEQ ID NO: 12598 - DNA, 1501 bp, Oryza sativa
atcgacatgcactaaatgagtgattaaaatccatcgccatgatacccccaggttgttcttgtatgtgtgccctacaggcttttaggagtacattctaaccccatgcccgctgcacagtaattgacgcggcccatctgcgtggccgtcgacgtatccagtatatgggtcaatttggatcacagattatgcagtggtcctaaatgggacgggctagaggcccacaatattttttcacgttacatccaaatttgtgtggcccgattaggatcgctgccaactattcccttcgtctcaggattttgagtttttgttttgcactatttggccactcatattattcaaaaaattttagaattattatttatttatttttgacttactttattatccaaagtactttaagcacaaattttcgttttttatatttgtacaattttttaataagacgagtgatcaaacagtgcaagcaaaaaactcaaaatcccttatattatgggatggagggagtagtcagtttggcaggccgacaacaccggcttccctatatattttagcaactttataggtgtcttatattgatgtcgagttcgaattatatccttaaactgtaatactgatgttgagctcgcattttccaaaacaggttaaataatatcttaacatagtatgtatgtttattttagctgacgtggcaatatagtcagaaaaaatacatgggggccacatgtaatttaacttcaacctcttcccatatatgggctccacattttttttactaggaagccacgtcaaaaaaaaaaaacatccatctatattgtcttagaaccttattttcctgggttttaaaagatggaggttcaacatttatagtattacgattccaggatgtaattcaaactcgacgtctagattagaaaccttaatgaacttattcctactagaggctctaatcttttggcccaatcaacgtatgccaaagccaaaatttaaatttttgaacttaattttgaagtagtttttgagttttttcaatcatagtttcttatacaatatggtcatttaagtcgctaagaacataattgtaaaagttttaatcacaagttatattttttcgctactacgccaaatagcgtatattccgcatatagccatccgatgaggctgccgtttatagggttctaaagaaaaaggctggtttgggccgagcaccagataagtcgggccgatctcaaacagaggcggtggcatggcccagtccagaagaaatttcgcatctccaaaaatttccacccgcgaaaactccgtgcgacagtgcgccgcccaccaaattcaaattttgaacgcgaaaacttcccccgcgcgtcttcctctcatgcttaaatctgcgcaaatcacgcgctcctcgcaagcaacagtgagtttgaacagaacaacgcgacgacccttgcagcgcacgaccccgcggactcgatccagatctagggcttctcgtcggcggcga

SEQ ID NO: 12599 - DNA, 645 bp, Oryza sativa
tatattatgaaatgtcacgtactgtttgttctagttagtgaattgtcatatggtaagaatatataaaaattaggttttctggactctatcttccaatgtatttttggatcctataacaaaatattttcataaatatattttttaagaatctaaacttttttgaaataaaagagcaacaaagaaaataaaaacgctctctcgtaagtaactcgtgaagatccatcgagagccactcgtttgaatcgtcgacacaaaagaacacttcattgattgcttttcgtcaattagccgcacagcacagtactctccaatctgctaaaccaaaaccaatctcatccatccatacccttcttgacaccaagtggcaactcctgattggacgcgccctatcctacatggcacccccaagattctctcgataggctacaggggccacaccgaccctccacgtcatcgtccacgtcaccctcatcccggcccatccagccaatcccagcccagcaaaaaatcttcccaagtggccaccagataagcctctccacgtattaatacgccaagtgttcgtcgccatgacacagcacgcacacacaccccaccagcagcagcagcagtagctgagcttgaagcagcagagcgaggtagaca

SEQ ID NO: 12600 - DNA, 1501 bp, Oryza sativa
taacctttggatcaatacttgttctactatatcatattattagccgattggttttctactggattatattgctatattatattatcatcagccgactgcctttatatcattatctacattggacatatagccgatcgcttaaatcctatcgctatcggctggtatcggcatcggctattatcggctatcggctggaactactccatcggcttgtcagccgatcggctgtttgatctactgtttgcatatcttgtcagtggcaggatcaaactgactggcacgcccgcatctcatcatatttggacttgcacaggagctaagcagatctcccagggcgccgtgttcgatttttacgtcaacactaggacaccacgtcagcaaaatcacacatctatactgcacggttttatatagtgacggattaattaggtttaataaattcgtcaagtagtttatagatggattctataatttgttttgttattattattatactacgtttaatacttcaaatgtgtgtccgtataatcgatgtgacacactaaaaattttcacccctagatctaaacacagtcttaacacagtcttagttccctttaaacttctgactttttcgtcacagcaaatatttggacacatacatggagcattaaatgtggacgaaaaaaaccaattgcacactttgcatgtaaattgcaagatgaatcttttgagcctaattacactatgatttgacaatatggtgctacagtaaacatttgctaacgacgaattaattaggcttaatagattcgtctcgcggtttactgacggaatatataatttgttttgttattaatctacgtttaatattttaaatgtttatccgtactcgtcaatttttttttttccaaatcaactaaacacggccgtagtctttttttttgtgcaaacccttctatcgtagtcagattgccattattgttgcatagaaaatgttaaccgatcacagcaagtacagttagcttgaaacgtacgtactagtgatcttatacggtgaataaatattgaacgatactgtatttgctacagaatcttatcactctcactgttcaccactcctttaatgaacagtaggctacttcgccgacttataattgcgaaacagaaaaaaaaaatcccaacggatcagacgtacgcgttgaagagattgggctggtttggtttggcttgaggtttaaattaggcttaccaatatttggtaattttaatagtgttcagtgtctatttggtttgaagccaaattttgacatatctaaaaaaaataggctattttaatagtgaacttagactattttggcttcaatctaaacataattttgccttaccaaaattagttataccaaaacttaccaaaatttggtattgacgaaatttgatatggcctaattaggctataaaccaaaccaacccattatctccgtattatctcgtacgtcaacggaaggtccggcgagccatt

SEQ ID NO: 12601 - DNA, 663 bp, Oryza sativa
tcacgccccacataacgtgtgtagcgttgatgtggcatcctaatcacaagccaactcaataagattggcaatgaagtcatgtatgtattggccttgcttcgcacgcactacacaaatttgtgtaccgaaacgagagtttttcaagttttgtactattgcacccactgcataagttcgcgtaccgtcaatgtcaatgtaatgtactcttaaatataataaggtaattaacaaattaaaagagatacatcaagagaaaaattatataatattgcatgtgagctcgtaaaatagcgattaatcaaacttttatcatgtttataggtgcatttataatacattttcatatatattttataatatgggacatacaggcgatacatgttttcccgtatcctaaaccatattttctaacaaaataggtttcgaactcggataatatcggatatcccattatttctcccatattcctcccgtgagcctcgggtcgggtgggcgggcgggaaatacccgcccatttcacccctaggtgtgagtaggtggcatcgtgcataatatagcagttgagttcagggcgacaacgggatgcagcaagacagaggacgtggcaaagagcatgtacgaatagaggttgctcgggcgcttggctggcgatgctgcaggagc

SEQ ID NO: 12602 - DNA, 1501 bp, Oryza sativa
tgttaatatcatttattagtaaataaattactcggaatccaactcatttcttctctcagtaaatggattactcccaggttgtagcccttctcagttggttcattctctcagtaaatgaattactgtcgggttggtcttatttattctcttagtaaataaattacttaagataatacaacacttaattggatatcataccttctcgcagtaaataaattacttaaaataacgtattgatatcgtctcaagattttcttagtaaataaattactattacaccaatctcaacataacatattgacattgccaacaaattctcttagtaaccaagttactattacaccgatggttctcaacatatgtctctcagtaactaaattactattacatgcacgaatccaacaagcaagacaacgctagtgcctcatatcgatgttgagccgacaaagcactatagattccttaggtctccccatcgataggtatccatcacccacgaacatctagagaggcatcccacatgcacctggatatagacagaaacgattacatcatctaagagaagtctttaatttacactcataaatgactctaaatgagatatgattcgctgaagaagaaataaaatgcttcataaaaaattgagcagcaggaagagagaatatgtgcaaaatgcagcctccatctgaagaacataaatcgagtagaataaattttagaactgatgagtctatactgctttatttacaggaatacactccattagactgatcatagatttcagatgttcacatgcatgttaaattaagaaccaaaattctaattgacacattatcagttcgccaagataaatccagaaaaagtgtgcaaagtgtacgacatgaaacatttagagcgtccaagtcaaatgaaccaaggatcctatatcttcagagatcacccggatatcattgaggtcaagagaaaagttcaatttggcagtcagtaaagatctgtttctagggaacatattattatgcataaaaatgatactaatcaaatagactcgtcctaaatttttcacgataccaatgcccaaataagctaaaatgatatggaaattattcatggatgaaaactcccttggtgtccttgatccgcacctgcggaactagtgaaggacatgccatgtgcacatgagcaattagaacaacaatctcaatcctctgaatatgaaaaaaaaaagcatacttaggcaacaaaaattattgtgtgcccagtagcaaaacacctgcaccaagaacagggatttgtgccaatagactgaacaataaaggtctcaatgtacatcgttgtcagtataatcctcatctgcattgatgctgcatccggattctcactctgcccctgcgaaaaaaagacatatcttgtcttttcatgtctagttataaacactaaactaaaacctgggaaaattgcaaccataaagcatagaagattgaatcgagaagaaaaaccacca

SEQ ID NO: 12603 - DNA, 1501 bp, Oryza sativa
tctgagctaccatttatccagatttgttagttttttttggacggagggagtatgtaattcctccatttcatattactaaatcattttgactttggtcaaaatcaaactactctaaatttaattaagtttataaataaatatagtagtatttattacaccaaataagtttcattgaatctataatcgaatatattttcatgatataattgttttcggttgaaaatgttagtatttttttttacaaatttgaccaaacttgaaacatatttactttgatcaaagttaaaaatgacttgtaatctgaagtagagcgagtagtcaataaataaattttgatcataatagttagggttaattggatccatgccactgcaactttaccaaattaaaaacatgccattactattcgttgtataggctacatgccactggaaatttctaaaattgaaaccatgccactcttgtcacgttttccgtctcctctctcatgtcgtttcttttcctccagtttaatcgtttcccctcatgtttcctctcctctcctctcctcttcttctcctctcctctcttccgaccaacctcccaccaccacaccgctcctcctcctcctgctgttgctgcaaccgtgctgccctcgagaaactaagtctttgatcaccgctggtaaacaacaaaccaaataaaaaacccttcttgcggtggtttctgggcagatctgagagagaacaaaaagtgattaggcagatccttttccgatggcttcttccccttccttttcctcctcctcctccccttccgccaccagtgccgcgccggcgtcctcctactactggtgctacagctgtgaccccttcgtgcacgctgcccctcacgaagactccatcgtcgcctgcccggactacggcggcgtcatcctcgaggagatgggtgtgcccccaccacgcaccgcctgccttcgccacccgcgcgcgcaccacaccaacgacctgcgcatgtgacggacacgctacgctgccgcagcagcggcggctagcgaccgctcgccattcaaccccgtcatcgtgcctcaccgctcccccgctgccgtagctgctggcgacgacgacggcgcgggctccggcctccgcccgctcccggagaccatgtcggacttcctcatgggctatgccttcgagcgtctcctcgactagctcacccagatcgaagtcggcggcctcgcccacatgagggagaacctaccggcctgcaaggcttccatccccatgccgcggggccgtccactcacctagctcaattgttggagaggagacagaaaaagtgacgggagtggcatggttccaattttagaaattttaagtggcatgtgactgatatgacgaatagtggtggtatttttttaatttggcaaagttgcagtggcatagatccaattaaccctttaaacaacatcaaatcaaatctaaaatcaagtttgaaaaatttaaaaatgtaacttataagc

SEQ ID NO: 12604 - DNA, 1501 bp, Oryza sativa
  unsure (1)..(1501): unsure at all n locations
gtgccggcggcgtggcccgcggggctcgagctcgacgcggccacgcggttctagctcagctgaagtgaggagaacattaagaggaggagaggaaagtgaggtgaagataaggggtagagagagaagataagagggagagagaagggaaactcgaattttttgaataggttgagagggaatgggtattttttcgggggatttttaactatttgccacttttagatttggcaaataactatttgccacccctatctcaatgacacgtgggtccacatgtgtctatgacatgtgggtctagtgggaaaaagttaattgccccatctaaatgtgacaaatggttaaatatctcatttttttgtgcaggtcgattattaggcccgtctgtgaaaattgagtatttttccgtgcaggactgttaagatgcccgcctgtgaaaattgatttttgcgtacggttttcttaaggaaccgcacacaaaaatggaggatgattttcgtagacgcgaccagtcagtggcggaggcagcgtgagggctggggggtctttanaccccccccctaccctctaatgaatcattagagcccccattaagaccccctaaaatttaaatccatatatctatcgcaagggtgttaaaatagactttgtctgagattgttagaaggcccaaaaggctgaggagtccccactataattttatcctggctccgccactacgaccagttatgttccgtatgcaatctaaatggatctttgtacagaaaaatagttttcgtagtagtgcagtagctagtgtttgcatctaacttgtcggtatagttgacgctatacaatgtacatggacaaatatctgtaagactgtaactgtccctcattgttcggtaactttactagatgatgattaattagccatttgatcgctactaaaattgtgaggtgcattttgcagctctttcgtagctgcactgagctagaaatatccaaaattttaacaatggatcatgctaaatcaacacaaaacacaaaacttgtgctcctcgtttaattttcacacaaacgtactatttttttcactccgcattttcctctcagttgttcacacaggataaaatagaaagatatacactaaacacgccggtcatttttacttttaatcctcgtttccttcttaatccacacggattataaaaataaaaagaggttaacaagcacgcctttccttacttacagagttccacacacaggtaaatttccagctagcaattgaccctatcggccccacatgtcagtcagattaccacacgccactctcgattcccctgtgcgtttcggactgcatgcaagggtgggccccacatgccagcctcacgcaataaataccctcctcggcacgagcagcagcatccgcaacaaattcacaaccctaatccggaaacatcaagaactcaacccaattcgcctccaattaattccccaatggccgcggcgatcatcggcgtcg

SEQ ID NO: 12605 - DNA, 1501 bp, Oryza sativa
acaattcctacaaacttttatatatgtgttattagcggtttaaaagtcaatgcttgaaaatggactacgataaaacaactttaaaataaactctaaagttaaattttaaaatttatattttgcctatggttgataagttaatggacagacgttgagagtatgagtaatcgtttataatataattcagtaggatggtgacagactctagtaattaaactatgctaattagattttctttttttacactttagattttctttttttataacttcagccagatatttctaaccacatgcatggaaaatcttataacgaaaaattgaagatgatgcaacacgcaatctgattccatactgtttttcctgaattattagacgaaagggcgcgcataaacaattttgctcttaccagctggcgttctccaacttgctttgaccttacagtttccatattaattaaatctcaatatgtataagggcatcaccgatgtatatggcaaagtgatccatatagatgggacccacataaatagtttatccctatggcaatgtcctacaaggtatcattaggagaagagaggagtagagatagataatataatttattccatatgggtagtccatatgcatatgggtatcttttgctattttttctatatggactagttgcacaatagtaataggtagctgaatggaatattctattgcttatggactacttttacaccacattgtggattccctaacagtggtaacatggtgaattggtgatcacacgtcaatcgactgggggagcatctatctgctgcagcttctttcagaatcagaagcttctctaaacagtccagcttttggtccaaattctgagaagctgtagttgtagaatccaaaaaataaactagaagccagaagctgggaaacctagcttttccatattctcagaagctggctaccaaatgggccttatatcttcctcttcatctgccttgttcgtacgtttatatattcaactttgtggaacaattgagtgcacaaatctcctgttgttggttgtgttgctaagtcttctaattctaccaatgtgtctaatcatcgtgaaaaatatacttgttctttttatggtaaagatggacatattgttggtttttgtttcagattaactcataaacagaaaaacgagagagagattgcttttgcaaaatcaaagtggcaaaaatctgatttttcctcgagggaaccggttagaccgcagtgggtcccatggtcggaccggcgaccggtcagaccggctgcagtgcctcggtcagaccgaacaccggtcagaccggcggtgcagcggcgatcagaccggcccccggtcagaccggcagtaacacctcggtcagaccggcctcagaggaatttttctgaaaattctcaaactatttttacacgtggatatatgcctattggatcttctggtcgtgtgtctcagtactggattcctaaatttttattatcat

SEQ ID NO: 12606 - DNA, 1501 bp, Oryza sativa
ttattgcaccagtgacaagagcacatctgtgctggtttgacaaaacctagcaccgataagggttttcccaccatgaacctcgagctcgtctatgcagagaatatacccggcactgatgagaccacctcttgttgaccggattatgtcattaaatggatatacagactattacatacataagttaaatattttgataaatagagtcaacaaatatcttaaaacaagtgatcaagaagtacaatggaagatatattttttaaaagaagaacatattaaaaacatgcagcaagtcatcatgataataacgtgatgaagcgactgaaatgaagactagtttagctggtgtaaacagtgtgctgcatgtggagagaatatatggcgccttttcgagggagcttcttgctgcggtagcttctcccagaatcagaagttttctcaaacagttcagtttttatccagaatctaaaaattatagaatctaaaagatgaactttaagccaaaagatgaaaaacccagtattttcagtttgtcagaagctgactaccaacagctgtttcgtagaatcttaaacttctccaaacagacccaaacaggcccatgatctgtaactgaaaatgaacggttattaggctaaactggtgctcttggctcacttgatctgacttaattaatcgctcttcctttttctatcattgccacgtggatttggaatagacacacgggcccagacctcctgatctctgggctgataaagaaataaagaaaaaagttagaatactgctaattgcaggcccactaatcaggtcttttcgacaaattcctttgacctgatggcgttcatagtatcacatttttaatctgtatgacttattatctctgtcccaaaatattactatttctaactataataatttattctaaaatgaagttatttattcacctgctatcttctctcaactaataaacaattctctttacctatttttcttttgactatcaatcataattctcctccaattatttgtacctactttcttaatttcttaatgtctgtatatctacataaaaaatgtgtatgtttccttgcgtgtaacggtcctctcacgtgagaaacagaaaaaaaaaagagaagttcgttaagaaaaattatgtgctcctttttacatcaacaatcaattcatttctaataatatagatacatcgtaatgtacgggtatatttcttgacgaccaattcacattggctggtttttaattcccatgtctctattactccctccgttttacaatgtaagtcattcaagtattttccacattcatattgatattaatgaatctaaacatatactcccttcattccaaatcgatctacatatttcataggtataccaagaccaagaaaaactaataactctctcatactatatttattctagcaacaaactcaatgcatgcaccatccccactatttcctagccaataacaaatgaagatattgtat

SEQ ID NO: 12607 - DNA, 1501 bp, Oryza sativa
aataattggaatgggacattagtgcaattgtgcttaacctggccctctgccttgtataccaacgacagcgactgagcatatcttatccagtagggctgagtatttactgctccatccgtcctaaagaaatttttgttgaatgaaatatactctgcccgttctaaaatataagcatttttaatatagtattaagccaaatatttttaactttgactattaattagaaaaaagcttaatcatgtaaaattaaagttactaaatttatcattaaacaaatctctactattataaaattgaagatgtttttgccggtacattcgtacgtcattcgtgtatgagtcggtttttaacttcgttcacttttggaaatacatttacatatttgagttagtttttaagttcggtcgcttttggaaacacagaaggagtcatgtaagaagtctttttttaaaaaaaaacttgcatgctaacttgacatgatcggactcctaattacagcttaattatgactttctaaaaaatatatatatccaagcaaattcacacagtgaatttcaccttaattaaactgtataactgacggagcgtggggctcctcaccgggagaccgcgcaggcccccctttgccggttcggccgggggccctgggtgagattctaagctctcggtatgtagaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggaccccccccccaaaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggatgagtgcttggaggctctcatcctgacgggatggggcgaggcgtacgtcagaccgcctgtcgccacctaacccacgatctgatcggtctgtgactggtcacagaccggataaacgagtgcgctgcactgcgttacatgcggcgtgacgcgctcgtccaaaccgcaataaatatggttaggtgagccccgctatgctcacctaccccatatacgcggcgcaaaacccacaagg

SEQ ID NO: 12608 - DNA, 1501 bp, Oryza sativa
attcccctttttcatgttctagccgatatgttttcttttgacatcaggtagtttatggatgaagaggaagaaactacaagtaaagccttggtgcctctagccgataatgtgaaaacaaccttgctggatatctcaaagtggcttgaaggctccctagaaactctggtggtcagttgtggatcaatcagagatagattccttgtaatctacgaccaactcccagatgaactagccgatgttatcaccccagcggcatacctcgaacagcatcagctcaagcttgaaaaggctaaacaaagggttgctgatcgccgtgaaagaaaagatcttgaggccaccatccaggctagtaggacttctattaatgaagaaaaggcaaaacttgatgagttggaagctggtccaaggtccactcaagccaacatagatcggctgaatactcggaagatagaactcctagccgaattggagcagtgcaatgcacatattgctattgaagaacataaacttgccgatctgcccaaagctactgaggatcagagatcatagctcaaatcttctgtcaaacatctagctgatctaatcaagtccctgaaagtaattcttggatctgatgcagtcgatacccagatcattgatgaggtagaacagattaggcaacgaattatatcggctatccaaaaatatgtatgtggatgagctaaacatgtaacatgtgaatgtatttagtttgttaccaaacattgttaatgcctagagaattttgacaacaacatatttagtctatcgctctatcctatcaaaatttagtaatattgtcaacttgacaaaattttggtattgctaaaatttgaaaaatgtttattttggcagtataatactctctccatctacttttgatagttatattttcaaatttgaaaaatttatttttgataggcatatttcaatccaacaacttatcatcttaatgactttctcagatttaatgcatgactctccattcttccacacaagattggttgcatgggcatcgagaaatgtaaatattaatgaatcgcttgtttacgagaaatgactagtagcatgtttaaatggatgataagtagaattatttatccttgatctgtgtgtcaagataaaatatgactatcaaaagcagatggaggaggagtaataagaaggctaaaaaaaaattggtgtctaaacggggaagatgcattcttaatggcagcaatcccccacgtcgacacgcagcccaagcgaccgtggccctccaggccccgactcccgagcacgagtatgcggcaacgagccggacaccagcaccacccaccaccgtggagcccaaccgaacccgaaacccactctccccactacaatcccacaaaacacagagaatatcaccgaggcgaacgaaaccgaaaagaaagcgaaaccccgatcccccaaaccctagcgcgtactagccccccgggcaaatcgccggcggcgatggcga

SEQ ID NO: 12609 - DNA, 1501 bp, Oryza sativa
gatgaaaatacatataaaggatagactagatcaattactaaaaaaatatttatacataattaaatcttggaaaaattcacatgaatactatccaatgtgtacaacacactgaaattttggtcagaatttatcacttaagctaatacctcaaataaatcagtcaaacgagtctaataatagactaattataaaccttaattggctaaaatcttaactcaccaaaatatgcattaaactgcatggaagtgggaagtgtataagggaaataatttattcaaatactaggttaattatcaagagtaactataattttccagaatttatttcttctgtttagaccttctaacaattcaaacaaaattctgctgagcccatcttctccatttttctgagagcaaactgcacataatttttaagtgcaaaaaaaaatgaaatctaggtataatcacctaactccagtaaaatctacatgaatttatctgcaccacaaattaatatatgaattaacaaagatgggaagagaaataaacctggaaaatcatccaaaatctagtctacccatgtttctacccttccctttctctctagcctaggttaccacggtttggacccacttggcagcctccccagctagcccagtccctgtccatcttcattcctcaccgcttaacgcgagagagaaaaagaaaaccggcgccgaccgctctcggacgcgctcaacgcgtggccacaacgtgtcaacggcttcaaactcctcttttctcgccctctactccgggtgtcgctaatgggcgggtgatcgctatcccccataacacgctcctctcccccttcctcctccccttctcctcttcctactacaccataattttttaaaaaataaaaaaacaaagttagaaaaaattatgtgtagaaatactatataaaaaatatttaaatttaaattcaaatttgaattgggtatataaacttttgacttataaactttgggtctatagaatttagatgtatagaaaatactatatataaaaaatatttaaattcaaatttaaatttgaatcggatatataaacttttgacttataaactctgtttctctaaactttatgcgtataaaaatactattataaaaattgaagatgcttttgctaaaatttttggtaagttaccgttttcgattcctacccgtctcgttgtttgtttcaatgtcatgtgcgtgttcatcgtcgcctgcatgggagtcccgttcgaattttcggcgtcgttcactcgttcgtgtgtcggtgtgtgaccgggtcctctagggacgcggcatgcatgcacatgcaagccttcgactgcatgtcagttcaagccactcacacgttcaactgactttgcatgttcacacgttgggctgactttgcatgcatgcggctttgcacctactcaaaaggttaaaacaacgttcaaaattgaaacaggccaaagctaaaattatatggatattccatattgttag

SEQ ID NO: 12610 - DNA, 1501 bp, Oryza sativa
agtgttgtgtcacattaacaacttaaatatcttactcgttccgtttcaaaatacaagagaattttagtactgtaaatttgaacatgatattttagtactataaatctggatatgatcgtattagtaatatgataaatatatgtatttttgaacttcaatatagtcttcgagatgctaatttaaccaataatatatataaaactaagatttttttaaataaaaagagttacatattatgataactagaaaaatgcatgtgcgttgcaacgggtgattgttattttaatcttattattgttattgtcggtgacatgggaccgggagtatcatgacttagagacttgaggcagacatgatcacccacgtggtctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgtacgcctcgccccatcccgtcaggatgagagcctccaagcactcatccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacattggtcatgtcgtcagcagacagccatgttcccacgtcgcgcctgcttccggcggaagtggaggtaggtatgggccgtcccatcagaaggtcattcagacggcaaccatacaagtctccgtctgtttatgaaaatataggataagtccccacaaaaaagagagagatggtgcatgtggtatccccttgaggtataaaaggaggaccttgcccacttagaagggggatattttttggggggggggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaa

SEQ ID NO: 12611 - DNA, 1501 bp, Oryza sativa
ttgcaactaaaagcctaagctgatagggaaagatggacaattcactttatacattccaacacaatcaatcaatcgattttgtccaagaaaccatcctgatccatcctgatcatgggcaatttccggccggcggcggcgtgcgtgcagtaccacgaggagatcggcaagccgccgccgaagtcggaggtgatgaggcacctcaaggcgaagcgctacgtcgacgccaaggacttcgccggagggcgtgacgccggcctggtggtggttcccaatggccaaggttagattactgacaaatcttatcgcttgcagaattattccggcgatctgaagctgctgctaattaacatcgctgagatcttcttcttcttcttcttccatggtggtacggtgcagatgtgcaggggacgtgcaagtacggcacgagggtggactacatcctggcgtcgcccaactcgccgtacaacttcgtgccggggtcgtacgccgtcgtcccgtccatgggcacctcggatcaccacatcgtcatggtggacgtcgccgtcgccgcccacgatggcggcggcggcggcggcgcggcgaggcggcggcggaggcggagggtggtgaaggtgacgaacaagagttcggcgagagggatattcgccgattagactagatggattattattgggcttctggtttcttcttccttttgagtgaactgtatatgtgtctcagtttacggcccaaacacttttttttggtggggatacggcccaaataattatctggccgaataagcccattagtaatatgaaccgaatggtagcgagcgatccaatcttggggtttgggttccaggaaggcccgtcaacattttcgtacgcacacagaacattgtcgtatggaattattcatccgatgccccttaacttgtcaacgaatctgattttcgtccttcaaccagaaaaccagatacaacgggtccctcaagtgttaaaaccggtgtaatatataggtcccatggcggttttagtagacgtggcgctgatgtggctaatttcactcggtcttcatctgacgtggcattgacgtggtatatatgaaataaaatttaaaaataaaacaaaatatatggtcccacacgtcagtcaaaataataaaattaaaaatagtgagacccacatatcagtgtccccattcatccacctcatcctttttctctgtctgctctcctcctcctccctctcttctctatcacctcatcatcttcttgttagatatcatgtgtatatctggatgtgtccggctggttgatcctatcctttagctgttgagatagcgttgtaatccaggttagttggagatatatcagccggactattctcgtcttgtaaaccacgatgcaggttgtttgcatcatatattaatacatgcgacgcacccaagaggaggtgacgatcgcttcctgtcctctgactttcttcttggtatcagagccttctcctctttcaatcca

SEQ ID NO: 12612 - DNA, 1501 bp, Oryza sativa
gacctgaccaggttttaatcaccataattaacacgcgtacaagcgaccacaaccttgggattactattagtataaacacgttcgttgccgccctgccaagagagagaaaagagagaaaaaaaaaaggtgactcgctgccgagtcggacacgtgacaacacgttggtgccgcgtccggttcaaccgcttgctcgcgcggaccttatcgctccggtccgacgcgcgggtgacgtgtaccgagcgaccataccgtgccagccttatccccaatccgggcccacacttttgtcgtcgctcggtgtgggccccaccctgtcagtgtacggctcggcgctcaccggcgtttacctccccagcccacgggaaggaggcggcgcgcacgtggcagttgcggtgggtgaggctgtgagggcggtgcgcgagcctacgtggcacgccgcgtccacggaggccgtagagaggtggcccccgtgagcacgcagttcgagtaggcgatgacgtgtccgacaggtggttcagcgagcaataattacggggtaatataataaaccgctcccgccaaactaacggcggcagcccacggaaaaggcgtccctcgctgctgtttcctccgtttttcgctcacctccggtcatcctactcggctaccccggcggcaaaaacatgaagttctacagatctacgacatcagtttactagtttgtcttttgttctactttgctctttctttcttgcgaatttctttttaatcacgttttgtgtagaccatgtacagcatcctcacttgtgcagggtaggaatttcacaagaaaacagtgctcgtgcagcgactcgatagaaacggaagaaaaccgtatcaacaaccaacacgaggaggtgtgtaatactcctttcgccttgtaatataaaagatttatatagatggataaattttaatactataaatttaaacaaattttctatgtagattagtagtatgtgttatatctatttaattttttttatattttaaaacggaagtagtaaacaattacttatgtaggctttgggtgcagggtaccgtagggggtgagggcaccgcacgtcacggttaaggtggccggttactactactggtgtcacatcggcagcggcaactggtattacgtgatgatcttatcctcgtcgtctcgccgtctttatcccgttcgctgcttgctttggcttctcacatcagcactgactccaataacacgctcatcaaacagcgcgcgcgagcgagggatggataggatattttcgttcgcgttcgtgccatcctaaatcccgtctataaagccgtgcacatctctatcctcacctccattccattccactcgccaacccgacacgtctctcatcttcacgcaacgaacagcagcagcagctcaagctaagctaagctaaagtactacgtgttctttcgtcttcgtcggcgccggagtttgattcgtcggagctagctagcaagaggaagaagaaaa

SEQ ID NO: 12613 - DNA, 1501 bp, Oryza sativa
attgccatcgcactcgcagcgcgcgcgcgcgtggcgtgcggccgtgcggtgcgggtgtggcttgccgcgcgcgagggaacgcggacgccgtgcgggcacgaggcgctcacgtgctcgcctgctgcggtgctgcctgctcccgagccagcgaagccgtacgtgcactcaccaagtatcacgcgtaggcgtaggttttgcgccacgaacttgccgcaataacgcgaacgcacgctgtcaggcgcgccaccaggggataaagcaaaaaaaaaaaaaaaaccggtcaaaggagagtcggggttttaaactccgagcccctcctatctcgttaaaaaaataactcggcccttttgaggttgtatatgaaggatatgtttagttctcaaacaaaaaaattttcatcttttcacgtcaaatatttggaaacatatatggagtattaaatatagaaaaaagctaattacatatattatgtgtaaattgcgagacggatcttttaaacataattgcgccatgatttgacaatattgtgctacagtaaacacttgctaatgaagtccggctctgggggttcgaaattttaatcaccgaacccccttgatgtcatatggcgtcgtcactcgcttgctctcgcttcctccccgctgcgtggctgtatatattgctagaagcctagaatgaagtgtatgcgtcgttgggtcgagctgagcctatcaatcgatcattcaagggctagaatgaagattttggccccgtttggtagggatctaaactccaactcccaactctaaactctaactccagtgagagctgactcctatagaagctgaggtggggacagaaagtgcttggctagactattcagctccacgccaccatattcctcgtcagcatttcatcgaacaccttgttggcgtcaacctatcgtggtcgccgcccgcgagccgccgccgccggtcagcccacgcccaccagctgtcgacgccgccgccgccgccgggcagcccgcgagctgccgccgccggttagcccgtgagctaccaccgcagcctgtcgacaccgccgcccgcgcgccactgccaccgccatcgcccgtgctgccctcgccaccgcgtgcccccgctgctgcggacgcggcctgtcgccactgcgtgccgccgtcagccgccaccgccgacgtgactcagccgccgctcgctgccaacgacgcaaatgaaaccttccatggccggcctcgggaggaggatgggggaggagagagaacgggaggaaagaagataggaagggtagctcaatggcatttttgtgtaaatagactaaaaaattaaagggtagtgggtctttaaggtggagtggagctgtggagcagaaaaacccagctatacccctgtagtacaaatttgtgaagtagctctactgttgacgtttgatgtcgtaattctggtatttgcatggtatggggattattggtgctaggatatacgcgagactgaggtaaaagaca

SEQ ID NO: 12614 - DNA, 1501 bp, Oryza sativa
tccaccccaacgagttccgcatccagtctttcttctccggcggctgcggccgtcctggcacggacgccgccaccgccgccgttgctgcctcgccggtcaagaatgtcagcggcggcgcaagtgatgctgctgccgcgaccacggcggcgcggtcgccggacaacgacgtgagggtgctcatcggcatccagacgctgccgagcaagtacgagcggcgcaacctgctgcggaccatctactcgctccaggccagggagcagccgtccctcgccggcagcgtcgacgtccggttcgtcttctgcaacgtgacgtcccccgtcgacgcggtgctggtgtcgctggaggccatccgccacggcgacatcatcgtcctcgactgcgccgagaacatggacaacggcaagacgtacaccttcttctccaccgtggcgcgcgccttcaactccagcgacggcgagggctcgggctcgggctcgccgccgccgccgcggtacgactacgtgatgaaggccgacgacgacacgtacctccggctggcggcgctggtggagtccctgcgcggcgcggcgcggcgcgacgcgtactacggactccagatgccgtgcgaccgcgagaacttctacccgttcccgccgttcatgtccgggatggggtacgcgctgtcgtgggacctcgtccagtgggtggcgacggcggaggagagccggcgcgaccacgtcgggccggaggacatgtggacggggcggtggctcaacctcgccagcaaggccaagaaccggtacgacatgtcgccgcggatgtacaactaccggggcgcctcgccgccgagctgcttccgccgcgacttcgccccggacaccatcgccgtccacatgctcaaggacgccgcccgctgggccgagacgctccgctacttcaacgccaccgccgcgctccggccatcccacctctgaaccgtgttcttcttcttcgcgccttctctctctcgatcgttttcgtgacggattcccgttgaatttggcggttgttggttggtggcgggtagttgttgcgcgaaagcacggtggattgcccctgtgttcctagctgatttgttccaaatttctcgagtttaaaatagatatgaaatggatatttgttcgttagtgcttacgtgttctttgataaaccaagtatgattattacgctgacgtttgcagcgagagaaaaaataacaggtgtgtgacatcttcagaggaaaatcacgtctgatagagaatgacacacggtatggatagaacgagcaatggtttcgccacaatcgggattggattctaatctcgaggggatgtcccttcgggtacttttttttctttcaaattctatataaatgattatgaaaaattctgaaaaaaaatgtagagtatagtgatatctattggtccaccaaaaatcaaattaaaattctacctacacatcaagaaaaaaaaagacaacttcagatattatcatatgaacaatg

SEQ ID NO: 12615 - DNA, 1501 bp, Oryza sativa
tcactgccatgcattttcgaaatcattttctctcctccaccagatgatgagacgaaattacccttcctggtgagcgtggtgagcaggggacaaaacgccatggcctcgccggcatattgagtggcggcggcggcggcagctattgtcttctcccaactcggtcgccccatctcactctccaacctactgctgaccacatcgagagaacaagcatgggctgcctctttggtctcaatcccatcgccggcggagatgaagacgatgatcatattcatcaccaagccacggtcgtccttgtcccttttgcgttccatactcaactcatcttgccgaacaaactttcttttgacgccatcgcgtttgatccattgtagcaacgggaacaccgccgcgccatcgtcgtcctggagcgcgctccggagcaccgccgcttcggcatcgtcgacgtccggccatcctcatccatcccggagcaagccaccgcgccatcaactcctccttgaggtcctcttcaaaacccctcaagaaccgagaagaatggagcatcgaggagggagattgacatcgtcttctccaacttcggccgccggcgtcaatcttcgattccctccgctccggtgacctcctcgtcgattctttgcgcatgcaccatccctgggacctaaccaacctcatggatgcacatgcatggcttcacatcgaattgaatgagttggcgtcgtctcgccggagctcagagccgccgctgagacgttttattcatcgctgccatcaaccaagcctcatggcctttgctcggcctcgccctgtcccacaccgtcgtcgccaactcgttccgccgcatccccgacaggtcgacgccctcgtcagcaacgatgacgaccacctcgccgcgctcgaccatctccgccggcagcacaaaacgaaggagagaaagaaagagaagagatggacctgccattggccccaagggcatttccgtctaatcaccacaaagaagaggcaaaatgatttcggaattaagagaaaatgagaaaatggcaatccagcgagttgcgccgccttgatattggtgtattctagcgaaaccgtgttttgaagatggctaaatgtccattttctcgtgggccaccgggctgtgcgaactcgctacgtggaatacttgggcccttcccttcctttccccaatccgcctcatccgataataccccccacccctctctcgtttcggcggcggcggcgcgcggccggagcccgagctgagaccaccaccacggcaccaccacgaacacgacgatgatggccgcggcagcgagaatggcgttcgcctcatgcggccgcctcctcgccccctcctcgtcgtcatccctccccgccctgccaagaacccggggcagcgtcgccgccagcggcaagcatcccgtctcgttcttggcggcggcgagatccgcctccgtcctctgctactgctccgacgccaccgtcgcgccggccccgcagg

SEQ ID NO: 12616 - DNA, 1501 bp, Oryza sativa
attcggttggaaaccgctcccctaatctcgccggcgccattgatggcggccgacctcccgcgccggtttcctcccttccccggccaccctctctcgcactggctctatttaaaccctccccgcacctcctccgtccggttccgcctctcgccgcccttcctcctcgccggatttgagctcgcgacgtcgctctctctctccgccgtcgccgccgagctccggtccgccgccgtcgtcaccccggaccgcctcccgcctcggcgtcgcctccttcggcttcgccgcgtcctcgccgacctcgtccacccttccgtttcgcccgccgaccgccggaacgccgccgtcctcgtcgacccgagccgcgccgccgccttcctccgctccggtcgccgttcccgtcgtcgccgtcgacccggggtgagccgtggaccgcccatttcgtttcccccttccctcccctctctcgggcgccgctccgccgcgccggtggtcgccggcggcgaccatcggggcgcgggcgcgccgcctcccgtcggctgtgccggcgaggccgccttcgggcgcgccccgcggctgccatgtggggcccggccgtcagccgcccgcgccttcgggtgcggctgacgcgtgggacccacggcgccggccggcgtaagccgcgtgcacccggtccatcgtggaccgagaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccataacttggccatttgaactcggaattggaccgttcaagtatctaatttttccttaagaagccaagaactcatttttgtgctttgtttctgcttgttatatggagtttagtagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccttagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagtagcaccccggccactataaggattaa

SEQ ID NO: 12617 - DNA, 1501 bp, Oryza sativa
tatcgcgtggtgaatgcggtcttagggatatcttcttcacgaatacgtaattggtgatatctggaacgaagatcaatcttggagaatacagtggcacctttaagctgatcgaacagatcatcgatccggggaagagggtacttgttttttatggtaacttcattgagagctctgtagtcaacgcacatcctctttgtcttgtctttcttctccacaaaaatcacaggagcaccccagggggaagtactcggccgtatataccccttttctttcaactcttccaactgtttcttgactttggccagttcattagctgccatacggtagggtcgcttgtacagaggagtggttcctagagcaagatcgatccggaactcaatctctcgcttgggcggcataccgggtagttcttccggaaacacatctccgaactctctgacgatggggatttccgacagtcttatctgatgaagttctgaactaccgacagaggttgggggtgcaaagaaaacgaccggttgttccgtccctcggtacagagtgacagtgcatcttgcacaatccactacacattggaattgagccaaccaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggatgcgcttggccttgctggcgcctcggctttgggcatttatccgcaaagtgcccaggcttgaagcagttgaagcacagacgctgctgaccttgaacgtccctgcggccttgaccaggctgcacggctggcataggaggacggggcgcacgagtcccttgctgactctgctgttgctgcggctatgggacgcgcaccacgaattgaggacccggcgcacccgggctcgcaccggccggcgccgtgggccccacgcatcagccgcacccgagggcgcgggcggctgacggccaggccccacgcggcagccgctcggtgcgcccgaaggcggccacggcggcgcggccggcgggaggcggcgcgcgcgcgcccctacggtcgccggcggcggccataggcatggcggagcggcggccgagagaagggagggaaagggggaaacgaggcggcggtccacggctcaccctaggtcgacggcgatgacgaaaaggcggccggagcggaggaaggcggcggcgcggctcgggtcgaccgggacggcggcgctccggtggtc

SEQ ID NO: 12618 - DNA, 1501 bp, Oryza sativa
ttagaaaataagggagtataattaattatatactccatgaatacctgatcgatcgatgcacactgatcgatcgactggcgtatacgtgctgcctgcgtgtgtatgatgatcttggaaacatacctctcatcacgcgcaccgaagcaaattaagcagaagcagtagcgtgtcaggctatatagcttcctctgaatttctccatgatatgtacatgcatgtatgcatctgccaatgtaagctagctacatacaatgctaggtaaccaaccgtacgtgtgtcacccatgaagtttttttaggtcatcttctgccgtatttcagtcatctcttgtgcctgaagttttcagtcatcttctgcctaacgtgcgtgtcctcctagccgagatggtggattgattctgtggtcatagatcttagttgtttctcatgttggtgggatcagcatcctccaacatggcaacatatatatgcagtaggtttgtgcatcgaaagattttgtttctcgaaggttatattaaagatcttggttgaccatgaagggaaatgtagtaactttgatgaattaatggtacgattcgattatgatatatttgtagtatatttgtgcaatcgactttgtctttttacaaagactagtaatttttttttgcacattacaatggatcggaggtgtgatggtggagttgtgggtgtatgcatgactttatccatcataatttaaattctgctatccacgaatactatgcacacgtaaagtacgttttcaataggaattcaatgggactatggatatgtgagtgtgtgttagagggtgcactcgtggatgtgtgagtgtggtctgtgtgcgtgtacgttaatacactacccgtgtaataaaaaaagaaaagtgttgatgtaaaatccagcctagttggcttaggtgagaaaatggaggatcgattttcatgtgggaatacctaggtttaggcctgttttcacgtgggagtgggttagtttttttataggggtggttgcacgctatggttgatggttaggaggggttaacatgtgaaattcccttttatcgtagcagaggtttatgattgattttctattatttaatatatcgttataattactatttaattagttaggtcatcaatttatcggatacagggagcaactttgatgcgtacgttacttgactagtggagttgagcattactatgtgtatgtgtccatgatggtgtgtgcatctttcatataattgaaaaaaaaattaatatgatcctacggaatatgatagctatatatctaagctaggcaaacgccgggttagataaacgtccctaagcttggtcatgttatactatagttatatacctagtctagtttaattacttcctccatcgtaaaataagtgaatttctagttttttctttaagtcaaactatcataaagttgaattatagcaatcttatactagataagagtattaagtatttaccattctaattaaatga

SEQ ID NO: 12619 - DNA, 1501 bp, Oryza sativa
acaacatggcctagctaagctagcctatctttcctttccggattattctctcccaaatgtgatattgatctagctttagtttcttcttttttttaagcaattgttccctaatcatatttaattatctcaaaggagtatgcctatctattcctgcctccaatgcgacgctgtttccttacccacatttgtggttttagtgctgtgtaagtaattaaacctagctagtaatggaagtaagtaaaacaactttattttcttgaaaggtacccatgtgtgcgatatttgtggggaattcggattttagaaccatgatgaataatcatatgcacccaacttctcaactgtacctcgatctgtcggtctatttaggagagttttagattcagataagcagcttgagagaatagaaaaaccatgtgaaaaaaaaacacacaactgaaaaaaaaaacatttttgcaggcgtctgcttcttattattttcctgaattttaaaactatataacttctccaaacctaaataaaaaaactaaactatttgagtagcttttgattgtcggaagcctctcctaaaatagccatgtgtttcccgccttcccaagtaagtaaaacaactttgggctatagtagtggatgggaacagaagagtggactaattttgtaataatattttgtgggaaataaaatatatgctggtgcgggtatatcttagattctgttggctttgcaattgtcgcctgttgtttgcagatgcgcgctccgcttagaaaatagcagcagaattcctcccaagaatatgacaaatccgatcatccgatgcgtcatggaactcgtggcgtcatcacatcagcaaatccaagtacggtgaactactacgcttcaatcaatttcccttttcttccaatgggcctcacaacgcaccgcggcccaatagctcttagcccattgccatccgccatctcggcccggaaccgcatgggccggcccacgccacgccgtccccatcacatcacaccggcccgcttctctctcgcgcgcgcgggtgaagcgtcgcgcggcgcgccgtggcgtggcgtggcgacaggtgaagcggccggcgaggcgaggcgaggcgaggcgaggcggcgtcatctgcgccgcgtccacacacatgtacgtcgcgctacgcgcccgcggcgccttatcttgacaccagaatccacatgattcctgagccccagctataggctatagctagctgctgttgctgcttggtcccggataacgtgacaaatgcgacatggttcatgcttgctcgattgattgattgcaatagacaaaaactcttcttgtctcttcacctcgccaccggggccgccatacaattacctccataaatcttggatagaatgttaggagtaactaactctgcactgtgccattgctgtgtgtcagtgtgtgtatatatatccagctgccagctgcagagtgaagcataaacatcagtagacgacggcgatggcgc

SEQ ID NO: 12620 - DNA, 1501 bp, Oryza sativa
cctctgcaatgctcttatctttggtgagaaatgtagagtgccatccacggccaataggagaagacggatcatcaccctctcctaacaccctcgtgtatatcagcccatccttctccaatttctcaacaaattctggatacttttccttcatcctcttgtaaacgtagtggctcaacactatcggtgtctcaccaccaatcttcggttccacctcgcagaagaagaacagcttcgccggaaatgtcggaacctgaaccaaaaacatatatgaaatctcagcttaattttaaacattagtataagcttgtagcgaaagcattttcttgaactcgaattggattcgatttgctgtgattgtatggtggacctgcgccatctcgtggtggaaggggatcttctggtcgggcggcgactcgttggcggtgaagacacgccccaccacgttgctccgcggggcggcgccgccgacgtaggggagctccgcgtacccgaaggcgtccacggcgcggtcgaagtccgccgcggcgcgcgccgggaacccgcggagcagcaccgcgccggcgccccgcagcagcggctccaccgtggacgccctctccgaccgcacggcgtccaggaacgcgtcgaggccgccaccggccgcggcggcggcggcgctcgggacgagcaccgccgggaaggcgacgccctcgacgagccgctgctccgggagggcggcctcctggaagaagctccccgccggcgccaccatgttaatccgttgggtggtgtgtgcgcgagcgagcgagcgagcgacacgaggtggatgacaaagggcgttggattcgttgggattttttggtggggacgatgcatatgcttgggatgaacgtggacgggttctcgaacagtgtcgggatggtggcttgtactagctcagtcaagctggacgtcacacttgtcacgactcacgactcatgatgatggcaacgtgcattaccctggtgttgatggctactacctccgttcaatctcaaaagttagttattatattctggacggagaaagtattaaggatgtaagcggattaacctgtaaacattgacggacccagcctaaaattttagctatagcgtaacaacgtagagagtacactttgaactaaagctatagaatctactttctccgtttcacaatgtaagtcattctagcatttcccatattcatactgatgttaatgaatttaaatagatatatatgactagattcattaacatcagtatgaatgtgggaaatgctagaatggcttatattgtgaaacggagtagtacaaaacattgtacagaaagttatgttgcagattagaattaattcaaagcatttttgaaatttagattagattttctagacccgattgtgaaacgagtgctaagcatagtgaaacgagtgctaagcatagtgaaaaaaaatgctaaaattgttataaaaatcaaaatcaaattctaaggtttaaaaaccaact

SEQ ID NO: 12621 - DNA, 1501 bp, Oryza sativa
attggtaggaattagctcaagcttattagagcaagtttaatagtatagtccactactacctctaatttatctatagccattgtaatagttaattcatacaatatagttgcttactatactattaatatatggtcacacatatcatacacataatgtgtcttggaatccgtgctgctgcagctggctataaatctgtataccgtttctcttctctctcatcttttatcttattaaaatatgtttatagttagctaatagtctgtcactgtatctgctcttaatcgtaattgattacagtagtgatggaagtggcatccctcaaccctcggttccggtgacactgggagggctggacatccatcgaggtgacaccgcctcgcccgggtcgacatgtgcgaccatcatctcactggatgcattttggcaaagaggatcacatgcacgcacacttggcctagcgtgcatgggtagccggaccggtacaaaacgaaggatataaacacacacaggctagcgctgcaggcaggcaggcaggcaggcgagcatgcaggagtcgtggtgcgacgcgccgacgagtggattcagagcgccgtattggtggtcgtcgcttcgggtggagtaggagtaggagtagcagaggttgcgatatgattcatatcgtctccgacgacgcgaggccagccggtgggttcatgcatgcgacggccaggaatagcagagtccacgagacgagacgcgaaggcgacgagctaccctactccggagtccggacagggctagtggtagcagagctcagaggagtgtactgctacatgatgacgtgcgatttgaccaccggccggcctgccctgccctggactcccgactgacacctgcgcatgcacttcgcacgcatgcacggctccccacgccctggatctttgttgccgccctgtgtcgcgtgtctcgtctcctccctcctgcactccttgtctctgttccgctcaatctactccctgcgtacggatgcccgacgtgcccacgtactctaaatagagtactcctacggtgcacgtactctactcttctattacaccctggtaaaaaaacaaaggctgtgtttagtttcttccaaagttgaaagttttgttgaaattgatatgatgtgactaaaaaattatgtgtgtatgacatgttgatgtgatgaaaaaagttagaagtttggatctaaacacagccaaacacatactactcctactgtccagattcgtaacggagaaaaactattcaaatctgtattactacgacatttacacatcctatacaagatgtactcctactagtacttatttagggatagagtataagaatcttgaaccagacatgatattttatagtattacgaatttgaaaagactgttggtccatattcttatattttggaatggagtaatagcggcttgttggtgtggctgtgacaaagaaacgtagtgctatactagtagtacaattcaatcgacta

SEQ ID NO: 12622 - DNA, 1501 bp, Oryza sativa
cgccgccgccgccgccgccgccgcaccggcgccgtcggcgacaaagccaccctcgtcgccagcggtgtcgcacgggtccggctgcgacgacgccgcggcgggcccgtcggcggccggcttcccggtgagccgctggacgaggtcgcggaagtgcctcgcgtccgtcttgatgacctccggcgccaggacgtgcacgatcttgatcttcctcggcggcgccttcgcgatggcgtgggagagcttgtgcgtcgccgacgacgacgaggcgcgggactgggacttcatggcgtggtgcttcatgccgaggggagtggcgccgtctcagcggctcgcctctggagagagatgccagaagggagaaacggaaatggcggtcggtgcttgtgacagacgggaggtggcagagccagagcacacgccgaaagggtttggcttatataggcaacccttgtggatttttagccgttggatgaggtgagcctgcgatccaatggtccatatataaaaagtttttttatatatatttcggtggtacaaagataagcatgattttaattggtatggtttcaaaagaggagttcagaatattttttccaaggaacagctcatctgattttcaatttttgaatgacatgatagagatggattttcatacctagagtttcacctaaacgagtatggtggcccacgtagattgcgcggctagcatcattatatttttttctctcatataatagcgtatatgttttctcaatttattattaaaatatattaaaatgacaacataattttaaattttgtactaactttatgaaactaataatgtgtaatatttatattttatatacgtgttagttattaattatttttaatatcaaattttagttatttctaaattatattcatatatggactctagactcgtctttcaatacttcttattttttaattccaaatttcattatctgtaaattgtatttctatatagactatagaatcttcttccaatattatttatttttaattctgaatttttattatttttaattgtatttctatttgcactctaaactcatctttcaatattctttaatttttaatttcgaattttagttacttctaaattgtattcctatattgactttagactcttcttctcatgttttttttatttttaattttagttatttgtaaattgtatttttatacggactctaaactctactttaaattttgttatgtttatgtttatttcgaattttagtttgttttaaattcctatatagactctatactctagttctaatattccttatttttaatttcgaatttctattatttcttaattatatttctatatggactctatactcttcttataatattctttattttttaatttctaatttcagttatttctaaattgtatttctatatggaatctgtcagggttacgggttaggtataccccttacccttcgatatacgccacatatcgaca

SEQ ID NO: 12623 - DNA, 1501 bp, Oryza sativa
tcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggttttcccgctcttgcacttaaggaccgtttccttggaatttcatccaaacataagataagtacgaccatatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggtatatggtaaacctgtgtcggctttggaaatgccttgtcatgaaagcttggaggtctcccgacgtggctgatccccacgggctgggtgatccgggttagtaatgtcgtgtgggtaaagtgtaccccatctgcagaggttaacaaactgttcgaacagccgtgcccaccgtcatgggcggatgtgaggtgattcctagcgtagttttgtttgactactgcttgtgaaattgttgttgtagaaaggggttcgctgtttgaaaaatctgcagctgatgggatcagctaggcccgggtggccgtttgaaagttgttggcccgggtggccgtttgaaaagctgttggccgggtgccaaccttgttttcaattttaaagactgatacattgcacatactccgaccggacgagacgcactgtctcaaccgtgtcgtttgagaaacactcacttagctgtttttagaaaagagttcaaataaaatcaacagcaaaaacaacagcctttccttgaagcctacattaaacacttatttcccttggcttgctgagtactcccgtactcacccttgctctatataaataatccccccccagttgctgaagaagaagaagcggatcctgctgatgaggagttctttcaggagcaagccggctacgatgagttttagggtttcggtctagttcccaagtcgcgcctgtgttggttggtcctagtcctggcttccgtttcccttttgtaatgcagttgtgagctcgggatctgtccgtagcccaacatgactgtatctctactctataataaagtgaccgctgttgctgtgatattctgtctccctgtgataccagcactgtttcctaggactggtatcgaccaacaggttaatttggagcgtcacgggctagttccggtcgggattagttcggggcgtgacatgacggcttcggactggtggcgcgcaggcgtgagaggagcaggcacgcgctctctgggacgcgtggcgcggatgcgttggcttggaggagcacgacgcggatcggtgcacgctgattggcttgaagtggaatcacgcggatcgcacgagggcgcgcaacgtggagagctcggatcaacaacgtggc

SEQ ID NO: 12624 - DNA, 1234 bp, Oryza sativa
cttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcgcccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattcttcttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggt

SEQ ID NO: 12625 - DNA, 1501 bp, Oryza sativa
cttggttccgaaggacagtaggtaaacctcgtttcttttcccaggtcatttgcacgtactgactgcttatatttcccgtatacatacatacatagagtaatatggtgttttcaaaataaaataaatataatctaatggtctaaaatattgggttaaaaatcgacggtgatatttgcttaaatttacagagtaatagcttttatatttaaatagtagaatactccatttttaaagataattgattttttcaatggtactatgtatgtatatttttttagctttattgttttctatagtaagtctgtgcatagtttttttttttataaacagtaggtaagattgattgttttttagtcttatgtatgtacgtacctatatggagtatatacttttgtttttgttttctttttctggtgaacagtaaggtattagtttatttttaaataaaatacatctaatctaaccgaatggtccaaattattgggtccacttatttaagtgaaaaacgacgataagattatgtgatttctttctttttctagcctaacagttatatatttctcccgtttacgtagacatagtaataaggtattagtttttaaaataatatacatctaatctaatggttaaaatattagattcacccatttaagttaaaatcgacagttatatttgcttaaatttatagagtaataggttttatctttaaatagtagaaaaaaatctatcttaaaaataatagatttttaatggtagtacgtacgtagtttttttttggctttattgttttttttatagtaagtgtgtgtgtattttttttccttacgatgaacagtaggtaagattattgattgttttttagtctttacatactacgtacgtacctatatatggatatatggagtacatgtgctttgttttcttttttctggtgaacagtaaggtatttctttctttttaaatatataatacatctaatctaatctaatggtctaaattattgggtccaccgattaagtgaaaatcgacgatgtaattagacattgccacgtggcggtctaggagcgtttgtaggagtgccacgtggcggcttgagagcgtttataggaagtttaatggacttttatttagtatatatatataatagatagaagatagatagatataagtaaaccaaaacaaagaaaattcgtccctggccacctcacccggccatgacccacatacgcctcgatcgatcgaaattccgatgaagcttcttcccttccatcttgatgtcccggattcatccgcacctggtcagtaatatcgaattatcgatcatcatcccggtcgatcgatcgatagcaaccgccgatcagggtggtataaattctatacggctccgctagctagctagcttgcctcgcgctcgcttccaaaaattaattaaccacaaaattaattaagtagctagacaaccacagccgccgtggccggtgcgttctgatccaccgcgcga

SEQ ID NO: 12626 - DNA, 1501 bp, Oryza sativa
ccaaagcgccgtgagattcttctccctttccttcgatctcgctcttctggtggtgttctccctctcctcctggtggtgtggtttctgcgtgcttgggtgtttgggggcgtcgcggttttttctggttcgatcatgtctttcgctgttgtggcatttgatcgagcagcaaccgcgtcttgacctctctttgaatcttgaggcgtttcgtcatccgaaacttggggcaaggatcacagctgtttgatctttttttccctctcttgtaggcttcccgtaccgtgcttttgttgcttcgatggttttgaagtttgaggtggagtgtggttttctgagttggaggaggaggctgatgagcaccgaagcttcatggtgtattgatcttgctgtgtgtgtctcaaagtctctaccagtgcgtgcgcaaaaaattagaccacgtcaattcgtttctcttgtctgcttgtattttccagtttgttcagttaattttggtgtgttgcgggagttcagtttctgaaaatttattaaccagatgccgccttcggccttcttgttcttttcgctgttcctgatgcaggatgcttcttctctatgtgtctctctgacgtgttctcttggtttagtttctgtttggaaagaactccatgttctctctgacgtgttatcttggtttagtttctgtttggaaagaactccatgttctgttcatacaatgatttctgcatgtgtagcttggttaaactgcttgtttttttttccctttttgatgagaaatcttctgattctttgcatatcaaagaagctttcatctcttgaatcttagatttgggatccttctaagcccaacggttttggttctgcaagattgtacaatttcttcatgtttgttacctatattttacttctcagtgacgctgtcatgttgtattctccttgctgaattctactataagtgcacgctgctgtctctgtttttcttcttctgttcacttcatactctgtttcgaattattgaagttttaatacaccaaagaggtggccatatcgggaggaaatttattgtccttgtacaatacgccttttctgtttgtttcctcttcatttcactttggaatttggtgttatgatttgtgtcagaaaagcttatatggcgttcttacaaaaccttgtatgcattttgttcacagtaatattttattttaattcttccttgcttgattcttgtataagatataagattaatgtgtataattactgcagcattgcaactgaagattgatgatctcatgttatatgtctcaaaaatgcatttaggggccctgataaatagtgtcatatcatgttatgtctagttgactccttttcgtgtttttacgaaagctcttatgtatttaattgatctgtagtgttttgtaattgtattcactttactctttctccatatttgtcaataaagttattgtatatttgtattcatgttataaattttcagcaaaacaaaggt

SEQ ID NO: 12627 - DNA, 1501 bp, Oryza sativa
tacacgattatcattgggtttattttttttactttctataagtccaaccaactgctataaccatactatccgccgtccctccttttaatcttcattgggattctatttggtttgtttttaatttttagaattctcattaaccgtcaccactctacttctttataggcatgaccatgatcaaactatttagattttttttaatccgagaatttgtaagtctcgagagcaaacttagagacttttttttacattactttattaagataatagatagaatattttatttgtatataattatatcaatcaatatacaccattaaaatctagatcctttaaatacttcacttttttttaattaatatggtgatttccgtccgcttctcagctctgccccattctcggagtatgagctataacatatggaccctaaatatagagaaagctattgggaatcttgttacttagaatttatttttttctaaaaaacataccgtctctaaagattatgcgatagagcaaaacttaaatatggttgaaggagttcggatgcccagttgttttatctcccctacatatgattttgtacaggacgtgtcagttgtgcatatttattatttctaatttagctatgcagacatgacgtgtttgtctcctgtcagtaaattaagtttcctaatttgattttgatttcaaaggctgctgcgtagcacgcatcaaaatctaactccacgctctttcacgtgtccgattcataaaaacagaatcaaagagtcaagcttttacatatattgtgattaaatctcaacccttgtagtctagatatgttaggatctaacggtgtagattttttctttttccccgattaatgtgggaatttctagcatccacctgtcttctttcaaagctgttttaataatataatagatagatagatagatagatagatagatagatattctatggcaaaatttgctacaggatatcaaaaaacatgtaatgtaattagctgtagaacatcgaaaaacctgactcagctataggacacttcaaaaatgatataatttgctaaaagactctaaagccattattttattatttcttggatcaaatggagagaggaattttttagaagacggcaatgccctcagacctctctccttcctcgatcttgtctgcaggtaaaaaagagaaagaaaaagaaacaagccgtcgttgcacatggcccacacaacaacatactccctccgtcccaaaataagtgcagttttgcactattcacgttcaacgtttggccgttcgtcttatttaaaatttttttatgattagtatttttattgctattagatgataaaacatgaataatactttacgtgtaactaaatatttttaaatttttcataaacttttcaaataagacggacggtcaaacgttaggcacggatatccacggctgcacttattttgggacggaggtaatacaacggtgtttcggtgtcctcca

SEQ ID NO: 12628 - DNA, 1501 bp, Oryza sativa
gaaaatgctaaaatgatttacattgtgaaacggaaggagtagaatcctgttgcgatgagcggtgcatcgtcgtggggagaacgtgtggctcgttgatgatcggcggtgccatgttttcagggaccgagcggcaacttttgtgctgatagcgtgcgtcctgccgggcgggcgtgcgtcgttatgtgagggcaaggccgcttatatgctgccgcaattaatcggaagaagctgaccggtgccggccctgaggacgtccacggtgcagacgtgcacacacagtacagtctccgcttgttacagtgaccgccaatcatgagctcaacactctctattcccttcctgattgctgacagctgcagctgacttccttccagctatagcagcagcagtagctgccgtcacttcgccaccacagtgttctcatctccctttcatatcccctgcttcctctccgtccatggaggaggtggcagtagcagctggcatcctcctcctctgatctcctcctcggtcacttcagtgcttacttgccggtgatgaggaggtcttctcaggggaagagctccagcggcggcggcgttggcggcgtacggaggtatgacgtgcacggtggtggtaacttgctggcctgctacgcgaaggcggcgaggccgaggccgtccaagtgggacgacgcgcagaagtggctctcccgggcgggcgacgacgactgcggcggcgaagctacccggcggaggagctcctgcgccagcgccgacgacgggctgctgctgcctcctccgccggcggcgcggaagggggccggcggctggcgatcgtggagcaacgtggaatgggagggcgcgcccgcggcgatggcgccggcgctgaaggccgcgcgcggcgacgagggggtggacaccaaggtggtggacgccgtgcaggcgtacgtgccgcagcggtgcgtggtgtcgctgagggacgtcggcacggagatgacgcccggcgggagcaaggagccgtcgagggcgaacactccccgcgtcgtcgcgccggcggcgaccgcccgtgtcgtcgcgcggggcacggcttcgcctgggcaatgcgacggcgggtcgcgtgacagcgccgtcgccggcggcgtggtggatctccgggcggctcgcaagcgcgccgatcaggggcacgacgaagtcgcgggcacgatcacggccgtgtcgcccgcgacggcgtggggcgacgcggagcgcgccaagtacatggccaggtgaccgatcgcgttccctgctgctcatcaattttctttcatcttatcgatattaacatcaatataaatataagaaatactagaataacttatattgggaaagggggaagcagttctttgcttgttatccgtctaaaaccagcaaattcgactaaaaatttagttgctcatctcctctctaaatccatggttaaaatcggtttgaactacgaaatcctgctgcaaaaatgcgctaaagctgtgctctgcatgtgc

SEQ ID NO: 12629 - DNA, 1501 bp, Oryza sativa
taattaatacccattgatacttggtcggtactacagtggtactaggtaggtatcatgtgatacaagtgggtacaagggctggtaccacatagtaccacacaaatattaactatttgccacttttacaagtggcaattaaggatttgtcattggtcccatatgtcataggtatatgagagcctatatgtcatagatcgcgagtggcaaatgcttaattaccacatctttaaagtggcaaatatttaaatgcccgatcccgtcctgattatatagcaattggtgccaagaataatattctacgtactggtagcacatacaaaagacaaagataaataatgtatctataaaggcatcaaataagatacttgtacaatataaggtacataaggtagcagaaccatacatatgtatcgcttgataaatctattaacttattgaactaatagaaaaaggagcctccacgttcgctctcacaacctagaaattctcatattaattagagaaaaagaaaaacatagtctatatagaaatataatttacaaatagctgaaattcagaattaataaaatagagaatattaaagaataaactagagtccataccgatatacaatttagaactaatgaaaattcggaattaaaaaaaaataaaattaaaattaggttagtgtccatatagaaatacaatctagaaataaaaaaaatggaattaaaaaaaggaatattagaagacgagcgtagagtccatataggaatacaatttagaaataacttaaatttgataataaaaataattaataactatcacgtatatacaatacagcatgaatgttacacacattagtagtttggtaaagttagtacagaactaaaaatatgttgtcactttaatatattttaataataaattaagaatatatatatatatatatatatatatatatatatatatatatatatatatatataatttgcgcgggccaccatgctagttggaaaaaaaagaaaatttttcaagaaaaaaataaatgagaaatatcggtgtcacacaagtatcatatatttctcttaaaaaatcaaattgtttcaactcataaataagaaatttaaccaaaaaaaggagaaaaataggtaaagatgagaaagaacctatgtcatatggttagcggccccatcatttgacttatttgcaaatgaaaaatcatttgtgaacaaaacttttatatacgtgttcttagtgatctaaagcaaagactgaaaaataaacttcgatgaaaaaaccctaaaatcaactccaaattttaaattttaaattttaaatttggctgataaacatcagcattagtgaaaagatgaggccgtcgttgctcagctaggaaagcgacgtgagttacttattatgtcgtgatttacacgtagcaaaaaccattggcccaccgagcggaagaaccgtgcgtgacatgtgactcgcgtcgagaaaataggagaaggcatgccgttgg

SEQ ID NO: 12630 - DNA, 1501 bp, Oryza sativa
cacttccatacgcaggttgtaacttgtgagtgcttgaggaaaacatgagaggaagaaacaaaaagaactactggcgagtagagaaggtcgctcggtggcaggtatttgaggccgtgatgcagacgaattgaagtgacgtggaaccgacgcagcaaccactctatcggtatatccatctcatcactccatcagcatcaaagctcttggcaaaaccagcactcctgcctgtccaaccaccagagaatattcttcctcgtacatccgccacgtcacgtgatcctcccctgtgtcttctagatctatcaacagattgagcaaatggcttacaaattcacatatctcctctcgtggtaaggttttcctcagcattttcgtcgtgccaactggaagattaagacaggctcaacagccctatcatgttcttaaaaaaaaacagccctatcattgcatttgtagcgtggataagcaataatggtgaacattagacatgattaatttagcgaaatgacgaaatgggtagattatttggcgccatctaactagttaccagctatgcatcgacaccgtagatgtgaaaaaacacgcaccaaatgtctagatcgatatcgaccaactcaccaccgaacagtcagaatcaaaagccatctcttaccttctctcctctccctaaagaaaaggccatccttttactagtgtccttgctttttgcgatggcatccatccataatccatttatccaaagtcaatgcgacgccaggaggcgacagacacgagcgcgcatcgacctggcactggcacaccacaggacaggagcccaggaagctacctataccttgctagcttggcgtcttggcgaaacacccccttgttggatcaatctgctgtgctggtggtgagtcagagttaagagttctaaaaaaaaaaagagagtcaaagttaagagatcgaccaagtcgctaaacaaatgcaggataagacgagcacctcagcatgagccgtcgtcctaatttgcaatcacctgcatttcatcttctactactatcagatccaaccaaacaagcaagggcatcagatattcagatcagtatatcgatcaggggcaatggacaatgcgctgatgcatgtgattccacttagtcatgcgagttaaccaaccggccgtgtgcgcaataatggattaaacaagtactagtaacaggagatttgtggcctagttgcctgaatttatgcgtgacgcgtctcccattattggactacttgacgatgatttattgttaagttgacgtgtaaaattattactgtaaactgccttttctgtaatctttatcagtcgatctctgtctctctctccgtcctgccgtacgtggtttcagaaaaaaaggaaggttgttgttgctatgctggatatacaggattagtcatgaaatgaaggggagttgcaagtgttgatcaattagtgtgtcgaaccaaatcaaccatgtcatcagcagttcttgtcttc

SEQ ID NO: 12631 - DNA, 1501 bp, Oryza sativa
gatatcgatctagacatttggtgcgtgttttttcacatctacggtgtcgatgcatagctggtaactagttagatggcgccaaataatctacccatttcgtcatttcgctaaattaatcatgtctaatgttcaccattattgcttatccacgctacaaatgcaatgatagggctgtttttttttaagaacatgatagggctgttgagcctgtcttaatcttccagttggcacgacgaaaatgctgaggaaaaccttaccacgagaggagatatgtgaatttgtaagccatttgctcaatctgttgatagatctagaagacacaggggaggatcacgtgacgtggcggatgtacgaggaagaatattctctggtggttggacaggcaggagtgctggttttgccaagagctttgatgctgatggagtgatgagatggatataccgatagagtggttgctgcgtcggttccacgtcacttcaattcgtctgcatcacggcctcaaatacctgccaccgagcgaccttctctactcgccagtagttctttttgtttcttcctctcatgttttcctcaagcactcacaagttacaacctgcgtatggaagtgtttagttcccttcaaacatccaaaaatttcatcatatcaaatatttagacatatgcatgaagtattaaatgtggatgaaaaaaaaccaattacacagtttgcatataaattgcgaaacgaatcttttgagcctaattacgccatgatttgataatgtggtgctacaggccgtgtttagttctttggctaattttttttaagtatacggatacacatttgaagtattaaacatagactaataacaaaacaaattacagattccgcctgtaaactgcgagacgaatttattaagcctaattaatccatcattagaatatgtttattgtagcatcacattgtcaaatcatagcgcaactatgctcaaaagattcgtctcacaatttacatgcaaattgtgtaattgtttttttcgttcacatttaatgctttatgcatgtgtccaaacatttgatgtgatattttttgacaaatttttttaggatctaaatacacatacagtaaacatttactaatgacggattaattaggcgtaataaatttgtctcgcagtttacatgcaaaatctataatttattttattattagtatatgtttaatactttaaatatgtgtccgcatacttaaaataaaatttagcatatgaaactaaacaaggcccatatcaaaaaaaaagttacaacctgccattgtttgtacatgcgcgagcgcgacggtttagatagagagcgagcgtgaaataattgtgtaatatactacctccgttctagaataattacatttttaccattcaaattttattaaaaaaaatactccatccgtcctataatataagggattttaggtcaatatgtcacaatcccttatattatgggatggagggagtatttctaccaa

SEQ ID NO: 12632 - DNA, 1501 bp, Oryza sativa
tgaattgagcccaaatcatgcaatcccgaagtataagaaatggaattaggccttctagggtttcgggttgaagaaattagaagaaggggaaagcaaaaattcatgcaaatctcaaacaaatccctaagaaccgaaaccctagctgcagtaagaccccaaaaattccccaaatcatggaaccctaaccctaaaatcatggggaaaaggagagcggcgggcttacctaagggcatgatggccggcggcgaccttcgtgtcgccccgacgcaataagaggcgagcacgcacccgaggacttggtccccgagcggcctcgcgacccgccgtgccggcccggctcctcctcctcgcgtgctccttgctgaggtcaccgtcgccgcctcgctgaggtagccgtcgccgctcgtctcgccgtcgccgccgtgggtcttccttgcgcgagcgaccggctacttagggcaccgtcgagcaacgctcgacggggatgcgcgccggatatggcggcacgcagccccggcgagcaaggctcggcggcgccatctccaccccgtcgtgcgccgcttcgccgtcgtcgtcgtctcgctcaccgtcgccgcgggcgtgagagaaagaggggaggagagaatgggggctagggttttcgcgggggcggccgccgcgccggttttgttccgcatgggagcgatcccggccgtccgatgaagatggacggctcggatcgggtcgctcccgacgcgggctgatgaggccgcacagagaggcagcaaacgccggcccaggcccaggttgatgggcctggagcccaggcgggaggcggcgcggctgtgatgggccaggccgaatgcggcctggctcggggagaaaggcccagctcaagatttccattaaaaaaatgtgtggctgcatagtaacgggctgtatagtaatgggcctaattaaagattgggctaagataatattacaattaacttttttccttttaaagaattatgattatgatcattgtgttcaaacattaaagatattttattatgttttaattaatgataataagaataataagtgactttgttatgtgataaaattcactttcatttatttatttgttttatgatcattatattatatttattacttaaagttattattgttttatgcattatgagtttatttccgctacaaataaatattacaattaagtgtgacaaataattgtcattctggccaaagctgattgacttttatttgattacaaaaattttattaattcaattcaaatctggccaaagctgttttgattgaattaataaaaggagttttaaacaaactgataaagtgtggtttgtatttattattctggccaaagctgattaataaatacttattcacaaaattttattgttcatttccttctctggccaaagccgttttggatttaatcaataaaagaaggtatttatttagctgctgattctctcttatgcagcatcttatgcctcac

SEQ ID NO: 12633 - DNA, 1501 bp, Oryza sativa
caaaatagaccattgtaacacttcattctaaacgtcttttttagactaaccttgtaaaacattgacccacgttactaaaaggggagagtaagtataactttgtgatctttttcatggagttgagtggcgcgtactgatgaagcgtgctagacaggaggctgctctcacttttattcagactagtagcttttcggttagttaccggcagttaattagttagttttgtggctgatatttcttctgatggtccacactgctgtttgcctgtttctctgcccaataaagctaacttaattaattccacacataacctgccattgtgtatgtgtatggttgtacacacttgtattacgtacgttctcgtacaggtacaaataataacaatccattgcatgtgtccatatgtatgcgtggaatgtacaggcaactgcagccatgcatgagactagcactagctattgtgggctcaagctagtggtactagtatattacaagtttaacatcactttgtttacataataattattactagggtcaatttgtactatattattattagcggtactatatatattaacttaacaattttaccgcacttttttcacttaattattactaagggtcaatttgtacgtgtgctatacaatacgatcgatgaggatagtaggtctcgatcttctgatagatattgataactctcgattttgtgaaaacttaataaacatgatccggcttctgatcaacatgattcaaatcctgcaatcatagcaccacgttttctttggttatcaaccgtgcactgctaggttgacctcgccgagaaggctaatctctgcatgcgaatcaaagaacacaagtaagaacaacatagattgcaacacaattgcatatgaatgattaagcactcgaatttagggtttcacaaaccaaactagcggcaaaactgtgatggcagaaataatctaagcaaaacctgactctaaactatgacgactattaaaaaaatatgatttgggacgtcctaagattgccctatggcgcacacccccttgggcttaacccacgacatcgttatgaggcccaagacccaaatcagattcggagtggatgaggtacgtggcttgttttgctgattcccgacagcttggtgcgaattttgacgtgggaccaaaaccatctgaaagtagactccataggctttccaacaagtactcatgatccccgagattctttctagatcagcggttagctccgtttgaagttaatgctgtcaagaggcccaaatccgaatccaaaacgtgtagaactttatctcttatcatctatggaccaaaagtgacgtggtgaggtttgaatggacttggagaaggtattgatttggtccccaatcaacttatttgatttatccatgcatttcttatgctcggtctcatttcttttgcctatgcaagtacctctgcaaaagaaaacacactaaactcattgtgtagcaatatttgtt

SEQ ID NO: 12634 - DNA, 1501 bp, Oryza sativa
aggagactaagccaatcgtctcaagatgatgcacaggtattctaagcaggagatatatcacagaatcatccatagaaacatcacagaaagagacaagagcggtttttttcctgaagtttggatcttgcgatcctactctctgttgaggagctccaaagagctaggtctcaattaaccccttgccttacttgtgcaaaaaccctagaggaaatccacagccttcaaccacaaacacccctaggcaaatttctagaattgagtgaccaccaagatccaactcaacctacttctagaaattcgtcacaagtgtaggttgctctacttggaaaacctctagaatctcagcataagaacttcattaacttaccttgttccctttcggaggagaggagatccttcacaaacttacccgggacatccacaatatgcaacggattctcgcgggcgacactaaccgtctaggagatcatctccaagagtaataagcaccgagatgacagcccacgagatactccaagtgctcacccaagatcctagtcttcacacctctccaaatcttcttctctccctctcaatctctctttctcacaagaattaggctctagattgagcggagaaggcaataaacacttgggagaggctagcaacagctctaggttcgaaaagtgaaagtggaatggccaaagaacaagctggaaacgagctgtatatgtataacggctaggtgacgtcatctagccgttactcacaattttaaactggaaactagacaggaagttccggatctggaagacaggaacttccggactacacttaggaaaatatttttcacaagaccggaactttcggacctggaagacaggaagttccggacttgcacttttggacatatggagtatttgcaaaaattactcttagggaaacttgacacttggtttatactaagagcacttgacatatatcagagcatcacctagaacccctcttaatagtatggtttttcctaaaaacttgatttcaatagataaactatcctatgcacttctcaagttccggtccgctttgattttgtacttttttggggggggggggtctccaagcatccatctttcacacattggactaatgcacctgaaagttacttaatgaactcattagtcacttaaccacatttgtcattaatcaccaaaacccactaggaggattaatgcactttcacccgaattgtcccaaatcgattatcacctccaaatttcatcagtgatcccaattatatatatttattttatagatcctcctatgcaaatacagtgccacacacactttttccctcttgatcattgactcaaactgtgccctacaagtgtacatgttagcatgttaattagagaggtgtccagccaacaacacaccttggacagctagctactccctccgtatcaaaatataagtatttttaaattttgacatagtttttgatatgctactttgactaacaata

SEQ ID NO: 12635 - DNA, 1501 bp, Oryza sativa; identical to SEQ ID NO: 12630

SEQ ID NO: 12636 - DNA, 1501 bp, Oryza sativa
actctttgtgttgattgaatcccctccctcaaccgcaataccgagtataacatcttctccatcttcaaaaaccgatacaaatcgagtccctcaacggtttggtgaccacgtggcatgttgacttggtcttcatgccatgtggtgtctacgtggcacttacgtgtcatttagaaaaataaaaaataaaaaacttagtgggaccaacatgtcaatcaaacaaaaatgtaaaacatagtaggctcacatgttagtcttctctccctttacccctatccactcaacagaagcttgatcgccagcacagtccccttctcgtctcctcgaacatagcccggcaccagatctagcctcttccccatcccatggcgactgcgggaagaagggttacagggagggccgagcccgacagagacaacgacagtttctcctctcctctcttctccctactctctctctctctatctctcttccccttttctctccatccatctcttcgagcggagaaaaagacatcgacgatagtgatgggggacggtaggctggcgagggcctcagctgcgcctgtgatgtagctccgtcgtatcgcccacgacctcaactgtgctgcccagatgtacggtgcagtggagctacgctagtcgattccccctggcggcatcgcggtccccggagagaggccgatgggaagagatctggcaacaaggagcacatggatagagtagcgctgcttggtgggggggggggatccggcgactgccactctggaagatccacgccctttggaggctggctcaatgaggactgagactgactgtggcaggaggtgcacatccaagcattggaaccatcacggtagcgtatggcggcttggtagagctcgtcgtcaccgggatgggaagggggaaatggaggtcggggatgggagtgaagggggaggggacaagaggagaatggatgaccccatcattgtcaaccattatcgcgcttgcaatagctaccgctttcaccgacagccatcgagctcatctaccgaccgcctccgccgttgctgccccatcctcgccgaccgccaccttcccgtggacgagctagagagctcgccggccactgccgacgccggagatttggggaaaagagattgacacgtgggcccgctattttttatttttttcactaacatgtgggtcccatctagtttttttttattctagtaccacgtaagagccacatcatcatcacatggcacgaagaccaagtcaacatgccacgtaggaaaaaaaaccaccagccaaaccgtcgatggacttgcactagttttcaaagatagaggagccattatatccggtactatggttgtaggatgtgattcaactagttgataccccgcgcttcaccgcggaatatatggatgaatgcatcttatacattatagtgtatagaaatgataaatgtacatgtttaaataatgtggagataataatttgacattgattgcatattg

SEQ ID NO: 12637 - DNA, 594 bp, Oryza sativa
taagatactttcttggcgacgtagtacacatggagacaagtctgctagcttgcgtatgacagcagtagtagtagtgatgaaggtttacgtacctacgtgaccgtgatgtcacgtacatgtaagcgctatatacacttatttaattagttcacatgagtgattgacgacctatgagcttcattgtcaaagtactgtaatttggtggctttgcgacctcacacattgatgacagccacacatgtcgtcagtcgtcttcgtatcaaataatgggcatgcaggtagctaacatacagtactagtagtagttctctcaatttcttggaccttattaaattactatacggtgttagttattaccgctatcaaactgctagtactactgagctttttaatgatctactcctatttgtatagagagttaatccagctctatccacatcaaaatcctatatggttacccggcaaaagaaaatcctatatggtttaagatggcacagtgcatatgcatgaaaaatctattagcgtttgtatgcatgcatttgcgtgtgtgggctagacgaggtagagcaagtaacgtaggtgtgtgtatatgca

SEQ ID NO: 12638 - DNA, 701 bp, Oryza sativa
gaggaggaggaggaagagaaggaaggaaggggaatgcgagaggtggaggtgggcgattttatgttgggttgggtttgccctttttttttttcggtttcggttcgggtcggctcggtcgcgtcgcggcaaggcgagagggggtccgtccgactgggctgactggtccgggtcgcctaccgcgtctggttttttcagctacggtttggatggctgaagaaacgtgcgggtaggctctccctgtcgcgtctcgcttcgttgtcgtaggtgatctcgatacggtgtttgcagtggtgatatggtcgacgtattcatgttgttctgcaggagatggacgtgtcgagttaaacgattagtattaccgaaatacccctatttcataaatcttaatgtaattgtttttcactttatcaattctcaatgtaattattttatactagtacttttataaattttgatataatgattacttaaaaatggatttattttaggacaaatagaagaagctaaaaatgaacttactgtgagatgagatgaagaaggttgtgatttctgctttagcaagagattctaagaaaccgctatttattctcataaattagatgagaatttagattatttggggatcagatattataaaagttgtttataacagtagtgtaactccacaagcttctaaaatagatcctcgttacctcaacaga

SEQ ID NO: 12639 - DNA, 1501 bp, Oryza sativa
aaaatttaaattggttaaattaattagaataaaaatatacagtcaataatattaatgtaaagaggtgtatatatattaccttatagtactatataggagttatctctttaagtaacaagaatgtatatacctccccaaatatagtagagaaaaatatgaaagctacttttatattccagcgacattatcctttttattatttagtactccctctgtttcaaaatgtttgacatcgttgatttttttagtacatgtttgactattcgtcttattcaaaaaatttaagtaattatttattcttttcatatcatttgatttattgttaaatatactttcatgtacatatgtagttttacatatttcaccaacttttttgaataagacgaacggtcaaatatatgctaaaaagttaacggtgtcaaacattttgaatcggaggaagtagtaactataaaaaaaacggggatattaaatacggagtataatgtacaggggaatgcaatcgttgtctgtctcaactctcaactctcaaccaagtaaaattggaatggttgtacagtgctagtcctcaagatgctcttaattcttgcctcccacatgcgccactagctagtgattgacttggatgtttttacctgatgcgcacgctacgaatatgcttaggtttattgcattattaggagggttaacagtaagttcaaagctcagactgtcgcccatttatcaaagagaataacactgctttattgctgggagtcactctctagaaaagaaaacggattaaaaattacctttcaaattcaggctccttttttactgaaaaaaaaacttctttcaaatcaccttgtcttttatgtttatcctaagtcaaaatatgcatatctttgactattaatcatttgaaatccatgtagtttaacaacatataaattatatacttaacaaaatacgaaagtatttctaatgatgaataaaaatataaatgttcaaatattaaaactataccattttataaaaattgatgatccaaaattaaaatgtttgaactagcacaaacctagaacgacagctaatttgaaacagagaaagaatgatgagtctgtctcaaccagggttcactttctcgtcggtaaccgcgcggtaaccgcggttaccgggcttaccgtggggggtcggtaacaaaaaccggcggtagggtttgggcaaattttgctcaaattcaaaaatttgaaaaataatccaaaaaaatcaaaaaaaatcatggatgtaaagcttgttttgtatgttgttatggtgaaaaaatttcatcaaaaagatgcaggtaaattcaaatttgagcgcaaaacctattgtgaattataaaaaagaaaaaagattaaatggaatgggccaagtatgcactgttcacgaggcccaataaggcccacaatgggaggaaaatatctttggaagcctctgcttcgtttctctggcgaatcctactgtttttcccctctctcgc

SEQ ID NO: 12640 - DNA, 1501 bp, Oryza sativa
atttgatggtggtatgataagcaactaaaatatatctgtacgcattgggagtagggatgaaaacggtcggaaacgatcggaaaacagcctcaaccatttccgtaaccatatttttctcggaaacgaaatcggaaacggtaaagtcggaaacgaaaacgatatcggaaatatcggaaaatcggaaacggaacaatatggacggaaacatgtcggtacagatcggaaaccggtaacaaatacggaaacattaaactataaaaacatatatttaactttacataagtatgttatatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatattataagaaacggtaatttccgcgagaatacggtaaatacggaaacgatcggtataacagcaaaaccatttccgttttcatttccatattttttaccatttccatttttgtttcggtcgattaccatttccatatggctcggccggtagaaagtcaaaaacgaacgccggtcggccggtaattaccgttaccgttttcacccctaattgggagaaagaaacaagcatgggttacacacctcttttcttccatctcatatatcctgcttctattttttgatgaatcgcaagttgatgtttcgttaaactatttccacacaggctaacataggagaggatggcaaacaaattagaagaagattgttgcaatctaaacacacacacatgaagactgtgcaaacctgcgagcatgatcttgttttctctgtttttactgcagctgatcgcctcaccctcgtgctccacggagaagccgatcgcctcaccctcttgccgacgcctcacgttcactcgcgggaaaagcagatgggattcgcgccaaaaaggaaaagacggcgccaaaaaggggagcaacgggctgacgatggtgtgcttgttgggcctaggcccagataacaaaggagcgaagcagccggacgtgcagctccacgcaaaggcgttcgatcgtgagctgacggatggattcgcgtgactgctctctaccatcattccaggtcaagaggggaggaagaagagagggaggagatgacatgtgggcccacatgtcagtgggccccacaatttttaatatgtgtgaatgacaaacgggtcccacgtatgcgtttttaattcaaatgccacctgagcgccacgtcaacccacatcctaggtcaatattgctacgtcagcgaaaccgccatctaaaaccaccaagggagtcaaattgcaccggtttcaatagtttgagggtcgagatatccggttttgcggttaagggccatggattagatttgggccacttttaagggagtcaaagtggacttattccttgtctctatgcct

SEQ ID NO: 12641 - DNA, 1501 bp, Oryza sativa
  unsure (1)..(1501): unsure at all n locations
ggggaatttacatgattacccttatgaaagggacatttacaggggtacataatgtcataggggctcatgggcccccgatgggccgtctggcgatcgtcggcctgatgggccggaggggcttcctcagccctcgcgggagcgaacttgtcaaggcgaagtcatcctccttcggcagacagtcttcgccttgcacccttcgcctgagacgcctctggcctggcgctactcttcgccttacgccgttcttgctccatagcctacgccatgggtttcggcaggttgggtcgaagggcctcatgccatccgccaacagaaataattcaacaatacaagtcacaccatgatctattttgaaacatgtatagctaaactcacactatataagcaagaataactagctgaaatatagataatctgagccactgcataagcaattgagtgcctttaactaaagaaaatattatgtttttttctaaatgtgctcaaataatccaaacaatctaaatgatcttctataagttttgattaatattctgcctttataagtttctcaaacacagtctacgattcatgcccacgcgaacgcgtgggctacctttcttgtttagtataaatactgcctaattgcaagcgttaatcatcacctctgcatacagtcagatagctagccaagctgagcaggactaagatcactcgtgaattcggagataccatgggaagtgtaccgaaaaaaggagctgcctttgctctgccggtggccattgcgaccatcgtggtggggaccaccaggaagatggccgcggacantacacaagatcctcacattttttacggcatatctgtgatgggctttagcattggtcagtgataagggtcacctttgacgggttctacgggacgcggtcattggtaaggcatctttttccaaccggtccaaggtactaattacctgtgacggttccatagtagaaaccgtcaaaggtgaggtaaatctcacctctgacggcttccacatccggcccgtcttacctgtgcgggttgcatccttataaatcgtcaaaggtgaggttaactcacctcaaacggacccatcactggagcccgtcacaggtggggaggggggctgactagactagtagatggagatatgtactcccttatccactctctctcttatccactgaaacaaaaggacctctctctctctcccttatccaaactcacagaaacaagaggggaggctcttgcggcggcggcggaggacccgacggcccccgggagaggcagcggcgtggcgacgacggcggcgccgcggcggtggttcggcggcgttgggcgacggctcagcggcgcgtggcagcggcggtggtgcggaggcgcagcgtcgaggtggtgcggcggcggcgctgggcggcagcggtggtgcggaggcaaagcggcgaggtggtgcggcggcgctaggcggcgagcggcgtcggcggtacccacatcctcctccccc

SEQ ID NO: 12642 - DNA, 1501 bp, Oryza sativa
ccttcatgccggccttctccacccaccgccgcccacggcttcgcacactcccttgccactctccgctccgccatccgttgcctcggcaagctctccgcgctgctcgccgacgggaagagaaagagagagataagggagagagagggggaggaagaaaggttgggaagagaatgacatgtggactccacatattagtggatcctattataatttttgtgaataataaatgggtcccacatatatatttttaattataatcttacatcagcgtcacgtgggacgaagaccaagttaacactgccacatcagcgccacgtcagcaaaaccgcccttcaaaaccattgagggagtgaatttgtaccggttttagtaattgggggagtcgttctaaccggttttctggttgaggggtacgaattagattcgttgtacatttaagggagtcaaagtggactttttccattgatattcatagctcaagctataatgggctggcccaggtcgtggcccaattttgggtccgcccttgatgaatgatgatcaaggccggctccaattatggatccgccccctatgaaaactagaatagagaactttgtaaaataaatctatatttgttattctaatggctttaaactaaatatttttaaagttattgatagttgaagttataaaagtttgacaacaataatatccaaaacaccaagaattatgaaaccagggcggaggtagtaatcagcaacagcatcataatcacctaaataccgagctcatgtgcaactacttaacacggtggcacgatagtatcaagggagtatattttgccacaatataattgataaagtgtggcatgccacatattgtatggttatgaatgtgttagccacaattgtggtaaaaaaaatcattcaatgacaagaggactagtcttagttgatcaaacttttttgccacaagtttggctaaggttgacactaaaccaaacaggccaattcagtcattcagtgcacatctatgttggaaacactgtaaattcatcagccaagcttttgcattcataatgtccaaaactggttataaaccgtaactgttttattagcaattagaaaataatttatctaaaacttctatatgtgttcttaacaacttagaaatcaatgtaaaatgctatgttaaaaatatcttaaaaatcaacttcaaaattaggttttaaattttaaaatttggctttgctttagctttttagtgtaaccaatggggctggcgactcatttcaaactaaattcgcaacaaataatccatggctgatgtgagacaatatgtgaatagcctaacctttttgacaaagtacattacagcacaatttctagtgcaaatatggtaaaatttatctcgcaaaccattagcttctaaatatttacacaaacgcaggcgctgaaaaaagctaatgatgtgctccaggaacacaagcatgccttgttctgcagctatgccaggtgat

SEQ ID NO: 12643 - DNA, 1501 bp, Oryza sativa
ccgccggccacgacggggaggcggcccgccgcgaggacgcgggcgacggcggcggccgcctcgcgccggaagtcctcggcggtgaagtcggcgtccgggtggaggacgccgaggaggtggtgggggacgccggcgcgctcctcctcggtgaccttgttcgtgatgatggggaacccgtcgtgcacctggatcttgtcggagttgatcacctcgccgccgaaccgctcggcgatggagatggcgagcttggacttgccggtggcggtggcgccgagcacgaagacgaccttgggcttgggtgactgtccgatgacaccgccgacgtggtactccattgatgaaggtgagctgctcaccggagaagaggtatataagccatcgttaattactttttgcaaagatagtaaatttacgacctaaaatgtacgtgcactcgatcattcttactcccccgtcccaaaatataatatacgagattttagatggatgtgatataagtttgttcagattaataatattaggatagctaagagcttgtgctttgtaacggacaacaaattgagtttctaatttattaaatcaattaacaaacacttatttagtccaagtactgagagccaacggtgaaacgggggaggactcgttaaaagataatgtaatggtatagattgtggggctcacacggtagtagtagagatggtgtgggaatggacaccaccagaactactaacattttaaggactatagattacatctacccaaaatcatttacattttgagatggaaggggaacatatactatatttaaatggttataatacattttctaaataaggattaccagaagacactataccattccagaatggaatactttatttctggcatcaccataacgccagcatggcacaaatttggtacttatatgatactagcattagacatgataaacataggaaccatatctaatatcggggtatcatacatgatactcataggtaacagtatttggtacctagatcccatgctgatgtcatgatgatgttagtaaaataaaccaccgttgtaacgatatagcatttttttttattttttttgttttcaaaaacagtaatgctgattgtaaatgatcagtttgatgctaaattacctatatatcatgataattaattgtctctagttaatttgttgtgaacgagaatttaacataaaactagcaatgcaagttcatggaacaatgtgggtgcacttccaaattatcatgcatgaaaaatacatctctgcacaatttgttaatcttacagtcgaaaacattaaatatcatgaaaagcattgacaagtaattaatcccccatatagattattcgcattgaacttccttattttactttttttaagagaagttcacggttcatgaatgaataataaactcatctgtggtcaattttccatcaacttcataaaaccaatctataccaaaggagaaaaggatgacagtacg

SEQ ID NO: 12644 - DNA, 1501 bp, Oryza sativa
acctcccatctccccagctcgcatatattgcacgcaccgctgtcgaggggtgggcccctgccaaggtccatgtgtgctcgggtaagctgcattgattaatcatgcatgtactctcgctagctacacacatgtcgatcgatccgtcagtttacacattgtggctgatcagcgagtgtgtgtgtggctgtgtgctgctgctcgctagtcgctttacagcaaacatgctggcaagctgcgcagtgtattatatgccagatgcataatcatgcatgcatgcaggaagggttgattaattaactaattaatatcactagattggtataaagggaactggccagttgattaaaccatagtcgatcggcgcattcgtactatcatgtggacaaatctatatattcaagcatgctagcgcagtagcgcgtgagtgaagatacataatatactcactcactcagggagcttcagttgtttgatatactcagggagcactaaccttgaatggttaaaaattgaacatcacataagctagcttagcgcaaggctaatagtataactcgctactagctccaattcatttatagtcaatctaatagccaattcatataataattgcttactatactattaatatatggtcccacatgtcatacacacattacatattggagtccgcgctgcagctggctacagatctgtagcccgctgttcttctctctcatagcaagtttaatagtatagcccactactagcttcaatttatctatacccaatctaatagccaattcatacaatagttacttactatagtattaatatatggtcccacctgtcatacacacatcttgtattggagtccgcgctgcagctagctacagatatgtagcccgctgctcttctctctcatcctttatctcattaaaatatgtttacaactagttaatagcttgctattgtacttgctctcatcttttatctcattaaaatatgtttacagctagttaatagtctgctatagtacctgctcttactggcacatcggccttggccttgaaatacgtgtcttacgtacgtgttcttgcagtattgtcctgcaatgcttctagaatggctgcgccaaatctgggtaactacgctagattgcttaagctgatcatatggatgatctgttgatctcttcgatccggcggacggcggtatatgagtgtatctgtcatcaataaaccgagttccattttcatcgcatgcaataatttccaacaaggtagccaacggtcaagcgcatgcagcttcattatggccttgtttggataacatatacaatccgccccagtgaatttagttcaaaatcccggtcaatttcatgggctcacggccttccaaacaaggcctcaagggcatgagcaatatgttggaggaataagttcatctgacatccctcaattgtacgcagagtctgtttaaggtcccctaacctcaataccagaaatgtatacccctaaac

SEQ ID NO: 12645 - DNA, 1501 bp, Oryza sativa
tcgtcggcgaggggggtgtagaaccaatcgctcttccagtcgtcccacttcttgcggaggacgcagggaatgtagcggtgcagcacctgcccccgcggctggaagtagcagccaccaactaccgacggcggcgacaccggctgtacggtgaagaaccaccggaacagccagagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccaggtagtgtggcgtcgggcgtccctcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgatgccggcggaggaggagcttgagagcgagtgagtgcggcaagggtagggcacaggaaacgaagagttagagctcaagtggagaaggcaaggggaagaatggcgagaggaaggaaacgaatctcttcctcggcgtctttatacccttgccaacgctattcccggctcctcgtttcccgcgcccactacctcgccccctcgtttctcgcgcccacgcctccactaacccaactcgctcgtttgcggcgcacgaggcagatgtgcggccgtagcagttgagatgggacagatcgtgcgcgcattaaccacgctcgccaaacgcgaaaagcgccatcatcacgtctccaggcgaaacgaaccggctcgtcccgattcgcgcgctgctcgagtgatgtagcggtcttaaagaggccgctcattattgtcggtcggttttcccttgccgatgcgcgcgacttgcgaccgatgggttcctgcctgcctgtagggaccggccccacctgtcaccgggcctaaggagtggcgtcacgcccgagcgcttccctcgaagggggcaatcgccctggcgtaacgccgggggctattgtcggtgacatggggccgagggtatcgtgactagaggtttgggtagccgcggtcacccacgtggcctgaccccctcgggggggtcgggcccgaggatgatgtggccacccctccctctgtctccccgaggggtcgggccgcccctgtttcggccccgagggctagggcgccccgaccccctgtgattttggcgccacgtgtatgggttaggtgagcacagaggggctcacctaaccgcatttattgcgggttggacgagcgcgccacgccgcatttaatgccgcgtagcgcacgcttatccggtccgtgaccggtcgcagtgtgtgaccggtcacagaccggtcagatcgcgggttaggtggcaacaggcggcctgtcacacgcctcgccccgtcccgtcggat

SEQ ID NO: 12646 - DNA, 1501 bp, Oryza sativa
acgtattattcatcgtttttcctttagatgtatgtagaacagttttttttcctaattccggcccacaggaggtgacggagcgtggggctcctcaccgggagaccgcccaggccccctttgccggttcggccgggggcgctaagtgaggttcttcaccctcgatctgtggaatgttcgcgagagagcaaatgcacaagacacgggcgatgtagacaggttcgggccgctgagaagcgtaataccctactcctgtattctggtggatctgtgtgtgaaggagttacagagagccggagagcaagagagttcaggctctagaacccctcttcctctttctctcctctatgagctcaggtattctccgagtcgtcccccctttctcttctccgtcctttacttcggtgggcaaggtcctccttttatatctcaaggggataccacatgcaccacttctacctactcttcttttgggtggggactcaccctatcttgacccaaacttggctcgcgccttcgcctggaagctaaatcacagctagtccttgagtaaggcccagtgccgtcactcgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgcctatgacgtgaccggcgtcagaccagtcacagaccggtcactcttgtccaccgcgcgtcagtttagcatgccgcacgtctgcctttcttcatacaatgacttccttgctatggttgcgatgaagcctggaacgaatctggccgggactgacataccaactccaggagttagcacgccggctccggctagggacgagtgcctggaggctctcatcaatccgacgggacggggcgaggcgtgtgacaggccgcctgttgccacctaacccgcgatctgaccggtctgtgaccggtcacacactgcgaccggtcacggaccggataagcgtgcgctacgcggcattaaatgcggcgtggcgcgctcgtccaacccgcaataaatgcggttaggtgagcccctctgtgctcacctaacccatacacgtggcgccaaaatcacagggggtcggggcgccctagccctcggggccgaaacaggggcggcccgacccctcggggagacagagggaggggtggccacatcatcctcgggcccgacccccccgagggggtcaggccacgtgggtgaccgcggctacccaaacctctagtcacgataccctcggccccatgtcaccgacaatagcccccggcgttacgccagggcgattgcccccttcgagggaagcgctcgggcgtgacgccactccttaggcccggtgacaggtggggccggtccctacaggcaggcaggaacccatcggtcgcaagtcgcgcgcatcggcaagggaaaaccgaccgacaataa

SEQ ID NO: 12647 - DNA, 1501 bp, Oryza sativa
tgtttttatggtgcggtccatatagcatattctttcatttttgttttcaaatatgacattctttacttcttactatctcataactttgtttgtggcatcgccaaacattgatgttagccgatgtggtagactttttcaccacgtcaatgatatataggcaaacacagctactttaaacatggggtaaattgaatagtttgaatagcttaggggtgttggatatctgattttagaggtgagaagattgttttacacggacgctataaaacaatagttggcttagttttagctatcttatctagaacactgaatcactaaagtttcttgcaaaattatcgtgtcacgtcatgaaacaaatatgcatgagccattccatttttatggagatgttgcaaaccttctttcacaaataggcctgggctcctactctcccacgcccctgttgtgaaaacaaaaaagctgcaaaccgcctcatcttatcgtcatcacgctgtccacggcactgcctccaaggacgatagactacttcaccttttactccctcttccttacggccaacacatctttctcctcgccctgcctcctcctcttagtggtagatataaataaataacccagtctacttgaggttatggaaaattaacaagcaaggaagaagccataagccaatctaacgataaaaggagcaaaaataataggagagccttactacttcctccatttcacaatgtaagactttctagcattgctcacattcatttagacacatgtatgtgtctagattcattaacacctatatgtatatgggcaatgctagaaagccttacattgtgaaacggatggagtatattacaagcacgcatgaagaaaacatcctactatacataatataaagtttatggccaatattgcaatggcgttttaagacaatcacaacataaattacaactccaccaacataaaagttgttataattgtagtgttataaaacaactttttaaaaaaatacatatacatttgcactaaatgaaaatctaaaaacagacttccagctaaccagaactacaatattatcttttttttaaaaaaagagagatagcaaaaaccccaaatcaccaaagagcgcaaaaaaaaaaaaaacctaaacctatctttatcatacccacaccgtccacacacagcaaacaccattcccacccactaaaacccctccacgtgtcccccccgaacccaacccacctcccccccagccacacgcccgcacccgctcccctcgcgcacggcccgctccccttgaccgccacgtgtccccccactgacatgcgggccccaccctccacccacgcccttcctcctcctcctcaaatgaatccccacctccccctccccaccaaagccgcgttcgcatccgccgccgcagccgcagccgccgccgccgacgccgacgaggagaggaggagagggaaggcgagagggaggtaggtaggtaggcagttagcca

SEQ ID NO: 12648 - DNA, 1501 bp, Oryza sativa
gaaagatataaaaattggctagaatattgttccatatgataactttttaatcagaatttgctatatatatgtcacaaattttactttgggccatattttattatgaatgttttattttagactaccctttaaccaatattttcattttggactgggtaagcatatcaacgatctcagatacgttggctcctaataataaattaactgtcacaaatataagatataagatatagcctagtcaacaacgaccctaggaaataaactggagagatcgaaaggagccacagcagagggtagactgatcatgtataaactttctaatttaagggttagaaggacatggttaatattttttttatgtacgtacatattcatgttttttttttgcaaataatagtctcctgtacatgcatataaacatacgtatattttctccgggagaatagtatatatttatttttctctcttgcaaatacgcatgagattaggagagagaaattaattactttagtatgatctaatctaatgattgaaaataatagttcacctgtatatgcgtaaatcaatggttcaatgtttaacttttatttttttcagaatattttggatttttattgatcttaagttatcagttactcccaatctaaattaaattgtgaccatttaactcaccatgtttatgttgaattgctagctataaaataggccaatagggtgttgagagaaaaggagatatatgtgggctgcacgtacgtatctgaagattttagatttttttttgacatggtacgtgacagagtatgtacaaaaggggagagagggttacgtgtgggaggagggaggtggatgtggaaagattttttttaaactaatctgacggcttgaaataatgggtccaccaatttaagtgaaaacggatggacagatgttttgcttttttcttagaatttctaggaatttctctaatttattagaacgccatatgacgacttagaagcgtttataggagaccacgtggcggcttgagagcgtttataagaagtttaatggacttttagtatataatagatagaagatatttgtatataaatattttttaaaaaatacaccgtttagcagtttgaaaaagcgtgtgtgcgaaaaaacgagtgaggtgactcggccggggggttagaggcgcacggcacaccccgcgacaccgtcacgtgcccacgcgcgcggccacggccgacacacacagccagatccatcgcctcgccgccgtgcctccgcgagccgcgtcctcacccgcacgcaatcaccgcgaaaacgcccaaaaaccccagcaaaaacacccaaaacaacaaccaaccccgcaccccgcgcagcagcacaagtccacaaccgcttccgctttccgctgcctccgctatactacaaaagagagagacgcctttggccttttccgctttaaaacaccacacagtgacacacacaccgcgagcgcgccgctcgcgagtag

SEQ ID NO: 12649 - DNA, 1501 bp, Oryza sativa
tccctaaattgggaaccacaactgatcctcccgaggagtggaggacccgccatggctcatacctcgcatccacgccgcgggaggtgccctggacgcccacccctcggctgcccggccgccgccgaggatgatttttctcctcttttttttttaattatttttcacttctgtgagctttgggcagcccttccatgttgcaaaagttgtgaaattcctagcttggcagttgcacatatcgatttcaatcgaggctgcctatacatcatgtgacatattttttggcctcctatcatacagatttcttacccttcagatcaacatctaatggatgacattaatatacacaaacaaaatacaaaaaacaaacaaacgggtcacgtggacaaatctaaagctcacgtgggctcaaatgggctcaagtagatttcaaacttacatcgtaaatacactaaaattacatatgtaattttcagacttacatcgtaaatacactaaaattacctatgtaattaatatgtaattatagtgtaagtacgatgtaattagtacgtgtggggatcataaacaaattaactttggaaaacacgtacggctagtttaacaccagggaacagtaacgtggacctagttaattagcagctagatgcaagcacggatctcacaaaccatcctacggctaaaaaaccgaatgattgaaggctcataaatctgtcaaacgatggttagcgattccgatttcaattacctaaagtaatgttttgaaatctagcacaagttattgctcattgatgctcaatgcattcgagtgaaattacatttactgagaccttagagctatctatgataccattttatatcgtaacaccgctctttagtctttacgatggaaccaagattgccattcaaccttgttaacctgtgttcatattgggagtttttcttttctttgagcagtggtcctcttgttgctattttaagatgatctcatgtaaagattgaatttctttgttgaatggcttcttttcagcctctccttattttctaggtttagcagtgatgtgattagatcatgggggacccaggacaaaataaacaatagtttcagcttcggaagtcttgtctctgctgactatcgatcattcatctcacttcagttgtcattttcactagaactaaagctatctcaacaagcaaagcaccctcctttgatttgcagctccgtctgcatgcttaaccttaacccttgctgatgtcctctatgcttgaagagcgctcttgatcccattgctaaggaaaacatgaccaaaatgatcattcttgtgacttccgctgaaaaaaaaaggacaacatcataccccactgtaacacataccacccaatgatgctggtcagagctaagttatctccctagtggtaatgcattggaaataggaagagatttgattttgttctatttaagcatatcttcatcttctgcgaaaacttatatcctttaaccagt

SEQ ID NO: 12650 - DNA, 1501 bp, Oryza sativa
tgcaaatcaaaggagggtgctttgcttgttgagatagctttagttctagtgaaaatgacaactgaagtgagatgaatgatcgatagtcagcagagacaagacttccgaagctgaaactattgtttattttgtcctgggtcccccatgatctaatcacatcactgctaaacctagaaaataaggagaggctgaaaagaagccattcaacaaagaaattcaatctttacatgagatcatcttaaaatagcaacaagaggaccactgctcaaagaaaagaaaaactcccaatatgaacacaggttaacaaggttgaatggcaatcttggttccatcgtaaagactaaagagcggtgttacgatataaaatggtatcatagatagctctaaggtctcagtaaatgtaatttcactcgaatgcattgagcatcaatgagcaataacttgtgctagatttcaaaacattactttaggtaattgaaatcggaatcgctaaccatcgtttgacagatttatgagccttcaatcattcggttttttagccgtaggatggtttgtgagatccgtgcttgcatctagctgctaattaactaggtccacgttactgttccctggtgttaaactagccgtacgtgttttccaaagttaatttgtttatgatccccacacgtactaattacatcgtacttacactataattacatattaattacataggtaattttagtgtatttacgatgtaagtctgaaaattacatatgtaattttagtgtatttacgatgtaagtttgaaatctacttgagcccatttgagcccacgtgagctttagatttgtccacgtgacccgtttgtttgttttttgtattttgtttgtgtatattaatgtcatccattagatgttgatctgaagggtaagaaatctgtatgataggaggccaaaaaatatgtcacatgatgtataggcagcctcgattgaaatcgatatgtgcaactgccaagctaggaatttcacaacttttgcaacatggaagggctgcccaaagctcacagaagtgaaaaataattaaaaaaaaaagaggagaaaaatcatcctcggcggcggccgggcagccgaggggtgggcgtccagggcacctcccgcggcgtggatgcgaggtatgagccatggcgggtcctccactcctcgggaggatcagttgtggttcccaatttagggattggaggaaggggatataggtgcgtgccgtaccttgaggacgaggccccggagccgctctctacggcgacctcgacatctccggaggaggacggctggtgcggaggaggaccagccatcgagagagcggagaggaagaaggaacgggagagaagggcggcggcgatcggcggtggatggccggatgcggccgccgccggcgactctcggtggcgtttgggtgttgaatgggtttattacgggcaaagccatcgtggcaggttattctgttctactatagatggcca

SEQ ID NO: 12651 - DNA, 1501 bp, Oryza sativa
tgggctgtgtttaaatggctggaaataagtctatttttgatccctcaactctgtgggttgtgtttaaatggctggaaaataagtctattttgggccatgccttatacggttatataagtctattttttatccctatattttttttatttgatcgggccgtgccgggccggcccaccgtgccgagggtgcagcccaggcacggcccggctatcgggccgggccggcacgggcacgaccctagtcgggccgggccgtgcttgggccgggccaaaattgcgggcttcgtgccgggccgtgggcctcgggccatatggccatctatatgttctactccctccttccaaaagtctaatacctatttcattctttagttttttcaaaaatctaaatcctatttgtagttattatatgctaaattaaattattgatagaaattaagaaaccattttaatgcttattggtaacatatttattggttttgtcacatggtgaatgaattaattacgtcatgctcttggtaaaaaaataaatagaactcagatttttggaaggagggagtatttcttcaactccaacttcaacttcaaattcctcattttccgttagcacgtttttcaagctattaaatggtacggtctttttaaaaagtttctatgtaaaagttgttttaaaaagcaaataagtccataatttaaatttataatagttaatactttattaatcatgtgctaataagatttctcatttcgcgtgcaaccaaaatttatctccatgtgtggagatcgaatgggggccttagcagacatatacgatatcaccatagacattaattatacatcacctgtattgcaaaaataaatagctgtaaatgcgattatccgtatcaaatctatgatgttaacatcggtgtgtaggttccaccacacaagaaatctaaccaattgagttacgcttacttcgcgtgacaagtggctttcggctaaatgccacttatcaaaaaggatttgataaaataccactatcaattcgggactacatgtctacatgttagaatactatctgggactaaggccctgtttagatgggactaaaacttttaagtccctatcacatcggatgtttgggtactaattataaatattaaatatagactattaataaaacccatccataatcttagactaattcgtgagacaaatctattgagcctaattaatctataattaacttatgtaatgctacagtaaacattctctaattatggattaattaggcttaaaaaatttgtctcgcgaattagctttcatttatttaattagttttataagtagtctatatttaatactttaaattagtgtctaaagaaagagactaaagttaagtcactgatctaaacaccacctaaattgcctctctactcatcttcttccttcttccggcactctgtcaacttctcgtcatgctactcactgacgtcatcatcgtctgggctgccatgtca

SEQ ID NO: 12652 - DNA, 1501 bp, Oryza sativa
cggacaagaattgtgctgttgtacggtaatatagttcctctcactgtctttttttttgaacggaaagttcctctcactgtcatgctatcatatactccctccttccctaaatgtttgacaccgttgacttttttaaacatgtttggccattcgttttattcaaaaacttttgtgatatgtgtaaaactatatgtatacataaaaatatatttaacaataaatcaaatgatagaaaaagaattaacaattacttaaattttttaaataaaacgaacggtcaaatattttttaaaaagtcaacggcgtcaacattttaggatggaggtagtatatcttctccactatcttaatatatacaagagcatcacgtatgtactgcagaatgctcgatcatatgcatgcccttcagaaaatatacgtgcaaggattgggtggtcaaagcgcacatttatctgttgacacctaattagctatattgctagctatacgtacctgtcaagcggcatgtgtactcacgtaatcatctggatcagaaagacactttcttttccttgcggtgcaagctctgggtttgactattgaccagtcgtataaaatctactcccattttggttggatgcgagtacaacgaatttatatataaaatatgtccagatttattgtactaggataaatcacatctaaccaaaataccttatatagtccagattcattgcactaggataaatcacatctaaccaaaatctcttatatttagggacagagagagtatgtactacacacaagtttcttaattgcacgtatgtatactagtgttctactctaatactgtagctgcacaggggtattgtatactccctccgccttaaaatataagtatttttcgactttgatatagtcttcgagattctattttgaccaacaatatatataaaaataaaatgttgtaaataaaaagagttgcatattataatagtttgtttatgataaatctagtcatatcaattttacacaattgaccctttttatttttgttttgctattagtagttaaagtaaaaattaaatacctaacttgacactatgctgaaaatctcatattttagtacagatggagtttatgacttcgatcggggatccaattgtgagggacgtatacttgttctgggagtacgagcatcaaattattttgaacaaattaagcccgttggtttcagctccttgctacgtcatcaaattaattattactgcagattatttgattcacatctttaaaatatatttctccaaagactttcttctaccgtattacttaggccctctttgtttaggtttataagccaacttataagtcgaaaagtttaagccaaaataaacaagcagctttttcatttggtttttttaagccataagccactctaacactattaagccaaaagctagattggagaagctttttttggcttatatgagatagatatatgactctaccattaaactta

SEQ ID NO: 12653 - DNA, 1501 bp, Oryza sativa
ttacgctgtagagccatatctgggagcagcgggctggccagcgcctgaagtaccatgttaggattaaattaagctttctgtagacactgtctctcgctagtaaatcctctcttagcctatcttagctttgtgtccttggataaacctggagaagagctgacatacatgttcatcggtatcttccgtgctgacatacacattccctgtgaaaatcgatgccttggaatactctagagtgaagtgctgtattgatatcttccgtgcgcttgtggattctatttgtgacgttaagaaatatataccaacactaagacaaaattcacatagctagaataaggtctccgagtactttgattcccatagacaccattttgtgactaatactcgcttattgattgaacaagcatttcggtacaacattttgtaaactaggctaattagaaagaaatgaaacttagtctagatgcacaaagataaggcaagttattcaatcataccgatttaattaacaagttttagattatccgattaccttccttgacgattttcaagatgtcctctcaatgaaattgataccttatttcaattgaatttgacacccattgtcacacacaagacttgcatatttatatctcttcctatctccattttttaagtgccagttctttacatatttttcatattcgtaactaagtaggaactaacaaattctgctatttttggatttttttttacttttttgcgcgagaatttatgagtgccaacaaatacacgggacctatttcatcatgcatcgacgaactcatgcaagcacggagggtggattttaaactgttatttgcatgttactcaaatagttatgaaaaaaattgagaaagatgtattaatatgttatatgtcacttcacaatcatgtaagtttaaatttaacttatacatatcgcaacgaaaaaaataaattaaactacggctagttaacgtatattcacagtcaaatttggttttttagttgtgacacgtagaagttgaattttaacttttatgtttgtggagtgatatatatcacatgttgataaattttttaaattacttcagattttcttatattaatgacatataaacaatgagatggcatcccctcgagcgtttagaatagttacgtgtaagtacgcgacaatgggttctctcgtgcatacacgtcaggactccggacatgaacccaccaccattagcatctgacagataccccactgaagaaaacaaagatcaatttgtcacgatgtactcattggctgcacgcgattaattatggttgttttagaacatcattaaggagaaactaatacagccaaaaccatacgcctctcaaagatgcctctgaacgatacctcaatgcttatctccatctacactgttggacggttcacaagcctatttaaccagcaacgcttggcacactacgatcaactgcgagagtgaggcaaagaggaagtcagggaacg

SEQ ID NO: 12654 - DNA, 1501 bp, Oryza sativa
cagctgagtctctggatccagtttaccccatggatgacacacatcactgagaagtgagaagtctcatatgcctgggccacgttgaaacagacgttcgtattatctgagccatccatctgtcggcatgtgtgcaaattggtgttttccgtagcgctctgaattgtgtggctctctttgaaacagccagcatctaaacacaataatacgagtagcacaaggcaccggatcttctgcacggaagaactgttttgcctcgtcccaagttgaaatgtcatcgtccctgtcattcgagtattaatcgactgtcaatgtaggcgttagcttacgttgcagttggttgcagcgaccattatgttgaaataaacgtgtttatgataaagtaataagggttcagaacacatttaagcaattttctttcacttttttggccctgaacaattcaatagccaatagtagagctctgctgtggttgtgcagccgcagccagcgctgagctgagcagcacctaaatttatataaacagcagataaatccacacctactccattcaaacaaagtactaaagtacaggtagtatagtacaatgttgtgagtacaagaggcgaagtccggtgaggtgccaccgtgccacatgcaggcgtggtaacctggtgtccactctgcatccccgcaaaatggaaaattcaaacacaactcgacgaaatgctatccagaccgtagatgtccctttgtttcaatgcttgctgctttctttctttcttaggggctgtttagttcgcgaaaagtaaatttttaagtatcacattgaatgtttgaccggatattggaagaagtttttggattcgaatgaaaaactaatttcataactcgtctggaaaccgcgagataaatcttttgagcctaattaaaccatcaatagcacacggggttactgtaacacttatagctaatcatggactaattatgctcaaaagattcatctcgcgatttgcaattagtttttatttatatctatatttaatgctccatgcatatgtccaaagttttgatgtgacgtttttgggaaaaaatttcgggaactaaaccaggtcttaggccttgttagttggcaaaagtttttgccctagcgtgtcacatcggatatacgaacacacatttaaagtattaaacgtagtctaataacaaaacaaaatacaaattccgctagaaaactacgagatgaattttaagccaaattaatccatcattagcaaatatttattgtagcaccatattatcaaatcatggcgtaattaggcttaaaagattcatctcgtaatttacacgtaaactgtgtaattagtttttttatctatatttgatactacatgcatatgtccaaacattcgatgtttttcttgtgggaactaaacaaccccttagttcaagggcgatgttacgaactccatcagtcccaaaataaaaaaactcaggatctgtttggctagtgactgtagtttag

SEQ ID NO: 12655 - DNA, 1501 bp, Oryza sativa
tttatttgagaaaaaaaactaaaatattttagagtttaaatccctagcacttatattctgttggagctataagcattctaattttgtgatttagttggttctcaacctatagttttgtgatagttttatcactaaatttatagttttatgatactcagtcttaaatatatagttttataataaatttgatgctaaatctgtaatggattatacaacaccttaaatcttcatttttttataatctattatattattaagacaactttgaaagaagacaccacgctcgctgtggaggctagaaattcctacattaatcggagaaaaagagaaaaaaagctacaccttagattataatagatccagattaaagggcatagatttatcataaaattatattattaagacagctttaaaagaaagcactacgttcaccgtggaggctagaaattcctacattaatcggagaaagagagaaaaaagctacaccattagattgtaatagatccagattaaagggcatagatttatcaagaaaaaaaaaactatgacacaaactatatccagtacgaatagaaaatatactataaaacaaactctatcgggtacatacgtacatagagtcagagtcccagtgtttggcctaggatgtctccgattcagagtgagcaagaaaaggggaaaaagcagagtccaaagcaagttcatctacactccaagttcatgcagacatatagctgccactataagaccacatgcgccgatccatcttatgcagtatattttatcaatttgtcaactaaaatatgcacaataattttaggcccacattaatctcatgtgaaaaaataacaatagtagtcaataaagagggatcagtttatttgtataattttattatatgtgaagactagaaattctcacattaatcatagaaaaagaaatggagagttcaactaggaatgagatttagaaataaaaataagaaatatcgaaaacagtatgtgtaggaaacaaaacgatattaattaaaattcaaaataaaaaataaaataagttccaatgttagaaaaaaatgagagttcaagtaaaaaagatacaatttagaaataataataaatcataataaaaaaagaaacattaaaacaacaatctatctaaaacacaacaatagctaataacaataaacagaggaaagagggcgtcgggcgaggcgtaatgaagtagggtggtagtggttgatgagacatataaaaactataaaataaaattcgaatgatgattaagagaaggggcggcgggcagaccgtgaagcgtgaaggcatagggttgcgacagttgacatgatttctagaaagtaaaaaaaaaacaataatgatcagattcgattttaaaaatctcaataagagtgtgcagccggggggggggggggagggggaaggagtacagtggcagcatttgacggaatttataaaaattataaagacgaattctataggacaat

SEQ ID NO: 12656 - DNA, 1501 bp, Oryza sativa
ttttccgcctcgcattgccagcctcgcagtcgcagagaacagagagagagagatgaggatgggagagaacagaggaaaagagagagaaggctgatgtggcaatgctgacatgtgtagcccacatgggtctcacgctaactcagccgccatgtggaataaaactagggtcaaaaccaccggaggatctaaagtgaacggttttattagttgagggatgtccagtatctggttctgtggttgaggaatgattttgtaactcgatgacaagttgagggaccttcggtgtaccttttcctttcctaaaacctctaggcccatgcccatcagagtgggcggtcgtcgggactcgggacgtacgcttgggcttcaagccgggagagtgcccaccggaataaaccggatcggcgcgtgaggcatcgcaacgagccgcgagcaacaggagcgaggcggcgcacgtcggtggcggggtcgctgcagatcggcaacgaggtagcggcagtcactggcgctctgtggattttaagtttctaaaaggaatcgattttgattaattgagcaagggcaaacctgagcgaaccgctctgccgcttctccgatcatggccggcaaacgtcgccggagcggcgccgctagagaccccctcgcggagcgcccctacagatacgaccacgaggatcgtatcgttcggaacagatcggcgctgctggatgccatcaacgggcactacgcggcggcgctggaccggctgccggtggaggagatgccggcgctgatcccgcgcctcctcaaggccggcctctgcgccggcttctcggatcccgtctccaacatcgtcgtcaacaccctctcctacaagcgcctcccggagcgcaagcccatggttcttggccgtcccgtcgacggcaagacagcggcgaggagacggcggagcgcgctctcccggatcgtcgccgacaccagcgacgtcacctggcactcgcccaaccacagccgcctccgcgacatgaggatgccgctgcggtcactcgaagcgctcgtcgccttcctcgtcgcctgcttcccctacctcccgacctgggaggcgctgcaatacctccgcctggccaacgccgacctcctcgccgccgcgcggctcgtcgaggaggatcgtaacaccaaggccttcatcctcgcgtcccggaccaccaagaccgcgctcagatgcgcgcagtcgcggcgtggcaacccaagcccagagcgttcgtcaacaggtcgttctccctcgccgctcggatggagcaggtctccgggatcctagccaaagaaggccgcctctcctgcaccgacgttgtcaacctccatggattgctcacgaaccaccgaccaagatctccaggcctcgccggagttactgctccccaattcctccagaacaaggtcaagcagccaccattcgtgcgcacaaaatctctgaagaacatcgtcgtcgacaagatctatggactgtacctccaagttcttg

SEQ ID NO: 12657 - DNA, 1501 bp, Oryza sativa
ttgtgataacatcagcgagagcagctgcacatcaaagctaccacaagctttcagtggcaatggcccgaagaaagctgacaggtaaaaattcaccagcgcatcacgatccggatgatgcgcagcggtggccgcggccttaaatccaatgcccctgtcgaacttgtccttcatggcgtggccttcttgccctgccatttcgattgctctctgtagattcacctctgccaagagcaggtatcgaatggcttgctgtctggagaccgtaggaaagcaggcgcggagataagcaacaaggccaaggagagatctgcaagcagtagaaacaagggttcttgagcagatcatggccacttcagagtactcttcctctgcaggaaacattgtgtcataccaaacggtgttgagaacgatgttgtgagcagggttcatgaaggggccatagcagtggccagccttgaggagtcccctgtggtagcgccgctgcaagaactccctcggcatcttggcaagaacttggaggtacagtccatagatcttgtcgacgacgatgttcttcagagattttgtgcgcacgaatggtggctgcttgaccttgttctggaggaattggggagcagtaactccggcgaggcctggagatcttggtcggtggttcgtgagcaatccatggaggttgacaacgtcggtgcaggagaggcggccttctttggctaggatcccggagacctgctccatccgagcggcgagggagaacgacctgttgacgaacgctctgggcttgggttgccacgccgcgactgcgcgcatctgagcgcggtcttggtggtccgggacgcgaggatgaaggccttggtgttacgatcctcctcgacgagccgcgcggcggcgaggaggtcggcgttggccaggcggaggtattgcagcgcctcccaggtcgggaggtaggggaagcaggcgacgaggaaggcgacgagcgcttcgagtgaccgcagcggcatcctcatgtcgcggaggcggctgtggttgggcgagtgccaggtgacgtcgctggtgtcggcgacgatccgggagagcgcgctccgccgtctcctcgccgctgtcttgccgtcgacgggacggccaagaaccatgggcttgcgctccgggaggcgcttgtaggagagggtgttgacgacgatgttggagacgggatccgagaagccggcgcagaggccggccttgaggaggcgcgggatcagcgccggcatctcctccaccggcagccggtccagcgccgccgcgtagtgcccgttgatggcatccagcagcgccgatctgttccgaacgatacgatcctcgtggtcgtatctgtaggggcgctccgcgagggggtctctagcggcgccgctccggcgacgtttgccggccatgatcggagaagcggcagagcggttcgctcaggtttgcccttgctcaattaatcaaaatcgattccttttagaaacttaaaatccacagagcg

SEQ ID NO: 12658 - DNA, 1501 bp, Oryza sativa
gctcgccgccatatgcaaccacggaaatacgggtgcgagggagggtggtgtgtgttgtacctttacacggcgaagcgacggtgatgcggactttcttgacagcgatgcagacctagatctcaatatttttttttataaaaagtataaaattttaactcatcctattttaaatgtaggcctcaaatttagtaggctaaaatattatgtccatttccaccatgcgtgctcgcatgcctcatgttggagatatatagcgcaactctatggaaaattgaaggcaagtaatgaagagaacaactagtagagatggaaatggtcaattcacgattatttcttagcgttgttttttgtaataatcaggcaagaaacattttctttagaaaaagatgcaggaggcacatatccaggctgtaaagacgactgacaatatggtcagctggtagtccagccgagagcaacgtgtgccatcgtttgggttacttggcactttcgcactctccaccatggatgacagatgttctccggtgtggtcgatgttgtccgggaattgaagtggcgaaatacatagcgactgtgccactgccactgccagccgggcgccggccacacccgccagccgtctgggatctacggtggttatggtcgcgagagctcgatccagcggctttcgacggtagactgtagagagatcgattggtgtcaaactgtcaataatgaagcagtggagcgctggatccttgtgtctcactcagtcattaatttggtctaaagatttccaaactgtcaataatgttctgggtcgccaagaacatcaaaatgtcgtgtatgcgacgattagtctcgcttggaaagacttggacggacaacgggtcgatggaaacaataggacgcaaggcacgatcaaagaagtttcttctcgatcgaattaacgcagagcctacttgaggacgagaagatcatgatgtcgtcgtggatatataccttaccatggatacaaactgcgtccaatacttgacgtcaacacgttaagtccgcagtcttaccgcactaaccaccaaattaagtggaaattaatttgcaagctgagaacgatgccacggactaactgtatcgtgccaaactatcaaacgactcacgttatactacaatgttttggaaactgttttcattccatgggaagatatccagtcttttttacatatcatttaaacagttatcatttttttaaaaaaaatgacaagattcttactataaaacatataccgctccacaaacttgcaaactaaaatttaatttctataaattgtataaaaaatatactaactacgaatatacgttaattattttcagtttatttcatgttttttacaatttgtagaaattgatttcagttttgtatattcatggagtgatatattttatattaatctgtatatgttgttaattttttaaatttaataactatttagaagacatggaagaaataaaaatccatgcccca

SEQ ID NO: 12659 - DNA, 1501 bp, Oryza sativa
tgccaggacaccctcgaagggaaccttgcaagtaagcactaagcagtaacgtgtgtggtacccaactacccaactaggcctgtgaatctgcagaagtggttcggaattcagaacgagaagcaagtgaatctgttgctcgtcggttgtaagttcagagtactcggtgtgtgcaacattctagcgagaggggctggtgtcggtcggatactctactagctacagtgattatgacatcaaagtacgtactaaacctcgtatatactattcaaggtgtactttgctggaagcaaagcataattggatcctaatgattgcttcagtaaagtaaaggtaaagcccgcaagttggccaaaagcttaatccggaacagagtagtactaaattctgctagtaatcgtccggcgaaaatttgtgctagcaatgaaccgtgagcaggtggaagtccataacgcatggtacaactgaaatgggtgcctcggtagtccacagcaaccaactgcgggttgaataagtggcctgtggccgccttcagagtttcagacaaaccttcgtcatcgtgcacacgcacgtagcttgccctgacatgggtttaccctgttcgaataagttcacatcaggtcctcaatttgtcgccaagttcgaaattcatccccacatcccctacctacaaaaccatgcaaacgaggtccttcagcactattgtccccggttttggctatcggtggcgcctacgtggctctcttgacgcggcgcttacgtggtaattcaatctgaaaaaataataaaacccacgggacccacatgtcagtttcacacaaaaaataataaaattgttggggcccatgtgtccccacatgtcatcctcactactccactcttctctctatcctctctctctcgcaggccaagcgagatggagcggcggcaggccgcaggtagagcagcaggtcgggtggatgagaaggatgtcgccgtgttcatcgacctcgccggggcgggagaggagatgcaagcgccggccggcaggaagagaggagccacgggtaggaaaggagacgcgagcggcggccagcaggaaaggagtcgcggacagtggccggtgggagagaagtggcgcgcagtggctggcgagagaggagtgatgcgcgagcgttgaccgatgggaggaaaggagtcgtgggaagcggccgcttctccctctccattccctctcagatccctgccccctcggctctggctctaccaagctcaccgcccggtaaggggggcggagagggaggaggctcacccctcgggctttgcctatggctcctctcctcccgccggccagcgcctgcgcgccgctgctttcccgtcggagagaggggggtagagataaaaggagagagaggatagagagaataggggagtagtgaggatgacatgtgggctacatggacctaccattttttattattttgtatgtgaaactgacatgtaggtcctgttttatcaatttttc

SEQ ID NO: 12660 - DNA, 1501 bp, Oryza sativa
ataaggattgcatatacatataagttggatttagccgatgacaacaaaggtttcactgtttaatctaatcttgtggatttcatgacatcggacctccagccgatgtgtgctttaaccttcggatcgatgcttatttatcatatcattatttgccgattggtttatgttgttattttattacatcatcatcagctgattgcctttatatcattatctactttggacatatagccgattgcttaaaccctatcgctatcggctggtatcaacatcggctattatcggctagaactactccatcggcttgtcagccgatcggctgttttgatctactatttgcatatcttgtcagttgcaggatcaaactgactggcacgcccgcacttcatcaagatttggacctgcactggagctaagcagatctctcaggccgatgtgttcgatttttttcgtcaacaactaccccatggaaacacgtaaccaagccatgaaaccatccaaggattggaaccccatggaaacacgtaagcaagctataaaatcaacgaaaaggacgttcatgtttccggatatccgatgcaataggatttaggtcctcattggttgcttaccactttatataagccataacggcttattaactagtaataaaaaaatatgaataaaacttttaaatatgtgttcttaataatttaaaaaccaatattgaaggaatttatgttgaaaaggcatctaaatcaaaagtttcaaaatttaaattttggcaacaaactggtataagtgatagcgcaagcaataagacccttaccttcttaccttggtggacagcgacacggacaaagctccaagcctcgattacgatcggtgcttcacactggcaatctaccatgccgtagactgtacccttctactacctcttttgtgctagaaagagttttaaccttggggagcaaggaaaacatgcttatcacaccgagggtgtgtttagttcacactaaaattaaaagtttgattgaaattaaaaacgatgtgataaaaaagttaaaagtttatatgtgtagaaaagttttgatgtgataaaaaaaattaaaaatttaaagaaaaagtttagaactaaataaggccagactcggccaaagctatctgccgagcacacatcagtccatcaccataggggtcgttctggactgctctcgagcattccggtggtttgtactcgtactcgtagcagggaaagcgcctagtgggaatgtgtgaaaccagatcactgtcttctctgaatcctgcagtgatactcgccgttcagattttcaggttgaaccccagtcccaagttaccgacgaaaacggccagaaaaccgccaaaagcacacagtaaaagagatgtacggagtacgtccatgcaagttagcttcacgtgcaagtctccacgtatagcacaaggccggccccaaggagcaagcaaccaaaccaaagcgctcgtttttaagcgctccagagcc

SEQ ID NO: 12661 - DNA, 1501 bp, Oryza sativa
gtagtaatgccatgtattcttcaccgtcacttggttgctaactactatatactcagcaaatgatgcctttgtttcaagagatttctcaacagatttaaaacttaaacgctgcggcaagcatgtcacttgctacaactctgctaatgatgcctttgtttcaagacagggcgccatcgttttgcagacgctgttgcttttcagcagtacctgatgcttataaacatcagcaattccattgttttgcttatagctgattaatggatcttctgtaaactgatgcattgcctctgcttgtctgcctgtgtgtgttgtgtgctcgtcagcactgactccagatgcgtggccgtagatagattccgacatgtatagggcccactaccaataacggttcgcatttaggctgtaacagcgaaccgatacgcttctactgcaaaacagcagccgcaaaagcgaacagatgcatcctatatttctcgacagatttaaaacttaaaaaagctgcggcaagcatgtgagatagtagtaccatcctaggacagctcaaaagtactacgtcaccgttaggatacaagtctactatgtaaggacagcatgtgagttagtgagtatatatgtttaatgtttttgttgaggtttctcaagaaatccagtgcatagcctgcttcttgatggcaaattgcaagactggagatcatctgtttttgtttaaggtttcccatgaaatcaagtgcatagcctgattcttgatggcaggttacaagactggactgggaaatttctagatggtgatcgagtgaccggtagtccacaagaccacaagcacacaaggcaccaggcacgctttaggggttaaccagaagatagacaaggaaacgtattttgcatcgagtgactggtagtccacaagcacacaaggcaccaggcacgctctagtggttaaccagaagataagacaaggaaacgtaaggcgtgtttactttgggctggtttggtttgaggcataaattggtattatcaatatttgataattttaatagtgtttactgtttatttggtttgaagccaaattttggcatgtctaagaaaatatgtcatttcaatagttaacttagtctattttggtttcaatccaaacacaactttgccttgccaaaattagtcatgccaaaacttgtcaaaatttagcattgacaaatattggtaagaccaatttaggtcacaaaccaaaccagccctttgatgctattttcaaccataccatcttttttaagttattaaaaaaatgtctacgttcagtttgttgctagatttgctaaatacataagaaatcctaccaaaattttgataatattgtcatcctgccaaaattttaacaatattaccatcctgccaaaattttggcattgccaaaatatcataaggtttattttggttaaaatccgtacaggcccgtattttgcagcgaaatgttggaaacaagaaaaaacaaaagagcaaatat

SEQ ID NO: 12662 - DNA, 252 bp, Oryza sativa
tttcccctctcccggtcgtggcaaggtcgcggttgtaccaagacgaacacgtcgacggtttgctgaagctggttcctcctgaggggacgaacggtgagactccgctttcgctatgcgcttctttgtttcgctatttttcccggttcgacgcttaatatggctacatcttttattttcgcagtattgattcttgattaggccgacgctgaagcccggaagatgattggcgacgtgtcggtcgtcgagtacagc

SEQ ID NO: 12663 - DNA, 1501 bp, Oryza sativa
gctctctctacacagacactttggtctgtcttaagttcgtatgtacaaaaaaaaaatcaaatggaaatgaaaatgactatggaagcaaagaaagttcgcaagcaaacggttggttatttgtagaataagcgaaacagcatatttgcaaatgaaaaataatttgtgaacaaaacttttatatacgtgttcttagcgatttaacttttatatacgtgttcttagcaatctaaaagtaaatattgaaaaataaacttcaataaaaaaaccttaaaatcagctctaaatttaagtttaaaaatttaaattttggctaataaacattagcctaagcgaaaagataaagccctatggtgcacggctcgaaaattcgatcaaaaccggacgaacttcgtgaatttcgttgtttccggcctgggacgaaagcacaatttcgtcagggagttcgaacacttttgagattttccaaatttgagaaggacaatgaaaaatggggaaaaagtcctaaaaacaatcatgtttttgtggtacagactggcaaaaaaaataataaactgcatttgcataaaaattgggggaaatcctgaaagtagtctcttttttttttcaagaaacctcaattgacgaaaataaaaaaagaagtttgcatttgcatattgggccgagaccatgaagcatgacagaccggttaggcctatattgagcctgtatgtttctctatttgtatgctctttctctcgcacgcagtctgttggcatctgaaatttcgctcatctagcttggaatttcgataactcaaccggattttgatgcgtgccaagtggacttctaggatttgaattcaaattttctttactcaatttatccaaaaactataaattttttgaatgactttcgtgattttcgtcatatcgccagcgtccggcatccacggcgtattcagtaatgtaaacctaggtggttactacgttaaccttaaggtgatcatattaatataggatgtatgtacgtatttatacgagtaaatatgcacatgcatatataagtgtgtttgtactatggttcgaaaaagaaaaaagtgtatttaattttatcctaactatttcattgggtcacttaatctttcaaagtatgttttagcttattttaccacaaaaccattgaaaatgattcattttacccattgataaaatttctcctttttaatttgtacagtttatattttaaggtaatttttttacaaccattgataatgtcattatcaaaattttaatagtgaatcatttttaatagtgtactgtaaggtgcaaaaagactgaaaaatagttaaggaggtaggttaaatacttaaatgctttgacgaaatagttagaatatttctttttcgttactggacattgatttggccctcgtccgtgtgactggcgcacacgccgtggcgtgctcacgtctcaccctccacgcgaccacgccgcgcccacctatggcacttggcgcgccacct

SEQ ID NO: 12664 - DNA, 968 bp, Oryza sativa
ctgaagagcaacttaaacattctaagcatgtatactgaacttcagttagtttctttagtcttgcaaaaatattctcagtaaaaaaagacttgtaaaaattgccataagttttttggatgcaaaacttttaaatatattaatagtagtataattataggtaactatattgtaactatactatattacattataagttttatataatttatatggaaaacatacgtaacttttatataacttgtattgtactataactataattcatatataagttataatatagctacaatacatttacactatagttataatatacatatatcgtatagttacattaaaatcatactataatcatactatagttaattatattatttgaaagttttttactttaaaaacttgctacggctctttagcaattccaaaaataactctatatatctaaggctaacatgaaaaaacaaataattgatcgacacgtacttgatcgaggccatggccaattgagagttccttatgaaaagaagttaaaaatccaaaggctagctagcttgcttgtgatctagcggaaatgagaactaactgtgatggcgatgggctgccaacaaataaaaatatatttttttagaaagagagtgcatggatccaagaataatactggtgcagtaggataggcatgtgtatcacgtacatatgctgtatgcccaagcctaggaccagggctagggaagtagacgaatttaagcccggccggccggttgttatcgccgcgtacgggagtttacttgcatgattgagtgctcaagtcaagacaatctagtcctaattaagcttgcattggcctatgagatgaatggcttctggtctctgaaaacctcatcaaacgtctatcattctggccgtggctatgattgcagctagctaccgttctctcgatagataatacggacgatcgacgcatctagcaa

SEQ ID NO: 12665 - DNA, 1501 bp, Oryza sativa
agccggcgagcgtggcgcggcccagcagacgtgcagggctaggacgacgaggtcgtggacggtgaacacgagggctgcgactatggtgcgtgcggaggcacggacggatagcactggaggttgctatggatcggacgtccgatctgtagcaaatcgtcggacggtgttgcactgtattattgaagaatgaatgtttcactcctcggtaaaaattgtttcaatgaaaatgtttcagatgtttcactatcagataaaaatatttcaacccttaagcaaaattgtttcaatcaaatacaatattcaaacaatactaattgcaacaccaagaaatcaattcatgcaacatcaagtcaaaacgaaatgaaacaccttagtaaaataaagtgcaacaaaaaaaataaataagctgcaacatcactaaaaattcctaaaaaaaaacatacatctatcttcttctattccggccaccggaaacaagtgaccggcatgggagagacaaataaggtgacggtgttagacgcggacgagggcaaatacaacattcaaacacataccaatggcaaacacgaagaatcaatacatgcaacattgaatcaaaatagaatgaaacaccatgatgcaataaagtgcaacagaaaaaacaataggatgcaacctcgctaaaaaactgtgacaaaattaaccgacctctatcttcttctactccggccaccacaaccaccaacacggcagagggaggtgaaagcgcgaggtgggcggactccggccagggcctgggccaaccacatcagatccaacacctcctccccatcccacgtcgccgtcgccgccgccgccgccgccggcgaggtccactgcctccaccctatcccacgtcagcctatgcccctaccatgccgcctctgccactgccgagtggctgtcgtcgagatccagcgcctcctcccaaccacgcgccgccatgcccggccgccgatgccgcgtgtggccgccggcgacgcgtcgccttttctcgcgactcccctggcgtccatgccccgactcttactccgtcgctcatcttcctgccgtctcatagtattttcatttgataaaaatggcgcagtgttggtagttgaagcagagagaaaaaggagaatacgagaaggctagaggagagatgagttattagctggatggataagtctggatggatggatgccgatatgtttcagcgttgactgtttctgcgcggtaggatggaagcgtccgatatttttcgttccgtcggacggcagatgcaaagcattttcggatggcactgggtgctgttctatgcgcacatatatgcacgagaaaccaacgcacagatgcctaatgcatgcaggtggcaaatacatgtacatgggctcgtgaaaagggcatggatgtcacgtgaaatcaatgcattcacactttgtgtgttgctctgattggaaacatcaacatgcaaagggcaggtggcggtacatggaggtctggt

SEQ ID NO: 12666 - DNA, 1501 bp, Oryza sativa
aaaaaaaaaaagaccaatcctacctacgactacgaatctggacacatgtgtgtccaagttcgtaggtaggaattcgttttttagacagagtagtaagcgctaggcagctagctaatacacatacacggacctatagctacccaatggtgaacctatgtactatttaccgggatcacaggcacctggtaaattactcaatgctagctgattcatattatataattagtatattagttaataattagataattaatatgtatagaacctccaataatttttattatgagttgctcactctagctaccagatcatctattgacgagaccgactggccggccggtcataccgggcgaagaaacgggtcgcgtccgtgactccatatatgcatgcatgcatggtgtcatctaccacttcggtctcttgcagatgctaagtacgtcggtcacgtacatacgccacaaaaaagtacgtgtgtctctgtggtcgatcgctgcgtgcacactgtgcctcgacgcctacctgcggcaaaaacaccctcgcatcgtcatatatcctttttccggtctccggccgcccttttctactgatctcagccaaaagataagatcgggcgacgacgcagcactgctgcgtatattccccgtccactctgctgctaaaggctaaagcgcgatttttcttcccagacatttttctgggatgggcttaattatataagtcaatttttgacagatacaacgggaaaatgagtttagaatatctaagacttttacgattctatcttcagcagtttaaaacttaagtccgagtgtgatgacgacaaaaataacaaggaaagaccataaattaattccaaaacttataatccgtagttcaaaattggaactggtctataagacgtagctcaaacaaataaggctttaatcggcactcaccgtgaaatgtacaaaactaaattaaatgtgcccgtagatgtagcggtcactaatatctgtacctagagatggttttctaatggatagggtgctcgattattatgtgctacctttaaaaagacggtgtttgtacaacgtggtgtatccatcaggcggtaaaggaaccttcttgtgctttttctcattcttccagctcagctagtgagcagctttttatccagtctctcctaaagtagtggaatacgaacccggccacggaatgaacgtttgccctgagatcttcttcgatattttattcatccttttccttttcggaaaatttgtatattaattcttcacgaccttttgatgaaagggctagctataatagttctgctaattaatctactgatcatatatataaagattactattctgtatttatgctatgctggcatcaataataaagattactacactcatataaactgaaggacagcgatctctacgcaaagaagagaataaaccgcccatgttcatacgcacttctggatggataagaggataaaaagctacttgtgcccaga

SEQ ID NO: 12667 - DNA, 1501 bp, Oryza sativa
gtgccaagctggaatgtgaaaaacacagatgccagctgaagctgcatgataacaaactctcctaatgctgtgcggaatcccttttctaagccaacttccattaccatagggagaacaagcagcaaacctagctggaaaaaagactgcgaggccagtgcgttttcaagaggcttaatgttctgctcgatacgtggatccagcaaaatagacctttccagaccactcataactagatataacctcccatatagaaacacataaactgtaagtactgtaacctggataaaggaagaaggatgtcagtatcccaaatgccaaagtgaaacacattgtaaaaccatgcctatactctcaggctgaccaaaatatacttcatatttatatactaaggaactacagcaagaatggccaaacaaaatattttctttacatgaaagactttccaaatcttgatgattttcaatatactggtgactggtccatgaagaaacaaatggctccacgttagaccatctggtagaggaaagatgtcctttttgttcttttgtaagtaactttctacaattttagtgttatacaatttttagtagggttgattctcaaggaagattatgtttagtagtgttatacaagacagaaatacctttttaggagctatcaataatataaacttccaaatgaacatgttcaattaatattcttaccatgctactaaagtaaaacccaactgtagtaaagtagaaggatagcattctataaaaatcgaatctgcgccccagccgatagatatcacgactcaatgtttgttcaccattgccatttgccaccttagcttcaaagcttgaaatttgattcattcccacatcacgccccttaccaacttgcatatactcatgatgtgtgacattcccttctctcattgttgaattaaaacctataagaaaattgcgtttcagtaactgcatgctaggtaatggatttgtaaacatgtatgagatgcacggcttacctgaaaatatatcttcacttagatttatagtctttgaggctttacttatgccacctctagtaatatggaagagtctatcgaaaatatcaggatgaccataatggaaccgaaccctgtattcatcttgcaataatgagttgtagacataaaagcacaacatgataaaaaatatacagtcataaatcaatgttaaatgaaacaatatctaaccatgtggaaactactcaaatcttagtgaaccccgctccatgtcataactgtttagttacatttgtagaatgatttccagaaagctaggtctgactttatttttatagttgtgtaacaaattatcaaagcatatttggtagtttccttttccagttcatactaacacgggcatgagccacttatgatttccaaacatgcaataaggattgtgtgaaccaattgacaaagctatttgcgatcaaagtaagagtaactccagatacttatcagtgttttatggaa

SEQ ID NO: 12668 - DNA, 408 bp, Oryza sativa
cccatgtcggtctgaccggcctggccgatggggccctctgacagggctacaacggctagttttctagccgttgcagagtagcacggtctgaccggccgcatacctccggtcagaccggcagagcacagagttggggaatttcgcccccaacggctagttttggtgggtgggagtataaatactcccccaccagcagcaagggggctctcttggcacccaattcaattgcatacactccttgcacctctctcacactcacttgagctttgtgttcatctatctagtgtgttagagggttgtttagccaagagtctagtgcatttgcttccattgtagagctagtgtggcacttgatcatctccacaccgggtcattgcttgttactcttggaggttgccgtctcctaga

SEQ ID NO: 12669 - DNA, 1138 bp, Oryza sativa
gggcagcagcgggtgcgggggcgggtgtgtatgtacctggtggtggacatgtcggggtcgctggtggtggtgcagagggagtacagcgtgcggcgggacgcggtggaggtggaggtggaggtgtcccggttcgcggcggaggagcgcaagtgggaggcggtggaggagctggcggcgggggaggcgctgttcgtggggtcggtggtgtcggtggcggcgcgggccacggaggggtccgggatcagggggaactgcgtgtacatggcgcggagggaggtggagttgatcgcgccgcacgccatcggcgtctactccctggccgacggggaggcggatgggttggccatctccggcggccactcgctcgccgcggagcctgtctggatcgccccctcgctcgcctgatccagattactccagctgcaacagcaatttatcaatcatgaatcaggaatcgatgagatcgtgttcgatcgtgtgttcgtgccgcctcgcttgcaaacccaacaataattactactccactagctagtagtactacttgagttcacaaccgtgctaggctttgctgtgaacaagtgtgttgatctgatggatgcagcaatttgctgctgttgtcgtcagtctaaatttgtactagtagctgtttgcaatgcaatagagagtgtatcgatgggactatctaattttgcttatagctgctgctgatgcttcatatttcttattgttgttggttcgatttatgttgtcttcttcctcttctgttctccgattgcttctgctctcatcttcttccttgcattccatggcaaaggaaacgaggcacagctcagctactgccaccgtggaaaaaggagcgagaaaaagtgagagcgcgatatgttgatgtttggggcctaatgggctttgtgtttgatatggggccgatgaagttttttttttctgggccgtaacggtggcccatggacattcctctagcagcctagccgcagcgggcgagggttggttggtggaggtggatgggaaacccaagaaaatacgaggacgacggcggcggcgacgattccaacgagaggagaagcgcaaggaggataggcggcggcggcgactgggcgaaagtgatcagagctcgcgagga

SEQ ID NO: 12670 - DNA, 1501 bp, Oryza sativa
tttatgtcaacttatcttatgtaggagtatgccatgtgtttctataagtgaaaacataagccatatttttgcctctctctacgaggcacgtgtagttggtctaaatctcagttgctaatacgctctaccattctggctgacctgactgcttgcccgttccatggcacctgggaacattagcagtctgcatcctcacatactgcacagtaccttttaatctacaactagcagtttaggatttggttatttcttcatgccattctgtgaattcagctcatgttgattgcaaagtggcatcagacttgaagatagtataccgggatttggttatttcttgatgccattctgcgaattcagctcatgttgattgcaaagttgcatcagacttgaagatagtatacctaacacaattattggttcacatgagcccctactcatttggagtatgttacaacaggatgctggtatcagtggcctgaatagcaagactcacatgaagatcctgctgaaatggatgacggggagaaggatcgtgaagctgaactgcgttggcacgggcaactcaaagaagttcctgtattccccgtattctgcagatgcagataaatccgaagaagcagcagcagaagagctgagtaaggctgctgcttcacaagggggaaaagctacaaaagggcaacagaagaaacgtgccacagccctacactgattgtcgctcatcacaatcttattgttacgcttctgggattatttttgtttttaatcttagtggttaggcagggcgaaattctgttaagatgattccatccaaaactgtgatgaacctttctcattgatgatgcagttatgctggcaggccagcattttgttgtagtagcactgtctgtatgttcgctaaggagcagcaataatttgatgatgcttctatagtttgagctacggctaataagccctagaagatatgaagcaactaagttatatttatgtgtaaaacttttatacatgtgttattgatggtttagaagtcaatgattgaaaaaagactatggtaagaaaaaaaaaaacctcagttaaactctaaaatgaagtttcagtatactccaatatatactggagtagtagtagtagtttgttgttgtggctgatgagagtaacactgttgtgccatccgtgagtacagcagaattaattgatggggcttctgttttgagttaaaaaaagagtacagtagcacttaaattacgtactgatgcatatagttatctgctatcattatgatgatgatataggaagtaaagagtgtgaccacgtgcacgaatcttgaagcacaaacaagcggcaggtagaggtggaagatgggccgaaaacggcgtaccaccggcctatactgcgttgccggcgattggactcttctactctctccctttcctttgctaccgcccgccgcaaccgcatcgccgacgtggcaagcgaagcgagggatccccacccctcacgaccc

SEQ ID NO: 12671 - DNA, 1501 bp, Oryza sativa
aaattctgtttaataatcccaaaatctaaattttggggatgaaattttgagtctctcggtgatgctcttaggccctgtttagttcccaaaataaaatttttcacgctgtcgaatgtttggatatatgcatggagtattaaatgtaggaaaaaaaacaattacacagattgcatgtaaattgtgagatgaatcttttaagcctaattgcaccatgatttgataatgttgtgctacagtaaacatttgctaatgacagattaattatgcttaataaattcatctcgcagtttcctggcggaatctgtaatttgtttttgttattaactacgtttaggatctgtttggcacagctctagctcccagctccaacttacctgcaactagtaggaaatcgtccatctatgacgttttgctcgtgacgttgtataatttcgtcattgaacagagcatatctatgacgaaaattcatgtttcgtcacggatcactcatgcgcaggggtagacatcgaaactccatgacgaaatttaaaatagcgtcaaaaaacaatagataatttcgtcacaaatgttgcgcaccattcatgtaactcacttatgatgctcctttattaatagaatttatgctgaaatatatttcatcagatgtaagtcaatatctattctcctattggtcccaccttgtatatgtggcactatccagattttccctggaccccacattgtatatgtggctatctagattgaccccacattgtatatgtggctaaccaggttgttactggacccacatataattgaggtacagtgggtcccaacattcgttttagttatttggcccacggatgcagcccaggtgtgttttcgttttagttatttggcccacggatgcagcccaggtgtgttttcgggccaggagatggcaaatgctgtctacttgcagcccatatgaaatacctttttctaaaaaaatatgctgcagctaggatcgaatacttttagttttcctttcacaattcttgaacgcatgaatgattgaatgttttatgcggacgacctaggagctaggacctgcatcacctgcttgtggggttcatcataaagtgtggtttatctttttaatctttggctaaaacttgtaggtagtctttctctctcatactaacttcaaatttgattattcttttttctaaatttttctaagttcatgatctatcaatttattgtgttattacaactattatttttggcatactttcatgtgactttgttttatcaattgaagatttaaatttcaaaaagtggcaacttcaaatgacattttgaagcagtaaacgatttcagctgaaaaattcatgaacacaaaagttgtagaactgatcgagatctacaaattttattttggtcatttattcattcgacaaagtgatagtaacgttgttctcaaaatttacatatctctcttataacttatgaaaccatacgggagatatgtaaaatttgt

SEQ ID NO: 12672 - DNA, 1501 bp, Oryza sativa
ttaattagtactccatccggagtaccaatcactggctgctgatgctgctgccgccactaaccatgatcagtcccgtgccaagaaggatttgtctctccctttgaaatctcttgccacctttttggtgtttgatttgtctctgcatgggtaggttgcctgcatactttgcattcaggcttctggtagagtgtgctgcctagatggcaaacgtgatggaccggcattctccttgcatcttagctttctttttttctacttcctccgtttcataatgtaagactttctagtattatccatattcatataaatgttaatgaatctaggtatatacatgtgtctagattcattaatatctatatgaatatgggtaatgctaggaagtcttacattataaaatggagggagtataagataatgaaataaatcctttagctagccatctacatatatatttctatctgcaaataaaagcaagagatagaaataatatgaaatttctgatgcaaccctgtatcagttattgctttttatatcttttaatatgctaacaatttctatctgtaaattaaagtgagagatataattaatatggatttatgatggaagaaatatatcttctatttttttaatgtattaacaatttctatatgcaaaattaaagtgagaataggtcatattaagtttgaatttcagatgcaatgctgtatacaactgtctatttatttatttttaatatatcaaatcagttggaccatcttggtcccactatagtatcattaaaaataggataaaaaatagtgttaatatattctggcatgaaaaatgcatgtaggcacaagttgcgtgtgtgctcatggttacgttcatgcatggttgaccggtgtctttgccctttattccttgcgtctccggttcgacgaaacttgggctccaataatctgtcaatctccctgcaatagattgcatctacaactagctaactgcctttcaagactagcagtcttctgccatgatggtggttgatagagaattggaagtattcaatgaaattggtacaatctgtgtttgcttggataaaaaaagaagaagaagaattggaagaacttgcagttaattttgtctgcaggttggttattggttccatctctgatctttatcttgccaattggaggatatctccttcaccgttgtaactgcaacaatgacattgttgtccaagagctagagtgaacagctggccaattgtgataggtggttagcaactgagatcactaaacagtggaagccaacaccacacatgcatctctcatcttattagagcagaataatcaatcatggttagaaaaaaaaagaaatgaattgccttaaccaacatcaccagcaacaggcatatacatgtccattaagcaaagagggcatattctcagtgtgattcagacatgggcatcaactaagcaaagcaaagctaaacactgtgcttaaaccgcacaaacgaatcaaa

SEQ ID NO: 12673 - DNA, 1501 bp, Oryza sativa
ctccatgtcaatgatttagtccagaacccaaatcaaaactgctgataagttaatcatcatcttcttttctttttgtgcactcaaacaaagttgttctagctttgctctgaattttgggcaacaatcactcaatcagtagcagtagacctgattaaggataagatgagatcaacgacgtgagtgcttgggcaaagagagggcagctttaatttgtgatcacaagtgcgagttcgttatgaatgtctgtgtctgtgtccatgtgtggtggtggtgcattttcagagaaggggattctttatagttcgctaataacaatatatacagggatgcctgtggctgatggctactgtcaccaccaacatcttgttattgttcagactaaagtgttggttgctagctcaggtttagctagctccaaatacaagtcttcactcataataatggtgttgctggtccatgcttgatcaaccatgcaagtgtggtgttctttgagttgggtgttgtcccatcaaaatcctctgtatatatatacttccatttgattcgtttgtgcggtttaagcacagtgtttagctttgctttgcttagttgatgcccatgtctgaatcacactgagaatatgccctctttgcttaatggacatgtatatgcctgttgctggtgatgttggttaaggcaattcatttctttttttttctaaccatgattgattattctgctctaataagatgagagatgcatgtgtggtgttggcttccactgtttagtgatctcagttgctaaccacctatcacaattggccagctgttcactctagctcttggacaacaatgtcattgttgcagttacaacggtgaaggagatatcctccaattggcaagataaagatcagagatggaaccaataaccaacctgcagacaaaattaactgcaagttcttccaattcttcttcttctttttttatccaagcaaacacagattgtaccaatttcattgaatacttccaattctctatcaaccaccatcatggcagaagactgctagtcttgaaaggcagttagctagttgtagatgcaatctattgcagggagattgacagattattggagcccaagtttcgtcgaaccggagacgcaaggaataaagggcaaagacaccggtcaaccatgcatgaacgtaaccatgagcacacacgcaacttgtgcctacatgcatttttcatgccagaatatattaacactattttttatcctatttttaatgatactatagtgggaccaagatggtccaactgatttgatatattaaaaataaataaatagacagttgtatacagcattgcatctgaaattcaaacttaatatgacctattctcactttaattttgcatatagaaattgttaatacattaaaaaaatagaagatatatttcttccatcataaatccatattaattatatctctcactttaatttacagatagaaattgttagcatatta

SEQ ID NO: 12674 - DNA, 1501 bp, Oryza sativa
tagaagtgtcttctgccattctaatcgccacgagcatttgtagacagtggaaaaaaaagagagagaaactgacaaggatgaatcctatgtacttgcaggtgaaggagtttgtgaaatcctacaacgctctccacgagatgggcttcacatcctcaaatgttcccgaactgctggccatccacgacaacgaccctgacaaagttatccagcacctgatcggcacatcatagtccagaacaaaactctccacatattcccccatgtataggtccatcttacgctggcaagcgccatacatgtcgcgtttttaatgatggtttcgagtgctagctattgtacgcgtatttccgctacgagtttcatgaactgactattgttgtgcttcccaagcggtttcataaacttaaccttgctttttgtgtcggatatatagagccagtaggtgatgattctgattgctgaaactttggttgctatacgtttgctactcctttttggtcgattcagcaatttcttcccgccgttgttcagtaagctccgaacgctgtgtgctgcacagcagcagccagattcctgtggcaatttgctggctggagctcactactggatagttcatgtccgtggatgacggttggttgtcacttgacatggtggcaaaatcactcgttcaataacgtgacgaacaacttccagatggtaagtaaacacgctaacaattactacctcagtcccaaaataaatgcagccatagttttccacgcccaactttaaccgttcatcttatttaaattttttttaaaaataatttaaaacataagtcataagtaaaatactgttcatattttatcatctcagaacaacaaaaatgctaattataaaaaaaattcaaataagacgaatgatcaaaattgagtgcgaaaactcatgactacacttatttttggacggaggtagtgcacctttttgcatgcctaaagcactggtttgggcatactccgtatgaaacaagcatatgtactgtggtgctgcagacaagtccagaatatgtgtcggccggtgactgttccatccacacactaaggcctaaatgtcattgaagaacttatcgtttgatctagaatcgaggatcactgttcaccacgctatcttttttctgctgaggatgagctttgcatcactggacagcaacaacgagcatgaacaagaacaaacaccacaatccatccccatctccttctctcccccataacgaaatcgttgcaatgctgtctcaatttctctcattaaaagaaaacaaaatcgttgcaatgccgtctcaatttctctcagaaaaagggaaaaaagaaaagaaaagaaaaaagaaaattacatttccagcccaacaccacgatctcccatctccttcctctctcccgctataaaacgacggcatgtcgcgccgtctcccgcctatcgccgatcgaagcttacgagctatctgctcttctctctctctccgcca

SEQ ID NO: 12675 - DNA, 707 bp, Oryza sativa
aactttttgttttttacattcgaaaaaaatatttaaataagacgagtggtcaaacgttgcaagcaaaaactcaaaatctcttgtattgtgggacggagggagtagttggagtaacagtccccatatacaagcgccaccaactgtgtcgtatcgtacgtacttttgtaacggcttaattgtcagacgtacgtacgtactctacgctcttacttactgcttgtcgttcacttgagtacgctacctccacctctcctctcccctccctggatgcaagcgagcaattgcatcctccatcgatttgaattgagtatattggatcttaattattgttgttgaaaaagcttagcttagcttgtactagtatgtagtggtactatggaagaaattaaaacgcagttgtaacgacagggatgaaatgtacgctagtgggctggctggccgatcgaagaagaagccagcaagctagcgtgtgaaattaaacagagatcgatgatcattcatgtactggtaggtacatcatatatctttattgtgcgtggtacgtacgttgtatatatatcgttgttcagacagttagaaaagaagatcgatcgagctcgatctgtcatcgacaatccaaaatattattccacttgcatctgcatgcatacagatacaggctctctctgcctcctgatctctttgtatcatatcgatgtcgtggttgt

SEQ ID NO: 12676 - DNA, 1501 bp, Oryza sativa
ttcggctttggctagtgcagctttgctttcgtgaattctcaagcattaatgatgcagttttgagcttggtttgtcctaacccaatacacgcgtcacctggaaattgacattacacttgcacaaaccttcactgggcctaacaagttcggcccattaagcccagatgctatctgggcctcacgtgccgattaaacctggcccaaatgattacttagacctcatcaagttgcgtccttttctaatcatttttcttcaaactatttttttcttgcaaagttgcaagaaaccgcagaaatcaaacttcattatgaaataagggtctgttcactttgatgccattttcaaccttactaaattttggtaaagttaaaaaaaaaagtggctacatttagtttgctgccaaattttggtaactatataagaaatcatatcaggcaactatgccaaaattttggtaatgccaaaaatttagtaaggtttttttttatcaaagtgaacaggtcctaaatatatggttccgtagtccgtacagtttacgtacagaaatggtcttccagcattatggttgcgtaattctgaacttccttcggcccaaattcatcaagatatacagcagccaatgttgtacaggtcaattttctgcttctgtctgacctgttccatggataaaatttgtcgttaggaacagttagtcaaaattattatttaatgaacgttatttttcccagattactggggaactatagtgataagcagcagtagtagtactttgtgctcacctgttgataataattaattgagcaggtgattgctctgattaagattggtacttgctccgatagagaactctacggattaactttgtttgttggatatatgtccaatactcaatgtttacttttgtaaggtgtaccttaatttggcactgcccaagaaaattttgacaagtacttattttttaaaaatatttgataccgttgaattttagatataagtttgactattcatcttataaaaatattatctatatgacttatatttttacacatttgcatacgtattttgattaagacgaatggtaaaacatgtttaaatgtcatcaaacataaagaaaagggagggagtaatcgatctctcttccattcttacagcatactggtaataattactagtataaaaccatgttcagacatatagagaattggaatatgattctctacccaacatatgcataaacctgactgttgttattccaaagttacaaagctaattttgcttggttttgaaaagaatttgcaaagttaatttggacttcaaaatccaccctcctgaaaaaaaagaaatccatgggtggaatgagaagttgaaaagaaaaatcttttggtcatgtgcttgcatggtctcagtcaaccaaagacattttccctatatatctttaccaatctctcccagcttgcaaggcatcaatcttgaaagctcctctctctttcttcctctctcg

SEQ ID NO: 12677 - DNA, 1501 bp, Oryza sativa
acaaaaacaaatggagctgcatgtctccggccatccgccggcgatcgccggagctgagaaatgaagaccgcgcgatcacctaccggaagacgtcccagcagctctcgacccccggcggcggccgcagaagcccggcgtccttggccagcacgttccggtacgtcggcccggcattctccgccgccttctccgactccaccaagtgcttcatcatctccggcgacggcggcgacgacacgacgacgagagaggaagaaagagagaggagctttcaagattgatgccttgcaagctgggagagattggtaaagatatatagggaaaatgtctttggttgactgagaccatgcaagcacatgaccaaaagatttttcttttcaacttctcattccacccatggatttcttttttttcaggagggtggattttgaagtccaaattaactttgcaaattcttttcaaaaccaagcaaaattagctttgtaactttggaataacaacagtcaggtttatgcatatgttgggtagagaatcatattccaattctctatatgtctgaacatggttttatactagtaattattaccagtatgctgtaagaatggaagagagatcgattactccctcccttttctttatgtttgatgacatttaaacatgttttaccattcgtcttaatcaaaatacgtatgcaaatgtgtaaaaatataagtcatatagataatatttttataagatgaatagtcaaacttatatctaaaattcaacggtatcaaatatttttaaaaaataagtacttgtcaaaattttcttgggcagtgccaaattaaggtacaccttacaaaagtaaacattgagtattggacatatatccaacaaacaaagttaatccgtagagttctctatcggagcaagtaccaatcttaatcagagcaatcacctgctcaattaattattatcaacaggtgagcacaaagtactactactgctgcttatcactatagttccccagtaatctgggaaaaataacgttcattaaataataattttgactaactgttcctaacgacaaattttatccatggaacaggtcagacagaagcagaaaattgacctgtacaacattggctgctgtatatcttgatgaatttgggccgaaggaagttcagaattacgcaaccataatgctggaagaccatttctgtacgtaaactgtacggactacggaaccatatatttaggacctgttcactttgataaaaaaaaaccttactaaatttttggcattaccaaaattttggcatagttgcctgatatgatttcttatatagttaccaaaatttggcagcaaactaaatgtagccacttttttttttaactttaccaaaatttagtaaggttgaaaatggcatcaaagtgaacagacccttatttcataatgaagtttgatttctgcggtttcttgcaactttgcaagaaaaaaatagtttgaagaaaaatg

SEQ ID NO: 12678 - DNA, 1501 bp, Oryza sativa; identical to SEQ ID NO: 12672

SEQ ID NO: 12679 - DNA, 1399 bp, Oryza sativa
aggagatgggggaggtgttcctcccagcttcctcttcccccgggcgtcggtagggcggctgctccccgagcccccgacgcggggcccagaagcacgaccccctccgggggtagattgatcccctcggcggctcccgcctgcgccgtcatggcccttaggagcctgctcctctgaggccccgaccgccgtcataatggtcaagatggaggcgcgatctggatcgctgcagagggggaggataccgtgggggatgagggacgcctccacggagttgagatttagcacacgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggtggcgataccgactgcacggtgaagaaccaccggaacagccgaagagatgggcacaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcaaaggggagaaagaagacggacctccccgggtagtctggcgccgggcgtccctcgcccagcgtgactatatcacggccggtggcagattccggcataaagcggcgcggcaacccagcctgcttctcgctcacgatgcgggaaggcggcagcacgctaccatcaagcagtgcggagccccgtgccatggcgccggacgaagagaagatggagagcgagcgtgtgtggcgaaagaagggcgcagggaagaaggagttagggcgcaagcggcgaaggcaaggggaatgatggcgaaaggaaggaaacaaatcctatcctcagtgcctttatacccttgccaacgctgtgcccggctcctcgtttctcgcgcccattatttcgccccctcgtttctcgcgcccacgcttccactgatcccattcgcccgcttgcggcgcgtgaagtggatatgcggttgcggcagtcgagatagatcgtatcgtgcgcgcgttaattacgctc

SEQ ID NO: 12680 - DNA, 1501 bp, Oryza sativa
tttgttaattgatttgctagaactctcgtcttcctatagaaaagaagaaagatttcatttgcccgtgtaaatataagtgcacaacccacgagagaagaatatcttcctgtaatcctaactggaaccatttgttcaagtattttttaaaaacaatttaagtcttaacgcattcttaattctaaatcccaagttttagagtttacaaaaaacaacaaacaaaaataatcatataaccaatatatatctctacgccatccaattctcaatgcattacacatatatacaaaatagtatgtggtatttttacggcgctgctatacatacgattcttttttacgattgttgtacggtaaaacgcttctttccagcggttgttaacgatgaaatggattcctcttccactattgagcccatatccaaagctcaagttcatgatgatgtcttggcctgctatatcataaccctttttttttgataaatttgtccttttcaaaaacttatttcgaaagtagtcccaacaaaaaacttcaaccaaaaataagccatcggctcagcgccagagaagttggcaccgagttcctacatgaccgtgccacacgtgttggcgctgaacccctgctaacgtggcggccgagccaatccccttcgacgtggcagggttctcagcgccaaggcggttggcactgagacggctaacctcgccaaacgcatttgcgttgagcctgcagcctatagatcgcggccgagccgcccaggcccggcactcccttctttttatcctcgcggctagggttcatccacgtcgccctctctgctcccctccgaatatctcctcaaatatccctcaaatcgaaggctattttgtacgcattgcgttggagattgatttgtaaggtaaattccctccaaaaaccctaatttccccaatgttttcatcatttttgtagagtattttggttgaaaccgtacgttattgaatgtggctcgggttgtggtgtgaattagggaatatgggtaagaatgcaatgttgtagttgtatattgatgttcgtatagaggatacatattgtttttgcaagttatacactattttgctaagggtgaacttgggagggatgtatagtgccgttgtattgtgaatattttggggattcatactgatttatgatgatgttgataggtatagatcctaggaacattgtcaccggggggaacggctcagccgccacgctggcagggtgttagcgccaaggtggttggcgctgagtcggctaaccttagcgccttcggcccgtgcaccagatctgagagagggagaggggtggtggcggcgggggaaggggaggagggaggagcgggggagaaagacctggatccgccgcctctcaccttcccgtcgcccgagtggtcgcgccactggatccgccgcccgtcacccgagccgccgcgccactagattcggctaccgcccgtcgcccgagccaccgcgccacctgatccg

SEQ ID NO: 12681 - DNA, 1501 bp, Oryza sativa
acggtttcaaccaaaatactctacaaaaatgatgaaaacattggggaaattagggtttttggagggaatttaccttacaaatcaatctccaacgcaatgcgtacaaaatagccttcgatttgagggatatttgaggagatattcggaggggagcagagagggcgacgtggatgaaccctagccgcgaggataaaaagaagggagtgccgggcctgggcggctcggccgcgatctataggctgcaggctcaacgcaaatgcgtttggcgaggttagccgtctcagtgccaaccgccttggcgctgagaaccctgccacgtcgaaggggattggctcggccgccacgttagcaggggttcagcgccaacacgtgtggcacggtcatgtaggaactcggtgccaacttctctggcgctgagccgatggcttatttttggttgaagttttttgttgggactactttcgaaataagtttttgaaaaggacaaatttatcaaaaaaaaagggttatgatatagcaggccaagacatcatcatgaacttgagctttggatatgggctcaatagtggaagaggaatccatttcatcgttaacaaccgctggaaagaagcgttttaccgtacaacaatcgtaaaaaagaatcgtatgtatagcagcgccgtaaaaataccacatactattttgtatatatgtgtaatgcattgagaattggatggcgtagagatatatattggttatatgattatttttgtttgttgttttttgtaaactctaaaacttgggatttagaattaagaatgcgttaagacttaaattgtttttaaaaaatacttgaacaaatggttccagttaggattacaggaagatattcttctctcgtgggttgtgcacttatatttacacgggcaaatgaaatctttcttcttttctataggaagacgagagttctagcaaatcaattaacaaagggggatggagaaagatactcctaagtgttttactccctccgtcttataaaatatcaacttctgaggatggacataaataggcatttgtctatattcatcaatagaagattttttttttacaaaaggtgtacagagtaagagccaaagcactgaactagtacaactaataaaaacagatgtagcagctttttacattacaactaataaagcactgaactaggagatcggacagatggaatcttcaagtgcaaagtagagtttttcttatttgaagacagaaaaagacagtgggctgaagtattagataaacagaacgttgatcaaaagacgtatgagtcatgtgaaggcttattggaatttgggaaggagcatctctctctctctcttgagtcctgaactagaggggactatagtcaagacttaacatctcagcttctgtatcgtgctcactttccagtttccacccaccgcatagtctccctgcagtactgtcgatcgctcaatcagatcacaagtctaggccaagatccaga

SEQ ID NO: 12682 - DNA, 1501 bp, Oryza sativa
atgaaaacacgtgcatgcacaccctcatttgtagacctaatgctcattgcattgataatcctagcaagaataggttagcctatttggataaccaaattaaagcaagcagcacgcacgttgaaaacctattcaatattttgatttctctgcatcgttgtggtttgttatataacttactaacaattatggtcacttaagtttttatatggggttgctagctataaaataggaaattcacgtacataccactgagggaggagtacatatatagagagaggagatttcttttattggaaacagataattaagatatatctaatggttagaaataataggttcaccggtttataagttataatggatggtcagatatttttttcttttttctcataatttttaagatttttctaatttattagagtgccacgcgatggttcaggagagtatatagggtgtcacatgatgacttaagtgtgttcgtaggaagtttaatgaacttgtgatagaatacaactcggaataacatatatttttacaactattggctgaaattattaatttggtttttatctcatgagagtgaaaaaaaaagaaaaaaaagaaaggaagggaaggggccacgtacgaagtatgcacgtacatgcacgtacacgtatgggatggatcgacgtagaacgtggtgctttctaaatataattctatttggtatttttttagttagatctaacggttaaaaaatataggttcaccagattaaatgaaaatggaatatttttattttttcttggacttttattagagcgccacttggcggcctagaaacatttatagaaatgccatgtggcggcttagtaacgtttgtaggaagtttaatggacttttagtatatataataatagatagattgatagatagatagatttatgcagctcaagtttacacatataaagtttagagacccaaagtttataagtcaacaagtttatatatccgattcaactttgaatttgaattcaaatattttttaatatagtatttctgtactaatgtttataaacctaaagtttatagacccaaagtttataagtcaaaagtttacatgcccgattcaaattttaatttgaattcaaatattaatttatagacccaatgtttataagttaaaagtttacatattcgttttaaatttgaatttgaattcaaatattttttacatatagtatttctatacataatttttttcaattttatttttattttttttaaaatttatggtgcagtaggaagagaagaagcggagaagaaaggggatgagcgtatagggggacaaggggtgatcgctccaagcgatccatctctccttagccacaccccaactttaacacgtctcagttgactataaaacagactccaatgtaatctccccattaccagacgaacagctagcgatctctctttctctgctgcaaactaattaacgggcatagaatggcatcggcga

SEQ ID NO: 12683 - DNA, 1501 bp, Oryza sativa; identical to SEQ ID NO: 12682

SEQ ID NO: 12684 - DNA, 1501 bp, Oryza sativa
cagtagtttttgggcccatctaatctacatcttccccttcttcttccatggttggccagtgcttgccctctcctaactaccaagcatcaaccaggctcgagctctgtacaccagctacaagtgagcgttctgttgacgtagaatcgtgctgccgccacacacgttatgtgcaacccatggcgcggcacccagagacgcgccgttatagggcgcggatagatgtcgccgaacgagcactcggagagaccccgtcggggtgaacacacgccggtttgtcctagactcaacaggccagctaggatgtccggtttaaggagaatatacttgggataggtagcaagaaaaagtgagatagaaaatatagatggtttggttattaaattgattttaacgattgattggttttgtttcaatccgccttagctcacttatatctataggagggttgaaattgcttcccaggttctttctcacgttcaattagctgtagaaaccaattagaactctcaaatatcaagccttagcaagaaaacccaagaactgataaatcaaacttgtagtcggactctaccagtctaaccgatcacatgctgccggtcagaccggcccctgctatcggtccgaccggcctcgtatgacaagtctaggttctttttaaatttagcaaaagttttcaattttatattctagagccaaatttgagtattaacacgtccaagtgctgcaaatccagctatagctgcagtcggtgccgcaacgcccctttctccactcaatcatttgtccagatccatgttacttggttctttagttcatccggtccactctctttcttttcttagcttgtgtcccaagggcaagctccggcagctagcgaacagcaaatggtcgcatcccctacacctccaatgtacacgccacagccagcaggttgcctggtaattttgatgccgaacaacacatggttgtacatatttgaacttagctcgtactgttctttagccaaacaatttcatgctaatttcaaattctttcatttgtgctcattcacgaatttatcttgactcataattgctatttgggtctgattttgaagggaaatcggcaggaagcatccgagaacaactcactgcgcacttcctccatttttgcagcaagctagtactattcagtggttttagtcctcaagaaattgggctatttgttttttcaattttgtttcgttcttgtcataggctctccggaccttccattataattgagagatgaaatgaataattcaagtcatcaaacaagcataataaaatatccgacgcctcgagagaggaatattggagacattgctgagcctttaacctgccagtcaacttcagcctgagatacgcccgtcaaaccactcgaaggcagtgaccagatgtgttacacattcaggagacttaacaaaaatggctaaagatctataacatctcaaatattcttaactcatactcatgtgaatcta

SEQ ID NO: 12685 - DNA, 1501 bp, Oryza sativa
tgggtaataaataaactagctcatgttacttatgtgacctagctagaactatattcttagccatgcttaattactactagcttagttgacgggataattacagtattagacctttttagtattagaatgagctgcgtgctcgagacatctggccatacttaatggtcgtaattatccaactaaaatgcgactgaatggtggactgtgggtgcatggttttgctagtcgcacccatggcagttaaggaccggttcgcgggaaaccctggaagaattcctcgtactttccacaagccagcgtgggcaacggctgggcttgtagtgtagctttcctctagctgacgcatctagacaagggtgggcgtgatggagtttggatgggccctgcgatggcctatgcggctttcggattcacctaggcacgagaggggactgcccgctgccttgcgaggattgagggtgaaacctaaggtgtggtgtgcttggttagagggggttatgcgaagggtcctgtcacggcctctttccggtatgtcgtggtggcatttcggcgcacggaaacatgtcgtggggctatgtcttgtgggtacagttgtacacctctggccagagtaaaactattcgaatagccgtgcccgcggttatgggcggtcgaccagattcaccgtgattagtcccaccttaataaatcgacccaatgcattgtagtttaggtgggttggttgggcctgttcaacgtggtgtagcgttgatcagtggagatttaatgttactttaattactcaactgttttactgtttgctcaataaaatgttttacaaccgccttaatgcaaatagccacaaaccgtccttgtgttccccttgcacgttagcatcgttggtgtgtgttgctgagtacggtggttgtactcagccttgctattatttccccttttcagaagtgtagtgcttctgagctgaaggcgaagttagaagaccaaggctcagaccccagttgagttttgcctgtggagtggagctgaagcctcgctaggatcgcctgtttccgctgctgctgctttcgtttcggtgtgaggactaagtgcctcttctgtaagtattttacgctttatttacgtttggaactgtatattacttgtcgttttgtgtaccctggctggtcctggacacggatttaatacacaaaatagtctggaaatttgggctaaatttctgggcgtgacaacctaggattaaaataggaaaggttgccaaaatttggaagtctaccggtttcctttgagtgggccggtcagaccgtcgtgtgttgggcggtcagatcaccgattgagtgccgatcagaccggcggtgtgtgtggccggtctgactggcaggtccgagtccgactgtgtttcattgggtttcgaggtttccttgctcgggaaggcatgtttcgggtttcctttagtttctaccccgagttggacgtggaggagggcctgtagagggcaagaccaacc

SEQ ID NO: 12686 - DNA, 1501 bp, Oryza sativa
tgtgccatggttcaccggcaaccgccgctcccatgccgttcaccggtgtagattttttcctagggtcttaatccaatctaatctaatccgttgtttgtctagcgtcgtcgtcgtctccgtgtgttgccgccggatcgtaaacgtcgaccctccctctccgatcgctttggttcggtgagacttctatccgtgtcccctcgggttaggtttcaatccctcggtcgtgtcgtcgccgttgttgctctaaccttagcgcagccgctgccgtgtcgcttgctggctgccctgtgcaccgccactaccgccggctccttgttgccgccgcgtcgctgtttagccgctgtacgtcgccgtcgcgctgctgctgcatgtgtgccaccgcaaccgcggttgtgccgttgccgtgcgcaacgcctatcgtatcgctgtgccgctagctgctgccttagcgtcaccgctgcactagctgcctagccgccgccatgccgctccctgccacagccgtgctgctgctgctgtgcattgccgcttctgctgtgcattgccgcttgccgctagctgtcgttgggccgctacttgtgcatgccaagtggccgccgtcccgctaccgcagctaccgagccacttgctgtcgtgccgtgccgtcgctgttgtgtcgtgtcgcagctgtgtgccgtttaaacctagccaccgctttagctcgttgctcggtagtcgagttgtctagccgtaggtacatccctaggttcctaccggcctatcgtttgccgtaccggggctttaccgtgaatcgtttctagtccaccggtttagccacagccgttgttgagttgttcgctcgttcgttcgaacgaggtgttccccgtgtttcgttcattcatccgtgtggagtcgtcctttagtttagagccgtcagagctgccggctccgttcgccggtttcggctaatcatttaggcgatcccgtgtcatgtagaattgactcgttgagtcggtatctcgtgaggctcgcttgccagatcaatccaagccatctgatcttggtcaactctcggtcaagattaatctcagtcgtccaaaatcgatataaatcctctcctcttttcaatggcatattattcctttttaatatatgtcatctaccaaatatgatctaatcttttctggaggttgctttaatcttttgtctcagttataaatcatttgtaaatggtttaattaatttggaatagtcttttctttaataggtttaattggaattaaatcttgtaaaatttgtaattaattcatatgaaatcggaatgagaccgttcaagtctctaaatttatgtaaaatcatgatctacatgtttgtttacttttatgtactgtttatttggtttttattagtctttctcctcgtttttgcgtgttagcttgtcgtttccgtcgtttcgaaggttcgaaagtgcgtcggaagtgttccagaagacttattgaagaccgaatattgcaaggcaagt

SEQ ID NO: 12687 - DNA, 1501 bp, Oryza sativa
tcccttcctcctccctcccctggagatggatgaggccacgccgcgcggacgaggtggacggacggacgcgcggcgtgcggcgcagacgtgcgttgcagggggagcacatgcgcgcagacgtcctccctcccccaaagttacttgttgtctctttttttttttgatattttgtgattcactgatatgtaattttgtgattcattgtatggatttgagatgtataatctgtgatgtatttgatttgtgtgtaaattttttaggatttgtgatgttttagatttgtgtgtataagtaactttaagatttgtgatatggatttgggatgttactttatttgaggatttggggtttaatttgggatgtgcatgtcaaccgattcgggagaaaataaaaaagtaacaaaaaaagaaaaggggaccatccgggattgtccctatcctctctttagtccgggactaaagatagatctttactcccgggtgaaatttactctcggttatttcatccaggactaaagatagcgatctttagtcccggattcacagtcccggttttctaaccgggattacagagggttacaaaccgggagtaaagacagtttctctaccagtggtatatcgtatattgccatacggcgacgcgtgcatgttgccaattcatcaccgttggatgggcaggtgatagattcggacaccggcgtcaatgttgggcaccaaatcgcggcgcgaaacgcgtgctgatgctcagcacgtcgttgataattaattttgtttccccttccttttgataggtttcggacgacgtcgtagtcatccacatgtacagacgtacacagtcgatcaacacgcctagtgtttaataacacacgtctaaacaagattatttttttcttttttgagaactaagtataagattagttattagagacgtcgacgtacgtatcatcacgtaacgtggccaaatgtttccagcctcaaagctcgaaccacgtacgtttagacgattagttaaaagcaaggctaataatacagccgacctgttggatgtaaggttttttataacgttctctcagtctacccatataatagtgagctctttataattaatacatggtccacttgtctctctcacagagtttattggttcctgtgttcaagccggctgtaagtttatagcccgcttctcctctctttcctctcttctctccttcacctcagcatttagccggtttatagcctactattatacttgctctaagactcgttcatcaattactaagcacgcacgcccagctggcggctggcatgcatggttaattatcgattaattacgtcgttcggcatattgaattagtctgcaatgcctggctatgacgaaccaattaatatactcctctcgacccacagttggtttacagtcttgactgcgcatatatcagtatattttggaaaaagtacgaattaaccctgaactattgcgatcggccgacttaccccctaaa

SEQ ID NO: 12688 - DNA, 1501 bp, Oryza sativa
cagtatcaaacatattcacaacataaatatgaaagtctctctgaagccaaagaacatcattgtcagctccatggaagatctgacaaataagtagggagaaggtaaatgaaactgcatttaataaaagaaagcaacacagatcttctgctgagacgattatacagcaattgattttggctaatagtcaaaaactcattagaaattagtgtaggtgtctaaaaaaggcctctgccactacattgcaaagaaatgagattacaagctaaaatagttatgagctctgaaggaattcatgagactatcaagtgccagagacaatactgaaggttccatatgcacaaaggacagaaaaagaaaagggagcaaggatggtaatgaaacaactcaaaaccgtagtctaggggttagagctagcatcagttcatatacataaggatgtctatacggctttgtaaaagtttgcttcactgtggtttatttttctccatggtgaaatatcaagcagacatatcgataactaaaactctaccaatgtccaaatgttcacttgctaaagtgtgatcatcagtttgatagtgagtaatagacagagaagagtaaacaaaagagagagagagagagagctgacaaagaataatacatgaaaaaagttaataataaccagacaggaaaggaaaaaacaagaaccaaatgattcatatagcattgattctgaagagccaagggtaaacggaccatttctgggcaaaatagtaaaatgtctatgagaacactgatggactcattcagcaatcttatcttgatcaaccaaacacccaccgtaccatgtaaatcatccatgctgttagggccccatgttccagaaattcaaatttacaagaagatttaagggctttaggtttgttggattgatttgttaggccaaataccaaactcagcattcgttcatttagagtgttcggggcccagcttctatagaaattacatgtcttattaggattggctgaaaaaatttttgacttattgtccttcaaacttccatattttggttgtttgtgtatagtggttcctggccctgcagtatcaacaacgcagcatgattcttggaaaaaaaaatatattactacctctaatgcagagacacataattatctttcatgatggctgagaaagaacaatccaccatcttatggatatcataaattagagtttagtgggtttaagcttgatacaaacaggaaattagactgtcaaacaaaccacgtttaggagggatgaactatgaaagctctaggcttaatccctcctgcacatcagacaatgtgaatcatgtgttatggtgaaaatataataattaaaaggcatttttacattgttttatttatggaccatggaccatggctcagctctttaaccagaaagaatcaatctctgaacttctctagatatcttttatagtaatcttagtaccaagggtgcacacaaatgtgacgctggtgga

SEQ ID NO: 12689 - DNA, 1501 bp, Oryza sativa
gcaaacagaacgctcattggacagcgttggacagagatagatgattgcctccagatccagatcactcgatttataacgttgttttgttttgtttatgggtttagataccaggctgacagtctcacaccgagagctgctaccttgaccgctaatcatgttcacagattcattgctcaaagaggatgaaggcatgtgttcatatttggtcctattcttcggtcaagttctttgctccgggtttggtcaaaataactcatcatgcattcctacagatggatagatttctcagtctgtactgaagtgtgaataatttaagccaaaaatgcaggttcagaataatgtagtcgtccgtacatatagtttgctgtgagaatcttttaccagttcttggtatattgtaccccctcgttcttggaggaaacttttaatttggattgtgtttcaaatcagtaaaataaaaggatgcagctttctctctaaaagaaaaaagaataatgtactcatacgtacatagtttgctgtaagaatcagaaaaaccctctttgcctatggccaattaatgctggataaatcacatatctattttgggtgtgtttagttcacatcaaaattaaaagtttgattgaaattgaaacgatgtgatgaaaaagttggaagtttgaaaaaaaaaagttgggaactaaaccaggcctttctcagtctatactgaaatgtgagtttaagccaaatgcaggttcagaataatgaagttagtacatagtttgctgcgagagtaaggtacacatgaattcgttaccttaacacacactaaaaagaacaagtattaacggcagttccttgatctcactaaatttctgttaaaaacacacacgcgtgtaatatttgtggtactaatatttgaatcctactggagtccaccacacttatggtgcttgcatcaattccaatgtccaaaactaatattgttcgactaaaaccagttcattttgcggtatgtatttgctaattgtttgtttgattggattttctagaaaacttattcgttggtatacaacttttagaagacatacgtgaatgtagaattgtgaataatataggagtaattgctgacagcttcccaggagtgagagataaattcagctgaggactatataggctgaattctcgattgcccatgacagtatatacacatagcaactggcaactattctagttgcaaatgaaataactagtgagaacgccctcccaagcccccaacatcatactgaaaaacaaccactggtaggtacaaatattcaaatgtggttgaattgcattgcaaaaaacgtgtattcatggatcatacaagttcccaccgtgtcatggattagatcgaccagatgcctggtaccatagagagtatttatgtagcgtagtactcctattacaaagcaagttttcatcaactatagaagcttagccacacagaactaaatggcatgtttgggcgtcttgtcctcag

SEQ ID NO: 12690 - DNA, 1501 bp, Oryza sativa
ctgtttttttttcttttctgtggttaattaagttttgggattttgttttcaccatcaatgtatcggtttctggttgttcttggctttcagtttcttgctatgttttgggactgggcattttttgtctctctactaccatctgcaggtgattttcaagttcctttccttctagcagtaaaactcaatgagctgtcactgcctgtccttttcacctcccacattgcaaccctgcttgattctctccttccatttcagatgttgtttcatcaaaagcaaaaaagaaaaaaaaaggtctcccattgccacatctccttgcatttttttccaaaagagaaaaatctcctcccctagtggcctgctgcattgctgttttgcattttccaacagaaagatatgtcctggtttgttttggtgatcttggcctacaaaattttgtggttaaagttacatacgtttgaacatttaaactttgcttctcgttttttatacttttcttttgggcattctagaaatgagtatcttgcatgcccttctattttatctgtattctgtactgaagttccaaccagaatgaggtgtgtactccttttgcatttccccccttttcttgagtttgcgttgtgaacagtgtgctaacagtggctgtgtgtggcctacctggtttatttgatactgatcattcatttattggaattattgttctaggagtagctctcatccatcccatcttgtactagtatcctgagaaaaaagaattgcaatagggggggggggggtaccattcttgtggttcggtccatgtttatggtcccttcatttttctcccagagatctactttggatctacaattctagacatatatagtagtagtagtagtagtttgatgttaaaagctgtgaacaagttgtattttgggtttatttatacttgagatattttttttttgttgttgtttcagttgttggtgaaagttgtgcattctctctggtcttcgtacattttccacgtagaccgtctgttgatggttgttgcgaattgggcacatatttccacggagcttttatgtcttcccttttcctcaattttttttttaaaaatgggcatttatatttctttatcctcccgaagttgtgttttcttggaattggttatcatctttacatattgtccacttatcggtgcattgtactaccttgctaacaaactctagattaatatctttcttcagtaacttaactgttattagtgttaatgtgtaggcactaggcagtactgttactgtatgagatcagtgtgtggggactgaattgtgtgtctagattttctcgcttaacagttaccaaacattgtcgatgcccatgtgcattttatcatatcattgataggtaaataggaggggaaagtaccaaaatacactggaggagacaatcttgtttttcatttactttttctgatgtagaagcagattattctactagtcaagaacagtaggtattttgc

SEQ ID NO: 12691 - DNA, 1501 bp, Oryza sativa
aaacgtatgcatcgttgcatgcaaggcaaagttaattattcgaataaaacagaagctttcaatggaactgtcgaactcatggtacaggaccgaattcacgaataaataaagttgcaagtttgctggaaactgtacaaacttaatcattagtaaaaagaatttatagcatatgagcgtgcagtgcgtccatagctccatacttgtctaggattaaattttcgatatgatatatatagcatgcagacaaaaatgtatctgtcaagttatcttgtcttcactgttcatatgcatacatgcatcatgcatggtcccagggctatacataagatcccgatgctaaatataaaattaggttgtacattgaagaatttccaagatcaaactttttaattctgtttacttatggaattgcaacatatatattttgtaataatactaagaattgcaaaggatattcctgatacaagtgtaaaagatatgctctcttcacgaaattaaataaaggatgttatacgggaaagcgtaacatgtccttgttcaaacaaaagaaagagcaaaaaaaccttgttcgatctgcttgagccttgatgcaatgttgttggaaagttgtaatatctaaagatttcttctatttactgacaacataggccggccgatttcaactttttccatgtagttcatgaattttgattcacgttcaatagtagttcatcctagtttaacactgtcatcagcaagatatatatccttgttgttcatataatattccatatactttgtcagcaagttgaggggtaaatatattacaagattattaaagtcccaacttcaattaatgaagagtatatatacctactgaaattaaatacgttcaaaatactaattccgttttttatttgacaatgttgaattattatataacttttcaaatagaatgaagtgcacgggcggttcttaaacttgtacagatgtgtcatctagatgactagatttctaacatctcaaaaatgcatttttgggtccccaaactcgtcatgtgtcatatagatctaaatggactccaacccgctccgtgagatgacgtggtataccacggtgatactttcgtgtcagtgggatccacatgcatgctagtcatgtagaaaaaaataaaatttaaaaggagatgagaaaataatgttttcaattttgaaaaaataaatgaaaaaagaaaggggaaaaatatttcctttttttttaatatgtggcggacatatatatgagttctattgacacgtaggtgccaacatggctgccacgtcagcacacggggcgggttggaacccgtttggatctatatgacacacgagacaagttaaagggctaaaaagttcattttgagagtttagtgacctagtttagtgatctagttgatacacccatacaagtttagagaccgcccgtgcactttactttttaaatagtaagaccaataatcaaactgtgtctatgtatatacata

SEQ ID NO: 12692 - DNA, 1501 bp, Oryza sativa
tttcataatatttttgttttgtgctgaaaatattattatatttttctataaagtcggtcaaacttttaggaaaaagtgaaaatagtccctaatatgaaatggagggagtacaattataggccaaatttgggcccataaagtggtgggctgagatttcggtccatctaaaggaaggacacggatggacctccatcccagttaaaaggggccgactggacattgaccgtacgtccgtattgcagtcatgtgttagaatttgtttctcttttttttaagcaaaaacgaacaaggtttattatttttgtttcagaaaaagcaaaaaaaaagagaaaatttcataaaactacatgtattttgaataaattatcaaacaaactatatatttaacatgatgtatcacaaaactatagatttaacactaaaattattatagaactatagaatggaatatcacaaaactacgcatttagtaacacagttatcaccatattatagaatttaaatatcataaaactataaatttagttacaaagttaccataaaacttggacacctttaactctaacataacattattgattattgttaatgatttgaactcaaaaatatatagttttgtgataattttattattaaacatgtagttttgtgataaatttagtgttcaatctgtagttttgtgatatatcacattaaatctataattttgtaataatttgaccaaagcatatgtaattttgtggaaattataattaaaaaaagttcacaatcgctgccggctgccgctgtcatttttgcttgggatcacagctgcttcagatacacccacatctcaaatgcaaagcttcatcatcaaattaaagaaagaaaaaccttcgaagcatttcattctacaaacgttgggcttacctaccgttcgttcgctgtacaggtgatgaagaaactgagggtggtattgcttgtggttaccaagtggctggtgccaaccacaacatcgttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttgg

SEQ ID NO: 12693 - DNA, 1501 bp, Oryza sativa
ataaatattatcaaaatttatgaattttttttaaaaaaaaattgaccaaaataatatcttatcgaagggatccaaaatgtccgaaatttccaaccctgtgaaggcgtggagatggcgcaaccatggctgttgtggttgcagcggttctggctgtgagaggcactgaagcagcatattattatactccctccgtcctataatatagcaacctaggaccggatgggatatttcatagatgtccggattcgttgtactgtgtcccatccggttctatgttactatattatgggacggagggagtacaagataacctcctgtccatccatttcctcccccatgcagatcaagtttttttttttttgaatggatgcagatcaagtattgatatttgattgctctattctgtgtcgattgttgtaggtgtatgcgaaacctgaattttgtacgtagctgtgtattgcatgactgatgagatgaataaaaataatttactccctccgtctctaaatatttgatgctgttgacttttttaaatatgtttgaccattcatcttattcaaaaactaaactatatgtatacataaaagtatatttaacaataaatcaaatgataggaaaagaatcaataaaacgaatgatcaaacatatttagaaaaatcaatagcgtcaaatatttagagacggatggagtagcatatagaggtgcaatcgcctttgactacttggcgctaccgcaagagctgggcgcgtggagctacaacgcgaagaaacgatagaagcagcaccatcaacgataaattcaacgattacttaaaaaatataaaaaataaaattacagccctatataactaaaattacatatgtaaattaagttgatatgatatgtaagtggattgtaattttgataaaaaagatgtgtaagtaaatatgtatttgttattttttaaatataaaattacagtcctatataactaaaattacatttgcaaattcagtcgatatgacatataagtgtactgtaattttgataaaaatgttgtgtaaataaatatgtatttgtttttttgtccgttggatgtaaatctaaagttggaaaaaatttggatgatttttttttctagaaatcacccaataaatggatagtcagatccataaataaacatcaaaattatccctaatcatataagtagcaaagtactgatatagccttataaatcaacggcttagactattctactaatagtagagaacaccgaagcaacgactggctggccgagttgatcttctgttaatccagctagcaacgtacgaatccgagttggcgagttatcgtgtataagaatgtgcgagggtatgcggtagaatcctccgtccatacaccgatcgatacaccctcttacgtatagcagactagcagtaaacccaatcaaactgctgtacttgctagttgctactccacaatgacccgttacaagccattggtgttgccgttgatgctgat

SEQ ID NO: 12694 - DNA, 1501 bp, Oryza sativa
gactacctcgacaagcccccacggcgtcctctccttctcggctctcgccgccgacgattccttccgccgtggctcgtcgccgcgctcaggtaccttgacgacgacggcgatctctccatggcagagaagaagaagaggaggaggaggaagctccttctcgcgaccactgcgcaggaggcccacatctacgacccggactccgacagtctccggaagatggcctccattgctggccgggcgacgacgattcaatgcgactcgtgctgtaccaggagagccttgtccggtttcctggcatcatgatggcaaaggaaagattaagtttgtacagcttgataatcgtgagcaagtaatcctgagtccgtaggcagatcagtcacggcaatatttccagttttatctctcaacaaataaataaattccatgctttgtgttagccacttcgtgaagccttccagcagtttcttctttcagatgctaaatccaaaatccttgccaatgcaaggttgtcaggaattcacaaatatataaatttaaattcaacttctacaaattataataaaaataataaatttgattgaatatattacatagctaaagtttaatttgttaactattttgttacaatttggtcgtgaagtgatatattacatattaatctattttgttaaaaaaaattaaaaaatagattatatacaataaacaaacggacattcactcgcgtgaatagaatccttatcgtgaacggatgcacgaccgtcaggttccagcaaggccttgcacgctcgaactgagaattgagcatcttgagtgcagccgtggagtaacggaatgaactgacgcgctgcgaccgttaaaaatcacgagaatcctcaccatcaaataatctgctcccttagctgctgctaactgacgtctgaggtggctcgtgtgcagtcgtccaaatcgccattcgcaactgctttgttcgcatgccacctagcatcaacgacgacgactttctgaaatctcaccaaaaaaaagaaaagcaaagcattttgaattcgtttttcctccctgaattgaaggcaaagaatcctgaattcgccgggaacaaacctcctgtcgacgcctggacagattagttagaacataatcctaattcagtaattcctaactcgacatcagcatcaagacattgacacaacacaaaagcacacatagatagccacaggattcgctccacagtgaatccggaccgtccagccagggcaccgcccggatccaatcaccgccctccacgtggcaaatctcgcttcgactcgacagcttaacagcttttcctccctcgtgaagagagctccgattccgaaacggctaaaaccgctttcacactgcctctttcgcgcagatccatacaaaaccaccggaaaagttttcaaatcccgaagcggattcgcgcacggaaacccacagtcgattctccggtgagaggattgtttcggcggcgaggtcgggggca

SEQ ID NO: 12695 - DNA, 1501 bp, Oryza sativa
aatggtgtaatcagattgtagattggataattagtttaagagaaaattctataagaagaaaacaagatatgcactattggatatactaatagcaaccaaaactcctaaagtactagcacgtgggtgtctctggttaagactaattggagaggcctctccaattagatttaccgttggaaatactgttatttgagaaggaataagtctgttttatctcccttaatcgcaaaattggatgtgccctcacaatcttttaaaagaacttttttagaaataatacaaatttaacgaaaattgtaaaattagatattggttgtctaaaattacaaatttagcacactgtcgaagaacagattgttcgattgggcttaaaatattgggaatttgggatgtgtatgcatgcacatgcatcgagtgggttgtggagttcggtaggctgcacatgcacatgtactattttcttttttaaaaagtaaaaagtacgaattacctccctgaactatcgcggttgtatgatttacccccctaaactcgaaaaccagacattgctcaccctgaactttcaataccggacaaattacccccttcgaccgaatctagagcggttttgtcctacgtggcgtacacgtggcaatccagtcagcattttattttttaaaaaatagtgggacccgcctatcataccttatcttcccctcttcctcatccttttcccctctctcgggctcagagcgtgcagcacggtgagtggaggcgcgtggaggcggacgggtagtcggtgcgcgggggccggtgatgagcggcgggcggcggcgtgctggggcggacgggtggtcggcgcgcgcgggctggcggcagaacgcagggaggacgtggcaggcaacgggcgatgccgaggaggccaggagggtgttggaggcggcggagagaggtgcggagcctcttctcggttccgacggggagtcagcgggatgcacggcctccctccctccctcccactctctctctctctctctctctctctgctcaggcaggcggccggcgatgaatcatcctcggggtggcgcggcgagtggcgcgcgtagcgtggagggcatggtgggaggcgccgaggagggcatcggaggcggtgcgctacggcgacgagttcgccgtccatccatgtcatccccatcaaccgtcgtcgccgtcaaccggagccacacagccgcgccaacgatttcctctccccggccgtcgcgcccgccgctgctgtaggatcgagatgtcgactagaggggggggtgaataggcgatttaaaaacctaaatgacacttaatcaaaactaacctaagtttctaggctcggtgagggttaagtctaactaagcaactaggttatgttttgcaaacctatggtgatagtggctcaattaattctctaggaaagtaaattacactcctatgtcaatgttttgcaatcctagggtgatatgatctcaagtatgtctctaggaatgta

SEQ ID NO: 12696 - DNA, 1501 bp, Oryza sativa
ccaaaatccatggtagatttgaagtttgtaaggtcttttacaggtaccaggaggtactaatatttttagtgtaaattttggtaccttctaacgtggaggtactgagataccaaattttacactggaaaattaatgggctgtcaaaaaaattaatgggccgtcaaaaaaataatgggccgtttaaaaatatttgttgacgttacctgccacgtcatcagtgacatgtcatcacacatgtgtcaacgaccacgtcatctgccatgttggccgccatgtctcaactatctgtgacgtttaattttgtcacaaaggttgggccggggctggactacatgagcccaaaagtgtttatgacggttaaaaaaacatcatagattgtgctgatccgtgacgatttcagagaaaacgtcggcagatttaatctgtgactctcaatggatgacgataagtagaatcgtcacggacaaatttatgtgacgaattttcagggatctatgacgaattttttttgtcatagattaaatagattcttgtatatcggacagatcttttcgcctgctacgcaccacgaatatatgacatcaacccgcagtatatatcgcgcccggatatggccatgataaatgtcccatgcatatagatacatttagattcgttttcggtagtgatggagagcagcgacagcaatgacgtgagggctcgctcgacatcgacaacgccttcgcgtatagcgagagtgctccccccggcctgcagtacagcatcgctgttggagggccaagctagcatccggcgccggaggtcagtagcttatccgcccatggcgccggaggagacccctcttgccgccgctgctgcggacggtgccagacatgatatgctgcaccgtcggacacgcccaggctgctggacctcgtcgtgatgatgatcacaaggcgtgtctattacgaggtatagggtatagctccatcactaaagtctacaggcattatcttgttaattagctacccacttgatggatgcatgcttgtttatctgctaccttcagacggtggcggcaacgagctctcggctctcgctatccttgacgacgacgctgcactcggggctcacccggatcagcggcgccgcatactgctgcagcgaagcaaacaactggctctcgtcgccgtcgatgatcttcagcagcgaccgacggtggctgcttcgtgaatcccaccatgtttaatcctacacgatggtgtggcggggcggtcggtcgatgtatgtggacttgcggaggcgtcatcgacgtcgagagatgcatgtcgtcgatccccatcactgtcgaggcgcgtgactcgtcgccgccgcacgagccaaaacgctattgttcacgcggattgggccaaagattagcttggtcgcccaattaaacggtaaaccctggtgcaatctgtaaaggatggtaaaaaaagatggtgtgatatgaaaacttagactttgccctggtgcaagttgc

SEQ ID NO: 12697 - DNA, 1501 bp, Oryza sativa
gctggcatctacaggcgccccgccgcgtcgccctgtctccccgccaccgtatttcccctaccatggccgtctccaccgccgcaccttcgccttcgaccgcgtcgcccccgccgccggtcgtgccgtcctcgcctccgcctcgatgccgtcggcatctgtgcacgttgctgctgcccctctcgatctttctcacgctttgttagccgcgcctagaggaacacaagattttggtgtcgctgctgctacgtactaccgccgcttgccatcttcggcctccaccgacgggcacctcatccttgggctccaccgctggcgcgcggctcgtcctcggcctccgcaacatggcgcgccgctcatcctcggcctcccgccgctcgcctcagtgcgccagatacggggagagaggggaagcggcgaagaggaggggggaagaaggggaattaggctgacaagtgggtcccaccatgtttatttgttttggctaacaaatgggtcccatatatttcttatgttttgattgactagactgccagtctaccatgtatccggtttgtaaattttagggttaaaaataatcggtattagagttcagggttaaaaatcggatgcgaggggtaatttgtaatttttccaaaaattttagcaataatatgggcaaaaattcctgttgggcctgggcgttgcgcgttcaccaccgtcggaagcccgaaaaactcttgctaagtggtccatgcagcccacctgtgtcaggtatagaagaaaggaataagttcatctaaggtctcttaaattgtcaacgaatccgattttcgcccttcaaccacaaaaccagatacaattggtccctcaactatcaaaaccggtgcatattaggtccctcggcggtttcgatggcggttttggctgacgtggcgcctacgtggctaattttgactcggtcttgatctgacgtggcactgatgtggcgcttacgtggcaattcgatccgaaaaataataaaccccgtgggacccacatgtcagtttcacacacaataataataataatggtgggacccacgcggaccccacatgtcagtctaattaacccctcctcttctgcttcctctctctcctcctccccctcttcgtctctctcttgcgctgggtcattctgattctcctcttccccatcttctctgtcttcatctctctcccctctcctctctctcttctcttcggttcacgggcggtggggagaggacggtgtccggctaagagaaggggcgcggcgcggcggctggtgggagggaaactagtggagagaagggaaccagcccggcggcggaggcagtgccgccgcggccgtggctgcggacgacgtcgacgtcgacctcggcatctcggcggcgggatgaacgtgtcccgccgaccggccgacacacgcgcgcatcctcggaggcggccgtccacgtgggcgggtgagggggccacctcgccggcgggagaggggagaggcggcc

SEQ ID NO: 12698 - DNA, 1501 bp, Oryza sativa
atgcctcatggaatctccatcaaccacgtgcattgttttttagcctaagcatctcgcatgatatcccaatcgcccggatgtcatcttctcccaagttgattcctgaccatcatcggcaacgctctcccgatgcatcaaagcacacctacacaggaatcaaacgaagaaacatatctgagcataagttctttctcaactttactcaacattattacacatgtatagaattcatatataagtcataatcacgaataaacaaataaaaaacccgaaaccaacatcgacataaagttggccggtcatgctgtcgttttggccagtttgacagtgcacaccacgccagtatgaccagcttatcctgcccggtctaactggctccacacaaagagcaaaactacttcactaataatcttcaaatatcgaaatcaattatctcatatgccaattgttcatcataaaataacaatcaaaacacactttgatttcacatgcccctcataaaaatgtgttaagaatcaacctatggagcgtgggcctcgtataggaagcatgggcctcaaagaatgagttaaggaacgatccatatgaatgagtttgcgtgtgtgtgtggggggggtgagggtttgtggcttttctcggttggtttgatggagccttcttcttaatgaaaaccatcggacacttattttctcactggtcaagtttttttaattatttttcgttgtttcgtttatttttctacagtttattagctatggagtaaactatgaggttgagagctaggttactcggttaaattagacagaccaccggaaagccatcaaatttcaaaaagtgttattaatgaatgagggtacaaacggtagaaatgacatgagccattacaatttttacggtggtctatactgatgatagaaaatacaccactaatgtagcaaaccatacagctgttacttatctacagatcgaacattcattaattttggcatcaaaccaaactttcagctctaaccaaacttacactaagctttgatggtactaaaattttggcaaaatatcagacctaaccagccttttaccaaaactttggcatggtccaaatattgacattgttaaaatctattatatactaaaagtccattaaactttctacaaacgctctcaagttatcacgtggcgctctaataaattagagaaaatcctagaaattctaaaaaaaaagcaaaacatctacctcttgattttcacttaaattgatgggtccaatattatacaccattagataaaattgatcttaaaacaaaccaaataatatgggtcccacctctcctatttctcccgcgtgcataagtataggtcacgtacgtacatgtgggcctgtagtacgtacgcctccctccatttttttcttttttttcttcttttttccatttatacaatttgatatatatttgtttaaataatcatattttttttaaaaaaagaaaaaacatcatataac

SEQ ID NO: 12699 - DNA, 1501 bp, Oryza sativa; identical to SEQ ID NO: 12697

SEQ ID NO: 12700 - DNA, 1501 bp, Oryza sativa
gcagcaagcatatctaatagtgatgtagtgatgctaaatgctacttctactcatagagcattttacgaagctgctcgaggtgatgcaggctgaagccgacgccggtctcgtgccgaacggatgtcgtccagccgtcgccatcctcgccgcagcggacgccgtgaacgacgacgtacttgcgctggtggtcttcaagtcgggggtgtccgacccggggggcctattggcgccgtggtcggaggatgccgaccgcgcctgcgcctggcccagggtgtcatgcgacgcgcggacggggcgcgtcgacgtggtcgcgctcccggccgtgggtttcttcggccgcctcccgcggtccgctctgctccgccgcccgtcggtcgtcgcgcccgagagagaagagagaggagagaggagagaggagagagacggacagaggggagattgggagtgaggaggaagaagaggggagtgagattgacaggtgggggccacgttggccccgccttttttaattattgttttttgtgtaacttacatgtgggcccgatgtttttatcattttcaaaactaaattgccacgtaagcatcacgttaatgccatgtgagacgaagaacgagtcaaattagccacgtatgcgccacgtcagcgaaaaccaccatccaaaccgccttgggacttattttgcaccggttttgacaattaagggacctgttgtatctggttttccggttgaaggacgaaaatcgaattcgttgacaaattaagggacctaacttgaacttattccaatccgatatatatggcccatcaaatctccaatagcccaatgcaaagccatcagaacgcctgagttttggcccaagagccaactgctccaccgtctcggctcttcttgatggctacaccctacaagtacagtttggccgcggcggcggcggcggtggccatcaccggcgactcgatcgtctctgcggcgtgctcaactcgattcctctccccacgcgtcttgttcacccagcctgaggctcccggcggccctcgtgttgcaatccgcaacccacaaggtgagtttccgtttcgcccagttctcttcgtttttattcatcttggaacccttctctaactgattatcagcaacacatcaatcgaaaagaccaatttagatgttatttcaatgtcttttgaccctactttagtgagttcttgaagtgtgtttagttccaaagtttttttttccaaacttccaactttccatcacattaaacctttcatacacacaacttttcagtcacatcgccttcaatttcaaccaaattccaaactttgggccaatctaaacacagccttggtctgctgcaaatattttcagcgcatttttatgaacacaaacaaatcagaattgcgaagtactgtaggattccaagcacactgtattagtacattggcagtagatttcccccttcttgaaatcgggtttagagcgtatagtttcctccagttttg

SEQ ID NO: 12701 - DNA, 1501 bp, Oryza sativa
aaacagagatatgcacaaaccagacatgaaatatttgaggcattcatgttttatatttcttcatcattatgatttgctccgagatacatacaaagtacctattgtttatcactgttggttggtttcaatacaccccttgcattgcaattgtatgtgccatggagttggtctaaacattcataattgagtgttatgttcaagaaatctcgggccacatcttttcgcttatacttatacttatcaatcaaaatttaaattttcaaccttaaatttgaagttgattttgggtttttttcatcgaagtttatttttcagcctttgcttttagatctctaaaaacacgtatataaaagttttattcacaaattatttttcatttgaaaatataccgtttgagtccgctcgatttgaacacagtatgtttgcctcagcgacatcaaacgatatatagggtttgttcggatcagctagacagtggctgtacagccgcagtgctgcagttgttttagtacaaatttacttggtagatcctgttggtgtggctgcagcgcagccactgctagctcttccgaacacagccataataaaagattttgttggtttttggtaagtaaacaagttgactggctgggtggatttacaatccaactccggctgaaatgattcatatccatatagaaattaagacgaaaatttaggccgagtataatgcacaactaattgtgtactttgcacaacggtaccgtaggaaaattctttgaagaggtaaactattgaattgaagtatgaaaattattgtttggagacgtgaattattggactgaagttgattagcgaaccgattgcatatgcactccgcacactgcattttccactagccacatcgccaccacatcatcaagtccaaagactggacagggccacgagcccacgacgtgtttcaggccggtccttctggcaccttctcccctctgcctgacacgtgggccccacaccatcacccaccaaattgaggccccacaggtcagtcaaaccaaaacccaatcttgttctcccatgcccctttccatggcccaccccagtacccacaaccaatcggagacggccattccaaacggtggggcccacttgtcagaaaatagaaaaaaatacaggaaaatatcctgaaaattttggtgcacaagagcggcgagccgtttgccttccctccaatctcttttctctcgtcgtcgtctcgtcttcccacctctcggattcccgagctccacacgacacgacccacctcggccactctccgccgtcggtggccagtggcctccaccccctccgtcccccggggaccacaccggcgtaacatcagccacacctccggcagatctttcccccgccgcttaattcacctcgtgcgcgcgcggcgccgctcgttgcctagctagctagctcggccgcaatctagtagtagtagtaggaggaggaggagcggcggcggcggcggatccta

SEQ ID NO: 12702 - DNA, 1501 bp, Oryza sativa
ccagacgctcccgttcttcacgcagttcctccggttcaaggcgcagtacagtgacctcccgaccttaacgtgcgaccattcttgccttctagctacaatcgtcaatctgcattacttccgtttgcaagctcgtttattccttcctgttgtcaccaggttgttcgtggtggcgaattcggctgttactgcgtacctggtgctgtccatcccgctgtccgtcgtgcacatcatcaggagcagggcaagttacagtaggctggtgttgatcttccttgactcggtataaatcgatcgatcaaaacgtaaaatattactgaattttggctaatctgggggggctctcgtgatcgtgcaaaaggtaatgctggcgctggtggcggcggtcgcgtcggcgtcggcggcgatcgtgtacctggcgcacaagggcaacgtgagggccaactggttcgccgtctgccagcagttcgactcgttctgcgagcgcatctcaggccccctgatcggctccttcgccgccatggccgtgctcctcctccttgtgctcctctccgccgccgcgctggcccgccgctgagtaataagaaaatcaaggttgaattgtgcatcgcgcggctgaccgggagagacggtaacatcaatacatgtggctgttgctggttgttactgtagttgttaccgtgtcgcctgtgtatcaggagattcagagtccgtgagccgttgtcgagtacgtacgtgccggcagagaccggtgccttgctttgaaaattcagtactccaacatcgagtgcagtgacctgtactggtttacaaattttcaattttaaactcatctgcacaatgagaaagcagaaggtattattgatgtgcggatcaattttggacatacaactttcagagtatgcagacgcatactgttacaatgttttccgaatcataaatacatatacatgtgatgtctacataatataaatcgggcgtccgatttttttttatatatatatataaattgtgcgttgtttcaccaagtagatcgaaattatttcactaagtagataaaaaatgttcattttttaatattttaaaaagctgaaacacaaccaaatcatctcgtgaaacattttactacaacgtatgaaacaacggtttccaaaaaaaccggacgctatttcaccttatataaaaacaatgtttcagcaaataacgaaaggatgtttcaattaactgcaacatttcattcatacgtagtgaaacatcacaagtacacttactgaaacattattggcggaacaaaaaatgaaacgaatttcattaatagagcgtttctgtaatatgtgggtgatttgttgtaatgacgcgtgtggtggggtgtgtggtggggacgacgcaggaagcggtgagcgcccgatttttcttccgctgatcgagcgctcgatcggtgccatttccgatataaatcgatatgaaaacatgatatttgatgagtgagagccctcagggccga

SEQ ID NO: 12703 - DNA, 1501 bp, Oryza sativa
tactcattcatgctgaataaaatgtgggaagcaaagttggcaaaacctgaatggtttgacctcaaacgccactattgtagaagcacttgtgtcgatatccctcttgtacctcaccaaaaatgataagtgattgtggatgaagtacctcttatgctcctcctgcggaaaaatgcttatgcatgagggtctttttaactaaagattttagcgaaataaagagtttgagaagatcaatataatgatctttcatctaaaaaaagagttttgagaagatgaacccactccaaagaattggccaattacaccaatatggtacccatgctgatagaaaaaatcatctttatctatccttctgattggaatacttaatgggaggttgtcaagagccctgtaattcaacttcattaaatctctcacaaactttgcggtgtttttagaaaatgtaaatctaacctctacaatccttacatgttcacacggtactcatcttccatcttctccgtcagctccttcgcttctttttctccaacaagcactctgcagacaatttggcacttcttgggcactctcatttcaaactacagtgaaaacgcaaagttggatcatcaattcgcagtccaaaaatgataatccaagatcttcacagacaaaaaaaaaatgatagaacccaagataaaaccctggcaggtggcagtgtgtgactaacctggtaaggggacctctgttggcgatcaccatggagaagttgccaaagagtcggagcactttcagttagattgtcaggtctacagaagggaagtgagtagtacgagtaggtgatctgagtctcgatggacatcagctcgttcatcttcaccaaaacctcatctccctgtgaaaatgaacacaagaaacaaagcaaacaattcagaagattagaccaattaatgttcagcagatcaattccaaaggagacagataccatgtagagcgtatcagattcagtaccttgtagaattcgtggatgaacacagctgcgaccggtggcgcggcgagcagcgcggccaccgccgccaccacgcaccataaagcctcacgtacgacggcgagtcggccggcggtgacgttgaggagggagaagcactaagcctcactcatatatgataccggaagtgctgggagatgacaacgacgagttggccggcggacggcggcgacagcgacggcgacggaggagacggccttctgcattggttttctctggccacgacatacgtggttgaccgttgacccctgggtggaccgcaataactgactgactgattacacgtacgtcacacagcaatatggcaacttttcaactcacccaaagaaaaaccggagcaaagcagctgctggtgatactatcttggaagggtaaaaaatgatcagaaaacagtagtattcggtcccgtatataataaaatgaatttatacagagatccataagaattgagaataatatgctctgccatacgaaact

SEQ ID NO: 12704 - DNA, 1501 bp, Oryza sativa
aaaatagtatttcagtgaacaccccttgatttagaatagtattttaatgaatcactttgaagggatagtattccagcgaaaccattcttttgcgatagcaaaatcacaattttctcgcgctcggtagggacgcgtaggcgataaggaagcaaacggtctgcaccggttgcacgtgtggggccagcgtaatcttcctggccttagctagtgcctctagctgttgcgtactccgtgtgaatcaatggagtaattgacactatacgtcgatgcatgcatgatgtctctggccatcgatcaaccgagaacgcacccaaattgtgcgtacggattcgaccgaggaaacagagaatcacatgccgattgcagcaagaaccagcgtgcgtgcgtgtttctttttctgttgcatgtgatgtggccttgtttttcttccaacgaactaacgatccacatgtgcaggtgggcaattaactcgcagatggatgactttacacgcgccacatatgtcgatcgaggtctctcctccatatgcatgtctgtcctgcggattatgccaagagagaaacctggttttgctggttatcaacgacctactgcacccatatgatttcatgtcgtcgcatctgaaaaccatcattgcaagttgcaacacaatcaagtgcagtaagcgccggtaccggcggcacgcacacagggtttcaggtttggcacagagcatcgtgtcacactcggagtcacatacgcacagcaagcagccgcgccaaagcagaggtccaacacgaaagcccaagctacttttccgttaactccctcaaatatttccggattaacacatatccctcaaaactctgttaccttcaactattaaaatcgtgaaaaaaaaaaccttagctgttttaaagacggttttggctcatgcgtctaacttagcagcctagttatatgaggaattaagaacaaacatagagcccacataaaagtggcaagggaattccttttttttttaaaaaaaaaagcaccctaaaaacagtccaggagtctatttgaacatgttttaatagttagacaggtcgatatatatacccgattttacggttaagaattacgaactaaatccggcctctataaaaggagtaaaattaaacttccttttctttgtcacaacctgaaggcccaagtagagcccaaaacacaaccattaggcccatatataaaagtaataagttcatctgaggtctcttaattttacaacgaatccgattttcatccttgaaccccaaaaccagatacaaccggtcctcaaactgtcaaaaccggtgcaaatgaggtccctaggcggttttagctgacgtggcgcctacgtggatggtttcactaggtctccgtcccacgtgacattgacgtggcgatgacgtgccagttatatctcggaaaaataataaaaatcatgggcccacatgtcagccacataaaaaaaaaatctaaaaatgatggggcccacatg

SEQ ID NO: 12705 - DNA, 1501 bp, Oryza sativa
atcctcccatcaaatccggtaatctggtcgagctcacatagttcagtgtccgtacgatggcaatcctctccgtcaaatacggtcgaatctttctcgatctccaaaattatcgagagattttgatccactcgatcccctttttcgtttttttaccaaaatcaaagcaatccgcaaaacttggaaaaaaatgacgaactgaaaggaaaattcaagcggaaaatgatgaaagagtagtggagaatcggtttttcaatctattggataaggaaatacataaagatgcaaatcgatatggcggcggcgctagggttcggcccgacgaaaaaaccacacaaaaaaagcgaaaccagaaaaacggtgaaagaaaaaacggcgcaaacaaaataaaacggacgaaaaaacccgaaaaaacggtgaaagaaaaaagcggtaaaaaataaaataaaacggaaaaggaaaaagaaaagggaaacggacaaaaaaatttattttatttttgccgtgacgggcttcctttttatacaatcgttttttcagcacttttttttccgcttttttaagtaaggataggaatcggtcagtttttttttccacactttttttttcgccctgggcttttcttaattacgatcggacttttttttatatttttttatttacggacgaaggaaacatcttgaacgtagtatatatatatatatataggagatagatagataaaatagatctaagtaaatctaaccatccaaaataatgggtccaccaatttaaataaaaatagatggtcagatttctcttaattattatggtgtgccacttggcgacttgatagcgtttatagggtgccacttggcggtttgggagcgtttatagaaagtttaatggacttttagtatataatagatagatagatagatgggtatcctacttaagtgaatgctaagaactttttaatgtaagagttttatattttttttctataattagttcactttgctcccttttgtatttcctattttattttatacaactttattttaacttgagatgataaaatattaatgatagagcgttataccttatgtatcaaccattttctgtgaaaactcaatcaacttttgtgtaaacatctaaggctaaataggttctcattatttatttattgatggatttggggaaggtggggggaggattcgaggttggatcatttcttgcaagtgtgcaaggctccacccagcctagagagaacatgattggaaggctaaatataactgcgaaggcatcattatgtttggaatatgatttttttattgtttccgtgatttaaatttttgtatgaaatttataattaaatattaggaagtatgtactcgataccaatcactctacaaactttttgattagctagattgcactgggcatgaattaagtacaataagattatataaacatttagctgatgcttataatgtctatccacttgacataattaccatgtatt

SEQ ID NO: 12706 - DNA, 450 bp, Oryza sativa
gaggagagagagaaggtggggggagattcaaaatcgaatcccgcccctctcgtgcgctggcgcggccgggagacgcggggagagggcggcgacgtggcgtgggcgcggcgacgtggcgtgggcgcggggaaagcggaggaagtgggtgcggcggcagcggtttcggcgggacggcgcgagcgggagaggcgggaggtgggagacgggtccgacaggtgggccccacctgtcggcgaccccgggagggagggaggcgggcggccggctgggcctcggctgcggccggcccagcagggaggagggggaggaaaggaggagatgggccggcggcccatccgaaagaaaggaggaaaaagagaaaaaaaagaaaaagaaaaagaaaaaggattttttttcctggaattaaaattgcactttggtgatttttaattggttaaaattatttctagg

SEQ ID NO: 12707 - DNA, 1501 bp, Oryza sativa
ctcgcattcaaacgggcggatttgcccccgcaaatctcgccggcgccattgatggtggccgacctcccgcgccggtttccttcctccccggccgctctctcccccttccaaccctatttaaaccctccccatgcatccctcctccgtttccaacccttgccgctttctctccccgtcggaatcgagctcgcgccggtgtcctctctctccgccgtcgccgcgagctttggttcgccgccgtcgtcgccccgacctcctcccgcttcggcatcgcctccttatggttcgccgcgtcctcgtcgacctcgtccaccccttcgtttcgcccgccgaccgccggaacgccgccgtcctcgtcgacccgagccgcgccgccgcctctctccgcttcggtcgccgttcccgtcgtcgccgtcgacccagggtgagccgaggaccgccatctcgcttcccccttccctccctctctcgggcgccgctccgtcgcgccggaggtcgccgccggcgaccatcggggcgcgggcgcgccgcctcccgtcgaccgtgccggcgaggccgcttcgggcgcgcccagtggctgccacgtggggcccggccgtcagccgcccgcgccctcgggtgcggctgacgtgtgggacccacggcgccggccggtgtgagcccgggtgcgcccggtccaccgtggaccgtgaggctgccgcgtgggccccactcccgtggacccggtccgcgcgcctctccccctcggctgacgcaataaaccctttttaaactaaaatttaaatgaagaaattcgcaaatattcatttaaagagcatataaacttcaaatggccataacttggccatttgaactcagaattagaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctctttgtggaagttgaagccgacgtttgggaaagcgagcaaggcaagtcacatcatccttgaacatattggatcccatttttataaaattattttgatttaaattattgcattatcgctttacttaaactcccgcgttatcactgttttatttagccatgcctatttacctttgttatgaccttattattattgttattgatattattaacttgttcaccctagattaaacaaaaccccaactagtggacactctactcatggtaccactagtatgaatttagttagatgcttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgattgtagcacctcggccatataaggaccggt

SEQ ID NO: 12708 - DNA, 1501 bp, Oryza sativa
gtcatggtgcgaggaccgctgcgttattgctgtagtcgtacctcgaccatctgaagttaatgtgcgagagattgctacgttttactagttcgagaaccaacgagcgagtagaattatctctcgaacaccaatggaagttgcggtgcgagagactgctacgtactagttcgagaaccagcgagcgagtagaattatctctcgaacactaatggaagttgcggtgcgagagattgctatgtactggtttgagagccaacgagcgagtagagttatctctcgaacaccaatggaagttgcgttgcgagagattgctacgtactggttcgagaaccagcgagcgagtagagttacctctcgaacaccaatggaagttgcggtgcgagagattgctacatactggttcgagaaccagcgagcgagtagagttacctctcgaacaccaatggaggttacagtgcgagagattgctacgtattggtttgagaaccagcgagcgagtagagttatctctcggacaccaatggaagttgcggtgcgagagattgctacgtgctggttcgagaaccagcgagcaagtagagttatctctcgaacaccaatggaggcgctagagttggtttattacatgtgcatctcatgtggccagcatgactcacacacccaacttgtagcatatccggatgtccgttcgcaatcatgtcgggtgatcaagccgacgacgttcgcgaggaattatccgttaacaaccttttctcgagtagtccagccatggccggtactatgagataggtcgtcggtcttcgttggtaggttgggcacgacgactcagcatttgtcgagatcgttttcgataatgcggtgtactcgaccacaacctactcaggtgctcaattgttcctgaagaatattttctagaaggcaagacatatagtagataatatcgagtatgtactcaaaaaactgcatggatcttctagtattatcaggacataatgagcaaatgtaaatatcaggcattatgcaaaccgtaagcaagcatgattcatataggagagaacagagcgagcccccagcgttagaccgtagtcgatttaacatcggggacacccgcgcaacagatattgtataaaaacatgctctaggtaaacaaaataaatcatggatttgacaatgctgtatgatctgaataggtacgataaattgcagataaactattgcgtacctttgtagatacatgccggatgtatctacgaaattagtagatcaatttaaaaaaccaatctaccaattaccttgttgcgtactcgttcgatatcatgcgatctgacatcttttggtacgccgcggagcttgaggcttggatgatctcgatagaccaagttgttgatgacgatgatggttccgatctggttaggttggatctccccctcagctgaagtcgtcgagtagctcgttgtcggagaatccatctcttaaacacatctcgtcgaaaccttgaagc

SEQ ID NO: 12709 - DNA, 1501 bp, Oryza sativa
ttatccccaaaattgtcttcactggtggtctaattttgccactagccaaaatggtatttttgctagcggttgtcttagcatagctgcttgcgaaactcaattttcactggcggccagcattattttcacttgcctttagtcactggcggcacatctagccgctagcgaaaatccattttgactgtcagcgaaaactattttttagtagtgtgccttttctaattaaactattcactactcgacgcatacatgaaaacattagttgactaattataggctccttcctggttaccgaacgttgtattgcataatttagtccatgcttacatgagacaccagtggcagttcctatggctagtccatgaccagtgatattacttttgacttccccttttctttttgttgcagagatcctttcgactttccaccagggtttacaattttgatttcggtaggaccgaaattttaccaaatttcatgattttcggcacttttcggaccattatttttttgaaattttgaaagattttgatcgaatttgagtaaatttgaccaaattccacaaaaaaaagagaaaatctgaaaatttctatcggtatattgatttgccggtggggaccaaaattatcgaaatttcgaaccaaaattgtaaacgctgctttccatgtgcaagaaaataaatttaaagggatttgctaggtttaaaaaattgtggattactaagcctcaaattacaattctatgcaatgtgtttattgcatgcagtgttttccttccatgtttaaattaatacatggctcacattttaatcccctcctatagatatataccgcccaatccattatagactgttcgattataagcaatcaacggaccatatgacttccaatcgaattctcgtttatttgagtggagtgtcgagatctgtcccgtcgccctattctgtttttttctaatttagcaatgctcttttatgtctatagtctatataccctatggcaaaaactagatatgtaaacgatttacattatctttttttttttaaaaaaactaactagatatggaaggacgaggccaagaacgtacacaagactcacagtagtaaccttcgtagtgagcttgtttgatcaacgtacggacccatcgtttcgtttatttgtggaataagcgaaacaacatatttgtaatttgtaaataaaacttttatatacgtgtgcttagcaatctaaatgcaaaggctgaaaaataaacttttatatacgtgtgcttagcaatctaaatgcgtctgatgaacacggtttgagatgggatcgttttgactagcttttgatcgaggtagaaccatacatatgaggtgcatggcttgtagaactacacaagtgatagtgttttggattcaaattttaaaatatttttatacgatgatgattctggttgttaatgatgtcctttgaaacaaataaattgtcaaaatataataatgaagaccacgttaaaacca

SEQ ID NO: 12710 - DNA, 457 bp, Oryza sativa
tcctgcagccctgaataagttgaccagacgttcctcaactttacgtcaagttcgtataacatccctataaaccacagtaccagaaagataaaagtacagcgaaggtccctcaacttgtcatcgagttacaaaatcatctcccaaccacaaaaccggataccggaggtccctcaactaacaaaaccgttcgcttgaggtcctctggtggttttgaccccggttttgtctgacgtggcgggtgagtcagcgtgggcctcacgtggaccccacctgtcagcattgccacatcagtcttctctcttttcctctgtggacccccgtttttataacaggaatcattcatgtaaacagtaccatttccctggatcaagtagtctggtacacaagttcatagctgaaataccaaaagcacatacacgagagtctagtgctaattattacatcataagcccgcagg

SEQ ID NO: 12711 - DNA, 1501 bp, Oryza sativa
ttgggtacctagccgcactataccagtgtgtttgacgcgggtagccgacaaggagatcatcggataccgcctcgggggccgcccaaattaaaaatcgcgcttccacgcctgggattcccatccggctgacgctgatcctcagccgccgcgccgcgaagcgaagcgaatttccggagcggcgccacaccactgtacttgccccagtctttgcttgccccccacccccaaccccaccgcatcggatgcccacccccgccgcccgtgcgcctaaactcgcagtatattactcatccgtctcattccaagtttatgttaaacgtttaatcgtccatttcattttaaaacataattaaaaataaaaaacaagtcatatataaaatactatttatattttatcatctaataaaaataaaaataattattataaaataattttaaataaaatgaacgttagtaaaaagacccacaaccgtacttaagattggagtgtacttatagggtctggttagtttcgaactttttttcaaacttccaacttttccatcacatcaaaatttttctatacacatgctcccatcggatggcctaaacagccaaataataagataaaatttaaattttcaaacttaattttgagattgattttgatattttcaacgtagtttctttttcagcattggcttttaagttaacaagaacacatatataaaatttttatctaaaaatttatttttgttccctaataaaccattttgacttatcagggaaaaagctaaacgataggagctataaactttccatttttccgtcacaccgttccaattcaaccaaacttctaattttattttgaactaaacacaccctacgatagatggagcagtagtatactccagtaggccacgccacgcaccgcgctcgtcgtcctgtcgtgatctctcccgctgccgaccgagtgccgacgtgtcctctcccgccgcgacgcatcggcgagagaatcctactccgccttgtattcctttgggtgaacatgagtgtctgacagttaaactgatctattcgttactacaggtacgggacgaactggtggtggtagcagtaagtattttgaataattaacagcttgggggagtacgaacgaccatgcgtgctgctccttgtttttttcctccgcgtccgtttttttctgtctccttttgatccattggtaggatataggagtagtagtatctactgtcgtgagaggaagagagtgtgtttatcatacgacactcatattttattgacgggcctggcgaaatgcagaggccctacagcatcgtgtggggatctgtgaacagtaacatgactcgaatggaggagatacagtcatacaactgaggtgagatgaggtcggtaaaggttaaaaaaaaagtgagatggaaccggtccgatccatcttgggtggttattaaaattaaaatggtcactcggatgcaaatccactgttgtacattactgtacc

SEQ ID NO: 12712 - DNA, 1501 bp, Oryza sativa
attacgtttgcatggcctctgcccacttgcagcgcagatcatcgatcaatagtacacctttttgcatggatgtaggcgattatccctcggctttgcataattgcgattgacaccgatcaattaatctcttaattctcgatcgcatatgtgtgatgatttgcagctaactttagttaattaatctgcatcgctcatatcatgtgcaatggatcgaactggtaaaaggtcgcaacggctttcgtcgatggagtgcgtgattgatcttcgatcgtacgttcttgatgtgtgtgtgtgtgaattgcgaatttgtgattaatcggaggaactggaatttggtttgtgtagcttttgtaaagcgcgtctcaattattgctgttgccttctcgttttgtttgctgttagttaagtatccttaaattaattaatccatctgttaattgaaagcttaaaagtaaccgagcatatgtacgtgacagatgcagattttgtagtaaaggaaaaaaaaactagagattttactatgcagatctttagtcgctgcatatatatccagcctctctctgtcatggaaatcttcggttccgaattttcgattcttctcgcgaatttacggtaccagctgctttatactttcagtaaaatcaaattcgcagatcttttcacggggaaaatgttagtactggtactagttttcatagaaattatgtcaaccaaatcaaacacaccctttgtcctgaaaaaaaaatcaaaaattagatataacatattttaatacaataaatctagatagagatgtgtctatatttaggttttttataggatgaagatagtatctgggatttcgcgaggctctcacacatgcacgaatccacgaagaattctcagaaataatagagttccgcacgtgatagtgatgcaagtttactgtacaattatatgatttttctgaccggggaccgggcgacgcagagagcacaggagaagctagccattgattaacctgtcgccgttgggcccatgcacaggagacgcaggattttgatcggacggctcaagatgcgttggagcagggcccacggccccagctgccgcggccggagtggcggccagcgaggccacagcctgccggcccagtgctcgatgctcacctgcctgtcgccgtttattttcagcataacgtttgactatatattttatttttaaaaaattatatatgttatttattctatttaattttattattattaaataaatatgcttttaactaatatttttatatatttatactaattctttaataagacaaatgattaaatgttacgtaaaagctcaatgatatatattttaagaagaaggtagtatatcttttagtttgaaaataaataaaagttcagttcgtgctattttaaacatcacttttaaatatcggcgcactgttatctctccatgtcaaatatccggcatccaagctatgatgaacttatccgtaccaccgaccaaa

SEQ ID NO: 12713 - DNA, 1501 bp, Oryza sativa
ggtagccccgtcttgttgaacccgctcaccgtcacgaacatccccgagaagaacaccagcagcgagtacgacacctgcatcatccattcacatccacgcacacgtggcacccagttcacatattgcttcttgtccgcatggccgccacgtgtacttgctcgtgtggcctagagttatagtgatttggacggatatgggttaccttgtcgaggcatggctcggcgtcgcggaagtcgacgacgacgagggcgatggcggtcgtgatggcggtccacgacatgttgaggccgagcatgtaggcgacgagcatgccgacggtgaccacgtacgcgaagctcttgaggaacagcttccgccggtgctccgagcactgcatgaaccaccggtgcttcgtcgagatgttctccgacatcatcgactcggcgtcgccgccgtcgtcgtcctccggcgatgcgggggtggcggcgtcgccgtcgtctttcttgttgttgttgagcgccgtgcggcggccctcctcgatggcctccatctgcttgccggcggcgacctcgtcggggctgcaggcgccgccgtcgagctccttccagtacatgcagagcagcatgagcatgttgatccccatgccggcgagcatggcggggaggatgccgaggaggaaggaaataaaggagatcttgctgttgaaggcgatgaccaggttctgcgggttgccgatgggcgtcgcgctggagccgatgttggcgctggtggcgagcgcgagcaggaacggcttcgccgggaggttgcgctcggcggcgagctcgagcacgaactcggtgaggacgacgcagcaggtgtcgttggtgaagagcgcgctggcgagcgcggtgacgacgcagacgcggcacatgaggtcgcgcccgccctggctccgccacgccagcagccggcccaggtgcctgaacatgccggcgttcttgaggtagccgccgacgaccatggtggcgaagaggaggcccaggatggggaggtcgatggaggcgtaggcgtcgtcggcgctgatcacgtggaacacgatcatcagcaccgcgcccagcagcgcccccgccgtccgcccgatcggcaggaacggcaccgacgggaacaccgccagcatccagaacacaccgaacgccaccgaccccatcaccaccttcggcagcgacgccagcgccatggccgcctctctctctcactacaatgcagctagcgtcttggagtgggaggtggtggtggcgattagagtgaggaagagaggcgactccccgtgggcttaagtactcccagccaggacgaacagctggcatcagttgcagctgatgtcagtgtccagctaggtaggcagatgattacgatccagaggcaagggcacgtacatttaagcacttaattacatgccattcttttgctaattttttcctttttatcttccagatggtaatcttgtaactttttctactatatctatataaacttctactcc

SEQ ID NO: 12714 - DNA, 1501 bp, Oryza sativa
aaacttgccctttccatctgctattaataaatgtgctgttacaatataataaaaaacatgagctaacgcaatcagcaatgacgacagcgttctagatgcaaaaatcgaacatggtaccaactcagtggatgtggacaagtataagttaacaaagaacactctctattattgataatattagaagataatgcaatgcttcaaaagtattaactggggatttccaaaatctttactatagaaagcatcaaaatcagagtttgaaagactatctgcttgaaccagaaataggtagcctttcatttattttagataatggatatcaatccggcctctacatccctaaaggacgtgaagcacatcaaacagaaattgaccccagaaaggtaagtctaagtcattactgatagacgctgttcaagtttaggtgaaaaccagtgatgttccgcatgtatggattgcagtggtactgtgttattccatttgcagtggatggaaatagggaaacccttagagcaagaaaatgttaaacctgaatgacaggtccacgtataagttcctgtatcaccaatatcggaaattttgtctcgacaggactacaatttgctaggacatttttcaggcaaattaactccaacgtgaagggaataactcctgatatcatatctcaaaaagcatcctggtttagattcaagccaccaagtggatattaagaatcctaaattcctagtgttcaattgaaacaagaccattcagcaggacccgaaatcttagtccaacctttagctacaaacgttgccagagaactaggacagatcatgccatccaaacaggtaatctaagttgcagacaacaggcacttagcctgatgccttttatggtgtatatctcaattctttaagctccattcaacaatgaataaagcagtacacatctcatgacatctacccagatcagtactaaagagtaaagaagctaacaaattcatacttcatcgggtagtgacaacaatagcacgatggcgaaggttcaatgataatatagctaggagactaagataagctttcgatttttcctatcagaaaccacgcaatcgagtaacctaaaatacgaaccacacgatgtcctggtaaatatcagtaaatcaaacaacgttgttgcaaggtgattggtgccatgtgcctgcatcctgtaggagatcgggtacagtaatcgcaaatttgcaaagtgcctggcatgagatgtatgggggatcggaccaaccttgctgagggcgcagtggaagacgacggtgtccttgtcgccggtggcacgcgcgagctccggcagccgcgccgcgaagctgcggctggagaagtggtgcgaccccccgatgtgcgcctggtagctcctctcctcgtccctgcaatcccccaccacacatagaaaaaaacgaactatctcatcaacatcagccaccaaatcagcgcggcggagggtcggagagagacgaagagcggaagcg

SEQ ID NO: 12715 - DNA, 1501 bp, Oryza sativa
ctgccaccaagttgaacaacagtggagataaagtatctccttgtctgactcccttataggtcctgaaaaactccccattctccccattgatgttaacagctactttcccattttctgttactgatttcatccagccaatccatttgtcacagaaacacttcctttgtaagacatcaaacaagaagtcccagtgtactttatcataagctttttcaaaatctagctttaaaataatgccggattggtgagatttttttaactcatgcaacacctcatgtagaataaccacaccatctaaaataaatctaccaggtataaaggttgtttgattctccccaatcactttggatgccacaaatgtccttagggtcaagatctttgttaaaagtttgaaacaaacattgagcaaacaaatgggtctaaatgctttgatattgttggcatctttaatcttggggattagagttattaccccatagtttaatctccacaactccaaactctcctcaaataaagaatcaagcatttctttaaactgatcttttaactgtggctaaaattccttgaagaaacagactggaaggccatcgggccctggtgctgtattagtcttcatgcccttaaaggctttctctatttcttccatggtgaaaggtctagttaaatattcattatcatcctgatccaatctgcccctcttagtccacatgtcctgacttgggaagatttttggaggtgactcagaaccaaacagagacttgtaatattgttttatatgatctttcaactccatctggtcatcaatcactctaccttcatcttccaaacttcttattatgctctttctcttcttaccgttggccacaccatgataatacgctgtgttagcatcaatttttccccactcctctcttgccaataaatctcctctgcaagatttccttcccgtaatattaccaggattctaagcttccttataatagatttccttcccgttagagcttttggttcctaaaatataagagattttaggtgaatgtgatatatcataatactagctattaatctggacaaatagcctacgatgtgtcgcattcacataagatcttttatattttgggacgaaaggagtaaacgacaccctatgccgtgatcgtatcattgggctttcactagactctccatagttccagacttccagtgaaacaaaaatggagcactattagttcgtttgtttggctccgcagtagctatataatttttgtgaggatcatcatcgactgtttttattcacacttaattctacttttttggacttaccgtaaagatttcccttgtacttaaaaaaacaaatactccaaaacacacttgagttttttccagagaggtatgacctgtgagttttttttggaagcaagcagcagcattgaaaaaaaaaatctgacataacgtctcttcttccgctgaccacacggtcccacccactcccccccaccgtcca

SEQ ID NO: 12716 - DNA, 1501 bp, Oryza sativa
tgaccacggccatggtcacggtgggttcaactggcaactgctgccaacgcgcatccgacgcagcacggctaatccgctactccaatatgatgccaatacgccgctgcgcctaaccgggcggtggattggtggctgcaatatattgcatggacgtacgactctacaagtcaatcgcggcgtgcgtgcccgcgcagcgcgtggttggtgtcgcgattcaattcaaacttgggtcagcccgttttggaagcagagatcacaaggggacaaaccgagcgagcgagcgagctagaccggcaaccgaagcaaaaccaaagctaagctagcgaccggcttattaaccggccgggtacgttggtgacgaccacgacgcttcaatcccctttttttccacttcgatacgacgaagattttttttaatgaacgtgcaaaaaaaattacacgactaacatagttttaattacacaatacaaatcggtcagactggcttatgccagggaaaagggagaaaagataaaataaaaaagctgaagcttagaaaactaccgtggctaaacataaactccaaacagcgggaaggggccgaaccacgctatacacccaacaagtctctaaaagcagcaacgtcagcttaaaaccacagatggccttccgagtggatggactccagaaccactaagactgaagagagcacaaagtcgaaaaccctacggtcccgttcctttcacagctcccaaaagaccacgagacatgacgaagattcaacactcgccgttgctataagtacgatcgagtctatgagtaaacaaaagatattttggattagctggaagctgtcgagcgagcgtggcgacacggccattctcttcctcctaggcaaaacgtcctcgtgtgccacgtactactgtagtgcgttgctactggtacgtgacaaagcacactagctacgtactgttggctcggccttatcgcgacgcccacgagaaacgaaagctgcatattcttggcacacttttcacccaacacttttttggcctttggacgctcatccggccggataaataccggacctcactctcacgactttatccagttttcttcattagtaagtagattattatcatgtaatctttttagttacagaggtatacaaaacgtggctgggttcgttcctagaggaaagattgtcacacatatcctaaactattaaatgatgtgtgttttaaaaaaaatacaccaatttttaaagttcaaattattaatattaattaattatatgttaatgactcatccatcatatcttttcaatattattcttttcacatctctctggttaaagctaaactgttttaaatttaactaaatttataaacaaatatagtaatatttataatattaaattagtatcatcaaatcaataattgaacatatttttataataaatttgtcttgggttgaaaatattagtacttttttctataaacttagtcaaacttaaatcagg

SEQ ID NO: 12717 - DNA, 1501 bp, Oryza sativa
acatctcacatggataatattttattgctggaatattttttttgagaaaattgctagaatattgattctaggaaacagctatcgccaacaccgtcgaatagttctgtttgcatcaattttgctttaaaatctcagcaagaaattataggagaacattagctctttccttttttattttctctctttcaggaagaatgggggtattagttgtaggagtagcactttcaaatgtatgatcttccacatttaatttttttcaaaggacttttctacattttgttcagactaaggttctacctatgtttgttaagacattaacttagtgctgactgatgagcatatgaacctcctaatatgcttatgattctatttttcaggcggcaaccactggtagctccttacaagctgaagtgtgacaaggaatcactcaatgccaggcatgttttactcaacaactgatttgttcctattgtcttattgactatgtacataaatgttttccattttctcatatctagcttttctattcttcaatattcttacttttttttcatttgcatggagaagttgcatatttgtattcgaaaacaactaaaagttagtgtttcctttgtactatggattttgtaggcttggtgcacctgacttctatccccagacattgagttgtgcagaagagaccttaaccaaagaatatgtgcaatctgggtacaaggataccgttgaaggaattgaggtgtgctccagaaaccaaaagtttcaaatcctatcccttttttgtgacactgcttatctagggttaatcttgtttcatatattgtttgtctcattttcacgagtctcatgccattaaaatcttgagtccataattttgtgtacattaggaccgcaatttctttgttttgttttgactgaaatttgttcctggtggtgtttttacaggaagccagagagattgtactcagtcagattccatacttgagcaaaccagatattgctacaaaatgcaaggaggtaaaaaggcaaccaacatcaacctaactagctttatttttcatgcaatcttatgttgttagaacatttcttcctgtcagagtgaagtgagaagtaggttggtatgcggcatgattgaatgctgctggagatcaggaactaagatgggtagaattatgggaatcacatcttttatatataagctgagatatgcatcacagggggttaacagccaaaactctacagcctacttggtgctaattttggataattgccacctttggattgttactggctgcatagtctgtcagaaacttaggattaatattatgtgaatacgtagatccatatggaagatgctgaagaattgcttcttttccctaaggttgatggattgaactgaatggttgaatggattgaatctaatatttttcttccccctttgacctacccgattattgtgttttccttctctaactgatatgtcttgtgaaaaaacttatacttt

SEQ ID NO: 12718 - DNA, 1501 bp, Oryza sativa
gaaccaaatctcttcttttgcagtgttgtaaacaacctttatacaagtgaaggatgtcacaaaagaactggataccactatcattctaagctgtgtcacaaaaaaaatttatatttcaacaataatacaagcatggcaacctctgaggctctgatccagaggctggtgttctaaacaaggaaacgataattataaaccatgcagggcctagccactcaccttcacttataagctggtgcaacctaacaacatccccaccagcacagaatgctcggccgctgcccttcatataatataaaaatcaatttagacctatatagtggcatcgataccatgcaaatgctgaagcagcataccttcatcatgacaaagccaatatcagggttgtcctcccatgacatataaaacttattgagcctagctccctgtcaagacagtcagtcacaggaaatcagatcaatgagccaccaagacatgtacaaatgtctatgtttcatcaagcattatactcaaaataaaagtcaatttactgaaaaccgcagtataccattaaagaataaatgatcacataggaaagccacaaaaatattgtgcccttacaatcaggtgtgtttcatgcatcggtagcaagagcacattctcactagaacgtgcaggccctttataggagtgtggagagcacgaatgtgaacaaacgtcacaggaacatatcacctgataccacgcacgcattttatcgaacaggaaaaggcgtacgaaccatggtggtcgtgagcgcgttgagatggccggggcggttgagcacggcggcgcgcgcgctggccttgccttccaccagcacctgccgagacacgcgacgtcagccagagaacctcacacctccgatcggagtcggaggcggccaagcggcggcgaaaccagaaccgctgcgttacctcctcgctggcggcggctgcggcggaggaggaggatgacggctggagggatgagagcgaccgaaccccgcccagcacggcgtatcgcagtgccccgccggcgcggcgggcggcggcggcggcggcggcgagggtcggcatggtcgtagggtttaggagggcggagagagtaagcaaaagtgggagagaaggaagtgaccagctgagtggcccatgtgaaaaactccgagatgaatcaaaatgggccaatgtgggcttggcctcatttcgattcgtcgaaacggcccaacaaggcccatatatagtcatcttaggcctcgtttgggaaggaagcacattttccggcccgttgagccatagtcggttcatattggaataagtccactttgacttcattaaaagtgacccgaatctaatccatgaccctaaaccgtaaaactgggtatgtcgacccccgaactattgaaaccggtgcaatttgactcccttgatggttttggaggacggttttggtgacgtggtgatgttgacctggtctatagggttgacgtggcgcttaggtggca

SEQ ID NO: 12719 - DNA, 1501 bp, Oryza sativa
cgcttgccctgcaggccgactgcttcaccagcgacctgagctagctcatcgccgacatgatgtccgggtcggtgccgcttgacgcaacacgcaagcacaagtatccccgagagggtggccatcttgggcgtgttcaagcgagacaaaattaattgctcccctctgcctactcatcctattctttagtggatggtgaacgacctgctaacaatcaattttatctctggttagttgctaaatgaatcaattttatttttggatttttgtgatgcttgtggccttagcagcactagttcaaggagacgcaacgggggatgagatggtggcgatgatggggctggcgcgggagttgacggccacgcagcgagctcgagcaatgacttgacgacgtcgtcgttgcaatgctgaatggcgtagctcgatggcagccctcgcccctaaccagcttgacaggctcgatgtcggccgtgtcgtcagcttgtcgcatatgccagatgcccggatcttgttgttgcaatcggcggagaggccagagtgccggatcttgttatcacggacggcgggaggtggcagagggagcagggagcttgttccccggtgagggtgccgtgctggtggaggtgaggactggggttagggcgcttaggtgccgtgccgtcgaccaccgtccccccgctcgatgtcatcggcgtcggcgtcggcgctgctgtcctctcccgcctccttgccggtcatcgagctgcccgttgccgctctggaacccgccgtcgctgcttcagcttccgccgaccgccaccactctagccctgccgctccagccgtgctctagtccccgcggctggccaaaggagagagaaagagaaagaaagagagaagggaagaagaggggaggaagaataaagagagagagatgatgacatgtggtcccacatatgtgtttttaattcaaatgccacctaagcgccacgtcaaccctatagaccaggtcaacatcaccacgtcaccaaaaccgtcctccaaaaccatcaagggagtcaaattgcaccggtttcaatagttcgggggtcgacatacccagttttacggtttagggtcatggattagattcgggtcacttttaatgaagtcaaagtggacttattccaatatgaaccgactatggctcaacgggccggaaaatgtgcttccttcccaaacgaggcctaagatgactatatatgggccttgttgggccgtttcgacgaatcgaaatgaggccaagcccacattggcccattttgattcatctcggagtttttcacatgggccactcagctggtcacttccttctctcccacttttgcttactctctccgccctcctaaaccctacgaccatgccgaccctcgccgccgccgccgccgccgcccgccgcgccggcggggcactgcgatacgccgtgctgggcggggttcggtcgctctcatccctccagccgtcatcctcctcctccgccgcagcc

SEQ ID NO: 12720 - DNA, 1501 bp, Oryza sativa
gagcgtgtcgagcgcgtccgagaacctctcctcatcgtcgtcgtcgtcatctcccttccgcagtaccgccgccacggacaccacctgcttctccgtcacttccttcttcgcctgtaacaccgccgcctccgccacctgcgccctcttctcatcacgcgccggcgccggcgccggagcgccagtccgggaacaggcgggggacgcgtccacgccatggagtatccccacatagtgctccccgagggcgtcgtggtatgggctcccgtcgatctcatcctccacgccgtgctccagcggctgaggatgggacgcggtcgtgggcgacggcggcgcgcggcgggtgcggacgctctttggctgcccgggccgctgctcccagacgaagggcaccgcgccggggtggcggacggggccggagttgaggtcggccttgtggtagggcagcgcgtcggcgtggcgcaccgaccggagcggcgcccccaggtcgatccgcttgcccccctccgccatcagacgatccgctcgcatcgctcacaaactacacagcgaagaggaggcgaagcagggggggacgaattcgtccgattgcttcggccgccgcggacgggagataggatctgcggcacggcgtgtggatggcggcgggcgaacactagaaaaggagaacgcactgcggtttcggtgcggtgcgagcttacttgctctactcgcggcggtcgtggggcaaacagatcagccgccagcgaagccgcctcctccactccactatagcgagtgcgagcgcgagtgcggagtgactcggcggggcgcggtgcggggggtggcggtgctcgcgcgtgaccgcgtgagtgtgcgatgttattgctacgcgtgcgacgagggacggtgacctgggggcgcgggcgggcgggtgacgactaaaaattgtagactttctgcgcgatctgcctaaaaagttgatgcgagcatggcagggggcagctacgagtatttttctactactaccatcactgtggctgccggaacatgcacggggacgggggccagggctgagctgcctcggtgcgaagcccgtggcattactgcgacggacatggacgtggccagatccgcgttcacgcttggcaggtggcggagttggcagaaactggttgccatcttggatgcctgcgtgtgaattggtcaattgggttagatctcgttttgtttggtcagttgtagcaaggaactagattcggttgggatcctgtttactataagagcaaggtcaatagtacagccagctgcttactccaattttgatccatcgcagctataggtaacattgtagccagtaaacacaataatcaagctatactactatggctcacacagtacaagaaattttattttaatctcccttctatccgcactctctctctctcctaatcccctgttctcgccggcgattgcttcttaggaactaggcatccaagctcatccatggccaaaaagatgaaca

SEQ ID NO: 12721 - DNA, 1501 bp, Oryza sativa
cccttcccggaccccgacatgtcctccccgagcagcagcttggcgaacttctccttcatcagctccatctctgcacgcaagcgtctagcgtcgcttcaaaaccaaagccgttctgtccatgcgcggcggcgggccgtgttcgatcatggcgacgacttaccggaaggtcctccgccgccgtgttcgccggtgtccttggcgagccgcgacttgggcgccgcgctgtccttgtcgagcacggcgccaatcttgagcgtgccgccgccgccgagatcctcatcggccggcgtgccccggccctcctcgctcaccatactctgcgaccgtcgcaccgagcttcgtctctctagcagcgacccaccgccgctcgctgccatcaaccgatcaactccaccgtggccagcttctcggcaaccaaccaaacagcaacaacaacaacggcaacaaagaaatggatccggtgacacgacacgtcgaaaagactggaaatcccaccatgatactacccaaagtgtatatacctgtaaaggacgcagctttctgcggcctcgagcgacgtgtgcagaagcaaacgatgatgatccaggattggcgctgcagaacacccacgcagagagagccacgagaaggaacaaaaaggggagggttgaaatgattaatcccgaggtgatgatgattgttgtttgtcccggtaatccaagaaccgggtggttcgatcgatcgtccgcattgtcgcggtaagaagaagccccggggaagagggggagcataattagggagcggcacatgctttattattagaaagtgccttgcctgccatagcgccattcttagccaccctgctttcctgggagctacctagctggaggaagaagacgaacacaacacatggagaattcgtcggggtcaatttactgaacaaagtttgttgtcctacttaaatagttaaatacttcaagcatgttcggtagacttatgttccacctcttatagaactgaagtcaactaaacagttttagcttcatccttttattacgtgaaatttgtcacgacacatgaagacctgagagatctgaataaatccagtgcaggtcctatcaatcgggttcaggacgtgtcaattcgtttaatcatgcaactaacaagataaatagacagatcgtatcggatcaaggagctgatcagccaatgggctgatgtgaagtcgagtgaccagccaatatcgataaggtttagatcaacggttatgggttcgatatagattcaaatatcagataaacaatgggattcttgctatcatcggctagaactaaacttcacataattatcaataaaccattctttgtcaaatacaatcttgatagatcggatcgaaccgagacaatataagattgaagttaataaagagagatttaactagtgagtatacgagtttgagtataagccaatacatcacttagaaatagtagcaagataactcatcacctagaactccgatgaa

SEQ ID NO: 12722 - DNA, 1501 bp, Oryza sativa
tagcccgcaacaataatccagtcaataatctcgaacaggtagaaaccgctacgcatatttgaattcaaattagttgcacctagtagtaagtaaggcaatgccattgtatcgccttttgttttatacctttgctctaggtcattggttagcagaggctaaattacgtgccaaggcaacaagggacgcaccttctgttctcttctcgggtgaacactagtaggataaattgcttcacatgattcacttccaacctttggtggacaaagtggcaataagacactgggaaggaaaaagtcctaaaccaagaagtaaatttcacattgcaccatacatttttaacaaagtttcacaatgggaaatggccaaatcaaccttttcacttaacattacatatctttgcactagttggcactttggacttgggatgagcacatcaaaggaagttgtcagagaaaagctagtttaaatcatcatccatagtgccatagtattaagataaatatctttaaaaaaatatttgcaaatcacaaaacaacttttttttagcaaatcacactaaaataatgatgtgaacatgtttaaaagtggcacaaaatgatctatacgtaggggcaaatgaacaaaaataaaatagaaaataaaactagttatttttgaatttaaataaaaatataaaataaaactagttaattaccactcacactgaaaagaagaagaaagcataaaatgttttgccttttataattatccgtatgcaaatcatatgaagttctctcacatattcccttgtttcgattacccttagaccctagtccaaactgaaaacttatgtaaagatgtatattgttaagtgaaaatattgatttaaccctagtttataacaaaatcttgatcaaaacatatggcccaatgtaaaatttacttaagaaaaggtaaaactagttaattaccgctcacaccgaaaagaaggaagaaaacataaaatgttttgccttttataattatacgtgtgtaaatcatatgaagttctctcacatattcgcttattttgatcacccggagtccaaactggagacttatgtaaagatgtattccctccgtcacaacaaaatttggtcagacttctttccagatttgttgtactagattatatctcatcccatacttcttaggctccgtttagcttcttaggttggttttttttttacggagggagtatagtgttaagtgaaaatattgatttaacctagtacatgtgttccaatgtactttaaaaaaaggtaaatgaaaggcgttttcaaaaatcaaaatgcagctccctccgagcaaaagccgttggcttctgtcaaacgtcaaatccgtcaggcttaccagttttagtactaccacactcctactgcacctagcctgacgaaatgaaaaggttgcaaagaaagttttgagtttttagccgttgcgcagcaaatttgcaatcaagaagaagagagggagcgaatagcga

SEQ ID NO: 12723 - DNA, 1501 bp, Oryza sativa
gggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccaccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggagcgttgggttggggatcaggtcgtcgacgcacgcctgcgccccgcacgcgcacttggacttggcggcgatgtggtcccggatgcaccagtcgcagaagctgtcgaagcagcacttgctcgccagcaccgcgtcggccatcacgtttcggcaaatcttgcagtagagttccgatgagatgacgccgctagatcccccggacggcgtcctccattcggcactcatctcgcagctgccacgggggatggaaaagataatagaggaagaggagataagttgctgacaagtgggacccacaagttgactcagctgccatgtaggacaaaaccgtctccgaaaccgccgagggaggtgatttgctctggttttcagagaagaaggaggcgttatacccagttttccggttgagggatgttattcacacaagcgcaagacatgagagaggcaaaatggacttattccatttagaaatacaaaatttggtagggttggcttaggcaaccaaccaacccaagccaaccaaagaagccctcaaatctttgtctcggcccataatggccagcgtttatggctcacttctaatgggctgtggcccacctgaaacagaagagtatcgtgtaggcgtatatgcc

SEQ ID NO: 12724 - DNA, 1501 bp, Oryza sativa
cctggatccagagctccatgggcccggcgagctggaacggtggcagggtcgggtcgaaggctcgcttcccgctcttgccacgccggatctcggcgagcgccgtgtcgtcggcgtcggcctgggaccggaagatgggcaggtcgacgaagtcccatcggttgacgtcctcgagcaggcgcaccggcaccaccttcctcccgacctcgatgtcgaactcgtacgccaccgcctgccccacgagcgcgtcgcgcacgtcgaacccggacaccttgagctcctccgactggaaccccagccccttcacgatcgcctccctcaggtcctgcaccgatcgatccgccacacgcgcgcatcgttacattaacatatcagaatcgttccgcgacaaggacgaatcggccaatcgggcgttggaagaggagaaatttcttcgtgtaactcaccgagatggccttggggacgggaggcttggccgccgccgacgacgacgcctgcctcacgaggccaggcgacgacccgaccgctaggagaagagcgagcggcagcgcgaggattcgccaccgagctcgagcggccattgctgcctccctccgattcaaccagcgaaattttctcctgcgagaggaggaagaacaccgcggcggaagcggagagattgaaaaagagggaaattcattttattggtccaaataaagtttttcttgagaggatgacccgtgggcccccgtgtccgtgggccccacctagagctacgtggaactctctagagcgcggccacgtgggttcgtttcgagtaaacgaggggaaaacgtgtatcgaaccaatcaagggcgagcaaacgattgcgtggacgcggggcccgggcggttgcagcagcggcttctccgtcggtttgcgaacagacccagataatttaaccgccaaaaaaacgacccgataaagcgataagccggccgcttgaaggatttcttagaattcagaaaattctttttttacgtccaaaagaaatcataaaagtttaaaactcgtcactaaacttttcgaaccaaactttccaataatttagataactttacagaattaaacaaacatcaaaccatcaatcgagatatcgaaactaataaaggcagagctcacgaaggtgtggccacgataaggatagtcgtgccaagccaacaacgagctcacgaaggtgtggtcacgacaaggatagtcgtgccaagccaacaacataacttgatacacattaataagtcactacatgaaaatgtaaaaatagggaaaagaagacaacataatcgtgttgcaaaatcaacttgcttgcgttttctcatattattctttttattcagccatacgcgtaggtaacaaaaagtaattgaatcaaacattgtatctctaatcttcatgatgtgtcgttccacactatgacgaagttagaaaatttctaagcctatggctcaagtaggacttagctgataagatatttggttttcttaaa

SEQ ID NO: 12725 - DNA, 1501 bp, Oryza sativa
tccaaaaatatcaaaacatgttacgatataaaacggatggagcagtaattgtgttcttttatgtttggaattccaaacttactgcataaccatgaggccatttcatagaagcgttgtactactaactgggctgcgttcggcagaccaggttccaactcttcctcctcgttttccacgcgcacgtttttcaaattaataaacgttactttttaaaaaaaaatttctatacaaaagttgcttaaaaaatcaaattaatccatttttataaaaaaaattaataattaattaattaaatcacacgctaatcgctgctccgttttgcgtgccggggagtgagggctcccaaacctcactcccgaacgcagtctaaactgtgaaaggtgaagcactgagtatttgatgtcaaatctcaatcatatagaaatataattctaattattttaaaaaggaaaaaaaatccattttaagtcactgaactttcataaaatctgctcctactcttcatatcagacgatgttcatactacaatatttcaaatcatttaccttacacccctcatccataactagaactagattgtttaaagcttacagggtgcttatctagcattatagtaaaaaaaaagtgtgaagtgcacgggcggtacttaaatttgaacggatgtgtcatctatgtccctaaactctcgaaatgtaattttagatcctcgatcttgtcatgtgtatcacataggtccaaacatactccaacccgctccttaagatgacatggcatgccggtgactcctacgtatcaatagaacccatacgtcagtcgcgtatagaaaaattaagaacatatattttctcctctctttttcattttactttttaaattaaaaacatcattttctcctctctctctctctctctctcactctcatcccttttaaatttttcttttttctgtgtgagtgacatgtggatcccaccgccacgtaggagtaaccgtggcatgccacgtcagcacacggagcaggttggaacccgtttagatatatatgacacctgagacaagttaagggatccaaaatgcattttgagaattcaggaatttaggtaacacacccgcacaagtttagagacttttcgtgcactttactaaaaaaggaagtaagatccacattgattctctccttccttacctttcgtcctcatcattctctgcttggcaaatgtttcatatagcttgatgccccctccctgtatgatctcaataagggcactcacagtgcaagcacctattgtgaggtaccacaaggtgacacctagggtggagagcttcaaagacactctctccacaatgcaagcaccgctagtgggacacacatatactactttaccaaatccccaactccctcaatcattacgcccgcctcctcctctctcactcaccacgtcggctctcccttgctccctccagcagcgccggctcccctcctcctccgccggcgcggctctcc

SEQ ID NO: 12726 - DNA, 1501 bp, Oryza sativa
gtgctagtaagtaaatattatgcttgtatttaagctttagatgtttagtggagagattcagcccttctacatcctacaataaggctgcaagccatgggccatggcccgtacacgcccaactttaggcccgaattcgcattcgatccgctaataacaatccagtagcaccgcgaactgtcatccgttagcaaacttcccttgatcccaacaaatttcgctcgaaaacactactctcttgtacactgcaggttgttcgcttcagagtttcagagcgtgtcgcgtgcaaccgtgcagtgaagctctccgtccccgaccgtctccgattttccagccgctttcgcgatctcctctcatccccctgttataaagccccactaccctccagacacgcctagcctctcatcgtctcgatcgatctctcacacgcgcgcgcctccattgttctcggatcaacaagctctccaagaacagcagcaaagatgaagccttcgtcttcctccgtcggcgtctgtaccctgctggtggcggtggcctccctgcagctcctcctcgtcgtcgccgtcgccgcctcggcgaagactgcaccggcgatgccagacgaggagttcttgggccgtctctgcgaccagcagcagggggccacgcggcggcggctcccgtggtgccagcagctgcacgcgaggcggcgccacggcggtggcggcggcggcgtcggcgtcggcaagcggcggcgggtgccgatgccgccgcccagccgcgccggcgaggagatcgacgcgcgctacgacgtgtccaagcgggtcgtgccgagcggaccgaacccgctgcacaactagactgatcgatcgatcgtgtatctgccgcttgcattgcatgcgggcgtgcgtcctcattgatctttcttcccgttgcgcgggggcggctgatcggcggctgggcgcgcgcccgcggtcagtccgcccctatagtactactgtactactactatactagcactactatactactatacctactactattcctacatacaataaatgaatgtatacacatacgaataaacataaaaatttattcatatgcatacattttttacctatataaaaactacatacatgtatatgttgtatacgtatatacaatttaactttgtatacgtgtatacaaactttatatacgcatacgtatacaaagtttgtttttttttttgacaaattgatccttgtagaaaacttatttcgaaattagtctttgccaaaaactatatccagatataggctgttggctcagcgccaaagttgttagcgctgaggttgttcctgtcagcgtcaacaggactggcgctggtattgcgccagcgtggcgggcgaggagcgacgtggcatggcaccaacgcaaatgtatttggcgctgaccccttatacatggtaaacagactgatgtcttgtaatgaattagttatgtactgctgcaatggtaagttcctttgcctggtgtacct

SEQ ID NO: 12727 - DNA, 1501 bp, Oryza sativa
ttaataacctggatagcatgtctgtgatagttcataatgtaaaaggaaaagaaatgagctttaaaaaggataaaataacttatttacaatgtacaacaaatatctctgtgcttttgagggcacacatttttatgaaatgtacttttttaagtacacacgatttttttccatttcagatatttctttgcagttgcgtattgtctaacacgtactagtatgttaattgactttttgagaagttcttaatagtataacaccactgtcaacttctcgtattcaatacgagcaatgagcaagaaagaaagtacaagtacaccactcatcagcccaacaacaaaaaggaaagacagcaaaatacagtagacaaccacgtaccagctcactatctccatcacaaacgttgaaaacgtatagatacaacctacaagtcgtgaaataaacataacccagctggttagattttctctacaaaaataaatcactcggagttctagataatgatgctcgaactaattgataagtgtaaagatattgtgagcaactacaattaattgcatcatggtaaagaaaaaataactatacaattatacaaccagccaactgtccacctaatgctcagattaacactaatatcatctctactggctgccattagttcattaggtcccccactaatactgaccaccattaaattagagagaaaaagaaattaaaaaaaaagaatactaagaaaaatcaggctatccgaagttcccaacggtcacctcgtcgtcgttgccaaatctgccatgtcgccgccatggatcccctaatcgaggacccccccaacctagcggagacgaagaagaacgagaagggaagcccaccgcgtcgccatcattaactcctcctctcctctcgtctccctcgaaagcaccaccggatccgacgaccccctcctcccctttctcccctcctcacgaaaccgcctcgccttcctcttcttttctttttcgctcgcttcgcatcgctcacatgcccctgcctgccgccgcagacggggcgccatgtcgcgtagcggggtggaggtggtcgtgagcaggggttgctccaggctcgtcctccccgggatgcagccttcctccgcctccgccgcttcctcctcctccttctcgcgcggcggacatggcggcggcggcgaccggaggccgctgcccgatggccccttcgccggattggtcatctgcgtcaccgggctatccaaaggtgcgttgcttttttgcttcttgatttttttttggcccaaaatggtgaaatctctgctgtagtattgatgaggtgcgcttctttttttttgtgtgtgttcttggtggttggggatttgtgttgtgtgcagaggcgaggactcaggtgaaggaggcgactgagaggatgggaggcgagtacagcgggagcctgcatcccaagtgcacccacctagtggttcagatatccttgcaaagatcatggattatggtagctt

SEQ ID NO: 12728 - DNA, 1501 bp, Oryza sativa
ctagtcggcaccacacacacatagcacgtactacacgcacgcgcgcgcgtctcaaggtacgcagctacagcttagctagcgcgagctggagcgcacaatttggttatcgccatctcttcgatcgcggcaggtcgcggggcgtcacgtaccgcgtgcgactggttcaattctattaattctcgcatgcatgcagtagtagtagtacgtactggggatatgatagtgcaggtgcggtgatgtgcatgtgtcgtcgatcggttaggcctcagctttcgtgggccttaatatatatagtacatcaatggtcgtcctcccttaattcagtgtttagtttctatcattattatcccttagtttctaagggcagtcccaaccctccatctagaatggtgtctatggcattaactatattgccatgtaggacttttagcttatgtggcactatattaattaagagagagtgaagagaggaataaactgagtctcatgcaagacacagtttcaacacgagaacctatgtactagacactatcaagttttgcattgggagataatagtgtctttataatagatgaagactaaatatgattggtagagaagagagatgatgtatttattaatggcccactttaaaaaaccatgggttgtagagtatagtttctattatgatgtcttattgacatggcaccatagacactgtttatggatattatgggttgggactgccccaaacactgagttgatcgatcgattatcgaccagcagcatcgatcgatcgatcgatctccggtgtgttttgtcaactgtcaaataaagcggggatagagttgattgggggtgtctgcggttcagctggccatattaattggttggttattagtacccttctgtcacccgcacaaatcatatcgttgaatcagtgtacgtacgtacgttcatgcatactatgccttgtaacttggagtagattgcctaccagccctttttgttgactcggtacgaccgtagactgttgtactgcatgttgttttcaggacataaaaatgatggcctgactcgatcagtccagcccagcctcagacaagttcggttggcccagcacgaatctcagtacatatgatctgacgtactgtgcacacagtgctcctgtgggtgccatcgtatcacttattcgcgaaataaacgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 12729 - DNA, 1501 bp, Oryza sativa
ttttgggaaagtgagacgataaatataggcggattggttttccatctaataagtgagaaagaaaaaaaaagaatgatgtgggcccaacgttgtacgtacgtatcaaagtatggacgtacttgtttttttatacctatacgtgcacatacaatgtgagtttttgaggtaaatttaattgtattttttataatagatctaatagttataaatataggtccactgcattctaaaattttttaaagcgccacataataacttaggagtgtttttagaggtgctatgtggcggcttaggaacatttattggaagtttaatggacttttagtagataatagatagataatagataatagatagattgaagattaggaaagggaagaggatatgtggggagagagggagtacgtacgttacgtaccaactggaggaggaggaggaggggaacgtagaggaggtggggaccggtgtggagaggaggattttatttttttatttgatctaatggttgaaaatattggacccaccaatttaaaggaaaatcaacggttagacttttagaatgccacttggtatctttggagcgtttgtaggaggacacgtggtggcttaggagcgcttataggaaatttaatggacttttagtatataatagatagattataatgtaattgtgaggtaattacattgcaactcatatggattatattataattgggtgactatatatgaaactatgaatcaaggatattgaataacaaatgattaaaagcacgtaaatgtacgagcatatccgcttaaaaaatattgtattttgcaaagtttagttgcaggcagtgtgtttggctgcctccatatagagccattttgaccgtctgcgaaaatattttttttattagtggcatgctgtcacaccccgaagttttcctcccaagccaaaattgtaattttgataaatgaccctaagaaaatgcaggtgaaatcaggagaaaaccctaagaaagtaatgcaaataataatcggatttgacatgtggaatttttcttgagttctacatgtcgaaactcattaacagggatttttagtggaattttcagagctctagaaataattttaaccaattaaaattgagcaagcaatgttttaattccagggaaaatcctttttcctttttttcttttttcttttccctccctttttcctcctttttccgaatgggccgccggcccattccctccttccttccccctcccccttactgggccggccgcaggccgaggcccagccaggccgcccgccgccctcctctccgggtcgccgacaggtggggcccacctgtcgggcccgtctcccacctcccgccgatctcgctcgcgccgccgcgccgcaaccgccgccgcgccctcgcctccgcctcccccgggccacgtcgaccacgcccgcgcgtgcgccgcgtctcccgcgcccactcccctctctctcccgctcgcgcccgcgcccgaga

SEQ ID NO: 12730 - DNA, 1501 bp, Oryza sativa
ccattctcccttcccttcccttcttccctcctttcttcgcgtgggccggcccatctcggctcccccttctccaagtcacataacccccatccttcttccttcttcccttgccgacaggtggacccgaagccccaccttgttattgtctccccccaaccgtttccgcctctctacttttccccgagccaccgacaggtgggccccacctgtcgggtccttcccccacctcccgccgatcccggtgcgccgccgcgccgaaaccgtcgccgcacccacttcctccgctttccccgcgcccacgccacgtcgccgcgcccacgccacgtcgccgccctctccccgcgtctcccggccgcgccagcgcacgagaggggcgggattcgattttgaatcttcccccccaccttctctctctcctcccccacgtcgccggcgaaatcggagcgccttccggacacgttcgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgtcgcaagacccttcccggccgctgctctgcgtcgccggaataccaccgaaaccccatttccctcgcgtcgtcggtgagttctctctccccttcgactccggccggcgtggatggtcgccgtgggggttttcctccgacctaattcctctcctctctttccctaggtgtcgccgtcgctcgtccgcacctcggcatcgccggtcttcgccgcctccctcgtttttctccgccggccattgccgcccctccggtgaggtctccctccccttccttcccttctttttttttccccgtgcgccgccgccctcttcgcgcgctcgctggcgctttcgggcggcgccgatcgcgccggcgacccgccgtccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccccttgagccgctgccgagtgggcccgtgtaccagcgccctccccctttgactcgctgacgtgtggggcccgcctgtcggcgccggccctttgctgacgtcagcggcagtccttttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgcca

SEQ ID NO: 12731 - DNA, 1501 bp, Oryza sativa
caagtaagtttaacattttttaaaagtaacttcaatgttaattggaagtaacttttgcatggttgagaagtaactctctgtaaatccgtttaatcaccgattgtttttttcctttcgttttcgcttttcatatagaatgagaaaagaagataaaacctttcatggattgtaaataacattgatggaataacttttaggtttattgaattacttttttatgtccaagaagtaatttagtgaaatttaaatgtaatttagatatattatccaagtaatttatatttttttcatcaaaatataatcatgtgagattttgttataaagatttaattgttacgaacacaacagtgtaatcggatcatagattggatgagtagtttaagagaaaattttatttgaagtataggtagatactatctttaatagatggagtggtagctggtttagacaaaccagctaccactagctgtgtagccacatccttggtggtattgaccccggttttatctgacgtggtggccgagttaacgtgggcccacgtgtgtcccacatatcaggatgaccacgtcatcactctctctctctctctttccctttttctttcctttcttcccctctcccactcttctcgtctggggaagttggccagtgagtggacaggaggctggcggggcgagtgtaacatcccggcctagagcttaataggattaatagaatactcgtaccaacaagttgcaacttcttttccggaagccgatcttgtcacgtcctgataaattcattccaaaataaaattcattttctaaaaggaataatagaattaattaaaattcgaaaaagaaattggcaaacactaaaaatacgtacaagaaaaattcaaatgtggcccggagaatttttgttaaattctccttggtctaaaaggagccctcaaattttacttgaattttcagagcaccggaaataattattaagcaacaaaaacaattatcaaagtttaataaaaagaaaaaacctaaaaataattctcctcttcctcctttgggccaagcccagcccgaagtccttctctcctccctctctttctctccctccccttctctccctctctctctcccgggcctctcttcccctcccgggcagcccactccctcctctcctcctccttctgggccgcccctccctcctctccttcccggcccaccttttctccctcctctcctcctgggccgcctcggcttcgcccggcccaagccgagccgcgctcccacccgtgccgcgcgcgtgcgcgcgctgaccgcgcgccccgcgtggggcccacgcgccaggccgccgtcgccttcctcctccagccgcccggccacctctctctctctcccgtgaaaaccctactcctttcctccctcaaatccgtgtgattcgctcatgggattccaaaattaaataggggaaattaatccccattgaatcctcttcaattgcccccaaattcccccttgat

SEQ ID NO: 12732 - DNA, 1501 bp, Oryza sativa
cggctggcggcggcggcggctgcaccgcggagacctcgccgtgctcctcgtcctcctcgctccggtgcaagaactcgggcggcgtcggcggtgaagacgacgacgatggtgtcggcggcggcggcgccgtcgtcgctgagaacgcctcggcgctgtccgactccgggctgtcgtcggccatcgcgtcgcgccggttcttcctctcctcgcccggcaggtccaactccatcgtcgactcgtcggcgcacggcgccgccgtcggcgtgggcgcggccggggtggcggtgcagacgtactcgccggacccgcacgccgacttcctcaggtcgatggaggctatggtcggcggcgctgcggctggacgcgcgccgccgcggcgacagggcgcggctccacgagctgctcttttggtacctcgcgctcaacgaccggcgcgcccacaagtacgtggtcagcgcattcacggacctcttcttcggcatcaccgcggccgccaaccttacgacggcgagccccgcgccgtgggccgcccacctgcacgagtcacattgaacccttttgctttcttgatttcttaattctcttccatttttttgatttttttttgggtctcacttttctatttgaattgctgcgtacgaacagatttttggtacgagattcttcgaacgatcgactgaaaatctcgttgcatgcaaaattgccagcaaaatgttttgtactctaaaatgtcggggtcgtctagctagctgtaaatatgtctggaaatttcgtaccaaagttcagttcgtatgcaaaagcttttcactttttctaaggcgtgagcgtgttggtgaagacagtatgatatcggcttccccaaatgtgctgctttgtgtttgcctttttggccatctttgtgagtcatcttttcactgtttcgctcatttcatctttcctgctctctctctctgctggttatctgaacttcctactaattataaggctgaatttgttgttgtgtggttgatgttgtaataagctgtactaaccattatgattgctactagtactaaatatttgggatgtgtatgtacaatcttattggctttccatcacaatctctgccactaattgtatatgtcttcagagaattcagcattctgtttacttcttacctgtccttatcagtgttaacacaagttgtaaactaccctgtaaacgaggtctcttcccttgagaggagtgaggtcctctttggatccagccacagttggcaataataaaagcaggtgccgtgcaaaacagaaaaccaattggcacagtgcatgacctctgtatgtgttagttggacggatcacatctgagtgacatcaacatttctctcctttcgtgacaaaactcatgcatcgtgatagcaaaaacctctaaagaagaaaaaagagtcctattagtgacgaactgcaaagcaattaagcctgtgaggagagacattgacattgcaaccgagaagaaagatcaa

SEQ ID NO: 12733 - DNA, 1501 bp, Oryza sativa
atgtataattcggtaaaatcgtcatgaagactacaacagaatcagcaccaatgtactcactccaacagaatcatatcagggcatcaggctatcaatagcttagctctttgcattatataatcatgcaccgcaagctcgcgatccaatagttctactccactctataagctaaatcatggtaccgccaaatgcatcgcagatctgaacccgacctagtatacgagaaagggggaaatttctctgcgccataacgctgatactaactaaacaaaacaacagctcaactgacagttaagcggggagaagaagggtgtctcactcacgaggtttgccttagtcggggacgacgcgcggaggagggcggcggcgaggggctcccagaaggcggccgccgcggaggagccgccgctcgcctcctccatcgtcgccttcacgcggtactcaggctcggcgacaaggcgcgcgagcaaggcgctggtgtccgcttccacccctacggaggcggcggccgcagtcgtcagcccgcgccacagccgccggcgcgcggcggcgatcgccatcggtgatcggcggcggtagcttctgcttcgccagtgaatcgcgtggatataaatgggcctctcatccaccgtaacacaattacggcccaaaatttatagtccgtacaatacgttcttcccaataagtatgggccacacgtcactagaaaagcgacagtaagttcacttatgatccctccctttccctccatacaccttaggtggtgtttgaatctcctgaaaatgaagatgaagattaagattaagtgtttcatgcaaaacgagatggtaataacatgtaattaattgagttttaattattacaaacttgaaaaatatattaatctggtattttagagtaactttcatatagaaagttttcgcacgaaacacaccgtttagaacttaaaaagcatgccactagtatccaaaatttcatccaactcttgtgggagaaacggacacagcctaagtatagaccgcccgtactccgcaatctcgctcgagcccaataaaaagaggacgcaatcctgttcgggcctaataagtatgggccgcaagttgtcacgtacactgcaatcaatatgggccaggccgggacgatgacgtagtctccaaccgccaacggcgtccgatgacagctagcgtacgtgttcatgggagtgagtttagtctgcatgcaccgccaccgtggtcgtcgacacccggaaagaccagagaggtggcggaggaagaagcgaacaaacagcaccgctcacacgcgccacgcatgccgctcccattcgcgcgcgacacgaacgcgcccacgtcgccgccgtctcccacacctgtcccccgttctacccggcgagccgcgccatatatgacctcgaaatcgaagatctctctcacacattcacagcgcagaccacacacgatctcactacaatagtgctagctacgacgagagtgtactaggacga

SEQ ID NO: 12734 - DNA, 1501 bp, Oryza sativa
atttctttaaaatatgtttatagctggcttatagcctgctattgtatctgctctcatactctggagtaggggatgtactccctctgtactcgtaaagaaagtcattttggacagcggcacggtctccaaaacacaactttgactttttatttctataaaaatatttattgaaaagtgatatatgtatacttttgtgaaagtatttttcaatacaaatctattcatataatttttacattttcaaactcaacaacttgagagttattcatgatttatattcccaaggtttgacttaaacattatcccaaacgacttcctttacgaatacggagggagtagtaattaaaggtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcttgccccggccccgagggccgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgtgcggtctcccggtgaggagccacgagctccgtcatctggcgcgccaggtagggggctcagcgtgtgttttctgagctctcatactcttccgtgtgcgccaagtttcccttgttcagcctaa

SEQ ID NO: 12735 - DNA, 1501 bp, Oryza sativa
taaagtaatcaatgcaagcaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgatttcatatgaatttattatgaattttacaagattaaattccaattaaacctattaaagaaaagactattccaaattaattaaacaatttacaaatgatttataacggagacagaagattaaagcaacctccggaaaagattagattatattggtagatgacatgataaaaagaaaaaggactaatatgccattgaaaagatagaacgaatttatattgattttggacggctgagattaatcttgaccgagagttgaccaagatcggatggcttagattgatctggcaagcgggcctcacgagataccgactcaacgagtcaattctacgtgacacgggatcacccaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaaaccggtggactagaaacgattcatggtaaaaccccggtacgacaaacgatagaccggtaggaacctagggttgcacctacggctgcacaactcgactaaaagcagcggctaggtttaagcggcacacaactgcgacacggcggcactagggcgacttggcttggctaggcggcagctcagcggatacacaaagctagggttagggtgacggcacagccggtagcaaccatgcacggctagaacagcagggctatgagcaaaaacgcaaccggcacggctgcggctgtggcaaagcggcaagcagctgcagctaagcggctcagccggcacacgcgcagcagcggcacggcaagcagcagctacgacacagcgatgacgacacacacggagacgatgatgacgttagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacagacggcgagggagatggcaggcgacgagctccaaaggcggcgaccttgggttgacgatggcgacggcttttcggcgacgagaggcaacaaccgagggc

SEQ ID NO: 12736 - DNA, 1354 bp, Oryza sativa
tgtataaagtattatttatgttttatcattaacaacaataaaaatactaatcataaaaaaaattcatataagacggacagtcaaacatagaacacggaaacccaggaattgagtcttttttttggacggagggagtatgtcactattactagcttgtagtaaccgtagcccgtgcaactacaacaaaaggacagtcgaataggacctatatacgattcatacacaaagtattgtctccattttaaaatataagacacaaccacccttaactcaaagaccaagaaataattattatcacatcatagtttggattaccgtaataaatagaatgcatgcacccaacaaaattagagatcttgataatgggggatttaaataataatattttagtgaaaaagatgtgttagttaatggcatgtatgcatgcacgcttatattatgaaacaactttaaaaagtaattgtgccttatattttggaatggagggagtagtataaaaggtagtgggtgggggaataaaatagtactccctccattccaaattgatctacatatagttttttgaggttattcctaaatgatctacatatttgtgtttattattaagtatattcgttatttgtgtattggagtaaatgggcattgatgcatgcatccatgcacacaagtatttataacccacatgcactatcttgatttgctattggctagaaaatattagggatgatgcatgcatcgagtttgttgctagaataaatatagtatgagagagttattagcttttcttggtcttggtgtgcctataaaatatgtagatcaatttagaatggagggagtataaaagttggtaggtagagaataaagtaccgtctcagtattccaaaacaccttataattcatgataaatttagaagaactcccttatattatgggatggaggatgtatttgccaccacgatgactatacatgaatagtgtttgcttatgtcacctattggcatccttcaatatccaactgtatccgacacatttttgtccctattgatccgattcatcaccgagctagctagagtggttgcatgcttatttatgccaattctattctacacccttctagttcgagaatacacgtatttatgacactagacatgaatatcaaattaagcattaaggttgtagtccacatataggactatacaatgaatagagatgtattgcgtagctgaaaattaagtagcctagtctgagaggcttggccaattgctagttccacccttgcttaattccaaacaaatttgcaggagatataccatatatatagctgctacaactaaattttccctctttacttagg

SEQ ID NO: 12737 - DNA, 1501 bp, Oryza sativa
aagaaattcagtgtgccaaaagaggtaagattcagagcagcaatgggaaatgggatggagcaaaattgactgaacaaaattgttgaacaaattcgccagaactcttgagggtttgggctagaaaccaatctgatgcaggcgcgaagcccaacaatttgacatggatctattatcctttttctggatcatatttgttccagcctcatttggacaagatgtggcagaagcccaacatatttcatccatgatccaaccagttcccagtgcaaacatcttcacagccttttggcccttattaattcggagcccacttcaggggaaaaaaaaaggaaatatccaccaagaaacctgcaattttctccaaataacaaaacaactagtgatttattaaacgggtttactatagatttctatcgacaaaaaaaagagaattctttttcattttttttgaccatcagatgtgcttgaagattcatgaagggcttgagagagaaaaatcatgtgaaaactcaaataggcttacatagggatggaaccccgatctactccattcgtctctaaatataagatattttggttggatgtgacatatcctaatacgacgaatctggacaggagctatgtcacatccaaccaaatttcttatatttagggacggagggagtattactcacaagtaggtttacatagggatggaagcctgatctcttattaacaagccgcacgcactagccaccagagccatcaaagtggttttagaagtggaaaaggtacaaattacatccttgaatcagaaaaccagacagcgcttaccttgaactttcaatacaggacgaattatcccccttgacataatcccgagcgattttattctatatggcatacgcatgacaatctagtcagtattttttttaaaaaaaatggtggagtccccttgtcatactctctcacctcctcccctccccctctctctccctctctctcacgcgcgtcatcgggcacacgcgtaggtcgagcggcggcgggcggttggcgcaaacggtatcgcacggggatgggtggtgagcggcagcccggacaaggaagcaagagctgtgaactccaagagggagccggagttgtgggaggccaccacgaagtacctgaactgcggcgtccggttagcctagacgacaagcaaccgccccctcggcgcgccaagtgtgattgtataatacaattacaatatgattgtatttggaagattttgaaaaggattttttaatagaaagtttaactttcaggtaatccctcattaaaatttaccatccttaagatggatcagcacatgttgttgtcgcttgaaagctgcaaatctccaaatttccagcgacacacgcacgtcgctgcggttggacgtcgcgggccacgcggtagaccgcgacaaacacttgccaccttctttgtgtcgccttatccctcgccacgccgtgcgcgtggcgcgcccggaaggcgagagaca

SEQ ID NO: 12738 - DNA, 1501 bp, Oryza sativa
cacacgctgtgcttactcatcgtcacagcagcatctaactcccagtacattacaaaaaaaaagtaaatattactcagttttcttttaaaaaaaacgtattcgtaggtaggtatgcggctggtacgtgtttgctgggaagattccaacttgctccagttgcgataaatttccatgtttaaatttctcgtgtcgtgtagcacatagcctttttaattttcattcgttttttgtcagctacggcctcgcccagatgaaacctagcttgttttttaggcgatttttgaaaatggaattttatttggcaatatggacttttttttcgtggcgcatatgcgcgtttggtccacgaaatatccggctcgtggggttccgttcacacgcgggcgtcctacgtggcgcgtgctcagggttcggtgtactggactactggggtggtggttggtgcggttggcagttgtgctctcatctgggccgtccaaactgggaagccatctcatccactccatccctccatcggatgtagtactaattttcatacctccatcggatcctaaatatgataatttctagctatgtatctggataggggcatatgcatatacataagtagaacattgttaatatttgcgacaatggaaggatagttccaatttatgtgcttatacttgaatctattttaatttagagcccttatcgtattttattaatgtttttatgagagagtttctgaaactactcgattttactattaaaatttaataggtttggaactaaatcttactattaaactttgataggtttggaagtagcaatgatgtgaacacaacccaacagacagctgctggtgattgatttgtctcgagctgaactggtgctaatcatgcacggtactactccagtagtgatttttgtacagccagctggtactaatttcctcctaaacatagggttgttgttagcattttgttctctcatcagcttctacctgctcttgaaataaaagtaggactgcaatctgttgtaccttactatggctgtgtttagatctaaagtttggatccaaacttcagtccttttccatcacatcaacctgtcatcagcttctacctgctcttgaaataaaagtaggactgcaatctgttgtaccttactatggctgtgtttagatctaaagtttggatccaaacttcagtccttttccatcacatcaacctgtcatacacacacaacttttcagtcacatcatctccaatttcaaccaaaatttaaactttacgctgaactaaacacaacctatatgaaagctctgcgttgtgtttttccatttagagaaatcaatggtgtatatataagagtacagtttagttggactgtgtatgtatgttcgtggaataggagcctgcttagggcccctttgaatcgcatgattgaaaaaaacgtaggaatagaaaaaacgtagaattttgatatgaatgtaagtggaaaacagagcattgcaaaa

SEQ ID NO: 12739 - DNA, 1501 bp, Oryza sativa
gtcttgttttaagttttgagtagcagcgttaccggatcttatctcaaggatttatcaatctgtttttacctgaacatctccataagaagttatctgtgggattttgagactagtttctctgttttgttaatgtgctgtcgtgagaacatagagtatgtggtttggaccagctatctaaattatgtatgcacttccatgttctctgtgatgtcctgtattttgatgctgtgatcttgtatcgctgtatcatattgttctagggctcatggcttactcggtcaccatggcgctgattccattcacagtgttcagcctacttaaacatatttgcaattttggttagatgagtttgttgtgaaatctggtcagtgggcatgcctagcaagcctaaatcaagttgagcgagcctcaatcttatcttgcttttggtgaggaaaatgttgtctgttttgtggttgtgttagttgaggaaaatatggtcgtgccattgctttaatcctggaatcactgtgatgactgactgaaacgagtttgctagttaaccaaactctgttaccgtcaatgattgaggaagaagtcttggctcgtgctgttgcagaaattgcacgggattgaatcagtggcaacttgagttctggatgaattttcttccaaacaaaacctcgacagttcgactgtgctggcaaccactgttccttggtttgcattctgttttgcgggaccgcttagcgttacgacaaatttagggcctgttcactttgatgacattttcaaccttaccaaattttggtaaagttgccaaaaaagtggctacatttagtttgctaccaaattttggtaactaatgaaatcttgccaaaattttggcatagttgtcaaaatttcagcaataccaaaatttagtaaggattttttttaagtatcaaagtgaacatgcccttagcaaaacactgaaactttgtccgaaatttgatccaaaacgaacggtttgaggaagcttcggacggaattcgaactaacgccgtgtttagttccaaataattcttcaaactttcaacttttccatcacatgaaaactttcctacacacataaacttccaacttttcatcacatcgttctaattttaaccaaacttctaattttagtgtgaactaaacacaactaagactgtttagttcaacgcaaagtttagattttggttgaaattagagatgatgtgattaaaaagttgtgtgtgtatgacaggttgatgtgatgaaaaaggactgaagtttggatccaaaccttgcatctaaacagtaaacacagcccaaattcgtaaaccgtcgggttcattcacttcaccccgcgtcaaacacgcaacggaccggagcgcgccgcgaagccagctcactcggtcagtcgcgcacgtggccccactccaccggccacgtcaccctccacgtcatcaaaagcattctctccctcctactctcccctcgtctactactacttcacctc

SEQ ID NO: 12740 - DNA, 1501 bp, Oryza sativa
cacgattttttcctcccgaacacgcactgacgtggcatcgctacagtaaaaaaagccatgaggtggcatgctgacgtggcgctccgttccttcctctctcaagcatatatgtatgacatgtgggcccggaatgtcagtaacagggaatcccgaaaaaattgcagctatgtgataatttctaacactaatgttgcagttttctgaaaagtggcgcaaaggttgcagcaaagtaatagtttagtcaataaaagtgcagttttctgaatttactcaaaaaactaatatttatgtttttactctgtaaggaaacaagaaatgttgtatctaaataaccgatatatctgatatctatccctaattaataattattaatatgtctcttgcaatcatggtgattactcaatttaataaacccacgcaacgagcatacggcatatttggaatctttcgaggacagaatacgacacttatccgataagggttttgtgaccaaagccaagacatagatctctaaattctccctcttttgcacttcatgttttttgaaaaggggaatatcattgcttactcctggccttctgtggtggagtgtgaggagaacctcctcctttcccctgtgatgtccccctatccaagaactaaaaggcaggataaagccaatggttcctttctcttgacaaagatttgtgcaaatcaaatctttctaccacctgtcctaactcctcagccttcctcaggtttgtggtgggttgtgagtaggaactagcatggaaaaaaatattcttatatttgtacttcaataccatcttggttttgtcatgttcatgtatgtgtttgggatcatgtgtaacctttggcataaaccttatgatattctctcgagggctttcttgtcattccacgcgttaataacagtaggaagaacagagatgcaaaatagaagtttgctttgcaacacatagatttactaatatatgtcaaagcatggacttttgctttgctttgttggaagttcagggatcgccacaaatccaaggttttacttgacaagttattgacttttcaattgactacagagctggttggtataatctgcttagattgtctagatttttattaaattcagcaagtaatgtaattggcatccaattacagtaagcacataaaacagaggtaggagatatcatctgatacgtgggctgcagctgaacaatccaaagtgcctgtagactgtagtgcagggcctcagaaaatgtacatttcagtttcagccaagtcatgttgacttggtaattcagataaaatgataaacgcaatctcgaaaagaaaatggcaaacacgatggagtatttgtgaaaataaattgatacttggacttggtattagacaaactacagccaagagcaacgtcattttcagaaccaatgtcgtgccgcctcatccattgacagaatgggctcatatcgttatatagctgggtttcagaatgacatgaatcagt

SEQ ID NO: 12741 - DNA, 1501 bp, Oryza sativa
agacttgatttatgttgaattgtcgtctcatgtcagctctcctcgccaccaatgaagctcaccatacatagagggtaaaaaaaaatgatataatgcattctaccagtttcttttctcaaattaagttttcgttgaaaacgactcaactgtaacaaaataaaattcccaacaattcctacgaaccattccttcatcaataaaatacaagtcttctagcccctttgcacattcacatccctataaaacacacgctgtgcttactcatcgtcacagcagcatctaactcccagtacattacaaaaaaaaagtaaatattactcagttttcttttaaaaaaaacgtattcgtaggtaggtatgcggctggtacgtgtttgctgggaagattccaacttgctccagttgcgataaatttccatgtttaaatttctcgtgtcgtgtagcacatagcctttttaattttcattcgttttttgtcagctacggcctcgcccagatgaaacctagcttgttttttaggcgatttttgaaaatggaattttatttggcaatatgggcttttttttcgtggcgcatatgcgcgtttggtccacgaaatatccggctcgtggggttccgttcacacgcgggcgtcctacgtggcgcgtgctcagggttcggtgtactggactactggggtggtggttggtgcggttggcagttgtgctctcatctgggccgtccaaactgggaagccatctcatccactccatcccttttggcttcttcgtgtcattccattctccaacacaacagtttgttattaaaattggagttttaaaagaaaattaaaatcaacggcttgttccctttgttattaaaatttggtacttactccgactaatgttatgagactttctagtattgtccacatttatatatatgttaatgaatctaggcatacatgtgtgtctagattcattaagatctatatgaatgtggccaatgctagaaagtcttataacctgaaacaaaggtagtactaattttcatacctccatctgatcctaaatatgataatttctagctatgtatctggataggggcatatgcatatacataagtagaaattgctatatttcgaaatggaggtagttcaattttgtgttatcttgaatctattttaatttagagccttatcgtattttattaatgtttttatgagagagtttctgaaactactcgattttactattaaaatttaataggtttggaactaaatcttactattaaactttgataggtttggaagtagcaatgatgtgaacacaacccaacagacagctgctggtgattgatttgtctcgagctgaactggtgctaatcatgcacggtactactccagtagtgatttttgtacagccagctggtactaatttcctcctaaacatagggttgttgttagcattttgttctctcatcagcttctacctgctcttgaaataaaagtaggactgcaatct

SEQ ID NO: 12742 - DNA, 1501 bp, Oryza sativa
agataaagaaagtaggatggagccactgggagagcagaagtgcgggttccaaaaatcagattttttttatttgccctcaaattggcttagatcatttaatgaagcagacgacaagcttttcatggagactctccattatatgcccattcattttttttccttttccaatcatttccgttgtttgattaaggtgcagaaattaattgaactttcaattttttttctgatcgaatcgccatgtaagtatcatatggaatgaagacctagtcaaatgggctttgtatgagccacgtcagttaaaatcaggttcaatactactcggcgggggactatatttgtaccggttttaaagttgagggtacaacgattctgattttgcggtttgaggatgtcttaatttgaaactcaaaaaaaaatgaggaatgtaaagtggacttttaccagtgaaaaaaaggtcagtttgtgagggttggcaaggaggaggggcgagggcgtattgaacaggtcaacaggaacaccctcaccctcgctgcccttcgggttcacccggccccggccctaaagtgaaaaacgggcgtaaaacaacctctgcacccgacacctccggggccctgtcacccgaccgaggccctgctgcacccgcatccgcatggcaacgaccgaggaagagacgatgaggcgtgatgcagtgggacgacgatgaagaggcggagcagcgacgagcaggcgtggggactgtggatggatgaggcggcctgacgacaatgatggtgtgtcgcaccggcagccggagatgaaccggcgcggagtagcagtaggcggcgtcgacagcccggctgcgtgggggcatagaggagaagcaggcggcccggttgcatagggacgcagtagcgtggaggaggagtagggtgacgctagcggtgccggcgacgtgggtgagtgagcttggcaatgacatcgcgttggggaacgcccgcgcgtgcacatgcagtaggcggtatagcgctagcttgggccggtggtagctagggactagaaaagggatagggagagaagaacttatataatacatacttaatttaacccggtttcataagtgggaagtgtttacacctaaatttggtacctatgaatgaaatagaggaaaattgtcaaagtttgaaaagtgttggatttcctccacagggccggtcataccataggtatatgggcggtctgactggctaatagagccggtctgaccgcaggtatgtggccagtcagactgtcagagtccgagtccaagtctgtcttcatcgggtctcaggtttccttactcgggaaggctatgtttcgtatttcctttgatttctatcccgagttagacgtggagaagggcctgtagagggcaagaccaacccctatttaagggacaaggccggttcatttgtaatcccccgaatacaatctcttttaccatgttttctattttacccaagttttagtccatttttttcaattt

SEQ ID NO: 12743 - DNA, 1501 bp, Oryza sativa
cgtcacgaacagcacgacgtagtgcgccacgccgacggcgaagaagaacacggcgccctccctgatccccatggacgcgcccagcagcgcgccgacgaagttgcccacgacggacaggtggttcgacgggttcgccaccatggacagccgcctctgcccgctcgacatccactgcccatagatcttgagctccaggcacagcatcggcgccatgagcgcgtaccagagccacgccgggagcgccgccgtcgacggcgcgacggaccgcggcacgccgatggcgaggaagaggcaggcgatcagcggcgcgaagaagaagttcaccctgaccgggtggaggtactcgcggcggacggcctcgaagaagaagaccaccttgcaggcgtagacggcggagacggcgcaggtgagcgcgacggagagccaccacagcacgaggttcacgtcggcggcgacgtgcaggtacctcgtcgtcggcggcgactccgcgatcctcttccacaggatcgcctggctgcccatcccaaggcagatcccgaacgccgacaccgggaaccgcagcaggaatggccatgtcctatccaccggcagcaccagctcctcctccgactatacgagttgtagcttatttttcagcattggcttttaaaccgctaatatatatatgaattattttttggttgtttcatttatttttctatagcttaccctgagttggtctagttcggggccttccagtgcggcaaagaagcggccaacctcgggcgtggacacagtgtgagaatggtggtgactatccatggcggcatccacgacttgccctgcaggtgaagggatgtccggcccgatgcccgccaggtggctgatctgcctctcgagtctccccgaccacgtcttgaatgaatcatagcgtttgtcccggctcatcgacgaccggccgccaccgggggtaggcgggggtgactggaacgctgttgtctcgtctgtgagccgccggccgttgttgctctgcgacgttggcgagcgctgctgtagcctttgtgtcatgttcgacgccatggcttgcctccggagatctatgcccgacgagtcgctggcaccggcaacaggtgcggcaaagccggttggtgttgctggcaggctgatggacataaccttcttcagctcggaggagtccggtgagtcaagtggcgggaatatcacctcggtttgtcgtggtacacagcgatggagtggtggcaactgtaaagaagacaaacgacaatgactcgggtggtgtttgcatccagggactttaactttagtttctgtatttagatactaatttagagtattaaatatagactagttacaaaactaattacataaatgaaagctgattcgcgagacaaattttttaagcctaagtaatccataattagagaatgtttactgtaacatcacataggctaatcatggattaattaggctcaatagattcgtctcgcaaattagtccaaga

SEQ ID NO: 12744 - DNA, 1501 bp, Oryza sativa
gaagattcaaacttgacaatactgagacaatttgttaacaagatttagccaaaatctacaacccgaacttgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataactagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccg

SEQ ID NO: 12745 - DNA, 1501 bp, Oryza sativa
atccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttccacaatttgcactaatcgcagattagaacaggaaaaagcaaacaaaaataagtccattttaccctgaacccctaaactattttttaagttcaatttacctctaatactactaaaatggtttacttaacattatgtctcttctttgtttttctttatacgagtagtattttaaactaaaatttttgtagtgacatagatgtcaaccactatcaaagttctaaactattttttaaaattcatttattactatttacttgaaatttaaaactcggtatttaatttagtctcattgcttccgatctatgtaaacaataataataaaatttgagaggtaagttataacacatttatcaattctaccaaattttatggcaaaatataacttatacatggggaaaggaaaaggagaaataccatcagaggtgtaaaataagaaaaaaccaatacattactactttatccatttcatattataagttatttgactttattaattagtcaagattctttaggtttcgaccaagtttatagagaaaattagcaatatccatgacaccaaactagttttaataaatttagcattaaatatattttattacaatatttattttatattaaaaatattgctatattttactatcaactctgttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcctccgaccacctcgctcgcctcgcctcgacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcggcggtggcggtgctgtggatgctcgccgctgtggtggcggcggctgcgctggatcctgatcaggacgagctcgaacgcgcgtaa

SEQ ID NO: 12746 - DNA, 1501 bp, Oryza sativa
gataaaacagtaactttaacacaagagacaccagtgatccttaatctgatcgatcatatagctaggctgctaggcctgtggcatgatggatttaattactgtgcattattactactaggaacgagatggcacggttacctttattcgttctttgttgtgtaactctgattctctgatcatcatttttcgattagaagtttagaacaacggtaataaataataaaattactgtaaatttacttggattatattttcagaccaattattgttagaattattgatggttctaagtgcaaaattaaagttcgacaaatttgactgaataaagctaacagcatcatatatttaaatacaaaagcaagtaatttaattattcatccatcccaaaatataagacacatactagtactacgaatctgaacatgcatatcatgtatctaaggtcatagcactagtatgtgttcaatacggggttgctagctactccctccgtctcataataggtgacgtttttgactttttatttgcaacgtttgaccattcgttttatttgaaaaattagtgcaaatataaaaaaagataagtcatatgtaaagtacttttgataataaagcaaatgataaacaaaataaataataattctagattttttttgaataagacgaatgatcaaacattgacaaacaaaaactcaaaaagataagtaatatgggacggagatagtactagtataatattgttgatcgaaacactattaaaatcgtcgtgtacaccgtacgactgtaaaccggacaagctaacaaagcaggccccatatttgtctggttacctagcgagcaacattgcaatcgatcgatcgcttcgctagctagctagctttcaatcccatcaatcaaccaaatacaccgcgagttagagttacaggtcacacgtcttccattaacgctagctatacagcaaaaaaccgaattaagtccacctggctcaccacatcctccgccattcctccctcgcccgggcgctcgatcgatcgatcgatcgccgttgatccgacgacgagacgaggacgtgctcctgccctgaccaaccgatggatggacggacacgtccgtacgcgcatcgatccgttgatttgaatggcgcggtcggggctgaaccatcgcgagagagaagctttttttggatttcttgggagcgtagcgtggctctgcccccctcctagctgattggagttgcgtttagtcattgtagtagtctcttccatttttcttggttgtgttttttttttctcttttcttagcataggctaatctggttgattgcgtcatgcaacaaaattttttaattttcttctaatatattaacgtgcaattattttgtattttcgcgaaaaaaaaatcgctagagagagaccggacagaggggaagcaaaagctcaaccgtacacatgatgaactcgcattcgttcgatccgatcgatcgatggcagccaccagcgcaa

SEQ ID NO: 12747 - DNA, 1501 bp, Oryza sativa
caaaaaaatgattgtattttgttgttacacaacatatgttaaaaaaactctgaatatactaaatgattgatctttcaaatattcaaatccacaagcaaatatatttgaaccaattaattttgatgaatcttaaaatttacttttttttggatttcatcaaaatttatgcataaaatgacatattaaattttgtacttttgcttgacatggcatacaagttctttatttttttataataaatatatttttcactactatacataataactaaattatttatacatacatacataattttttttaatatcatatatgtccatttgtgaaaactaaaatagtggttcacaatttttttaaaaatattttatgaaaactctaaaatttgaaataagaaaagaagtatatgcatattttaaattaatgagcacactaattttttcatatagtatttttgagtgataagtatatataggctatctagcaaacatgcgaatggcacgccgattattttcagtctttgctaaaccctaacctctttctcccgcgctttcgagttttctgaaaccctagtttccccgttgtcgtactcgctccgaaaccctagtttctcctactgccgtactcgctgagatttggccgttcatcggagcattttggagtttgaggaccagtctccatgaagggccgttgtgcgaccgcaggtggtggagcaccatccagcacgagctggattgaggattgaggagaagctccgcaccaccgatgagtgggccccctacactgccgtcgccgggaagaggttttcagcgattttccagcccactggatcccgaagcaggtgagatcgttgggatcagaagcgggcgaggtcaggagatggaggaagaggaggaggatccttcctccatcttcatcgaggagggtcgccgccggagatcgatgaagaggaggagaatccttcctccttcgcacgatctgtcgtgattcaaccccactggatccatctgagctccatataccatatgaccttattctatcgcatagtctattccagatattttttataattttcttttaattttattatgccgcatattatatttcagtattttgagtaaattgcaccaacggtgcttaaacttgtaagcaagtttcacctatctccataaacttgcaaagtgcatatcgagatccctaaacttattttattatatcatcccggtccaaatcctcgtttgaccatagtcttgtctacttggcatgctactttgaagatgacatggcaaaatttcccatttcccttttcaccctcccttcttttctcttcttcctccacgagtgcatgtcgacgtccctaaacttgttttattgtatcatcccggtccaaatcctcgtttgaccatagtcttgcctatgtggcatgcgacttggaagatgacatggcaaaatttccccctttccattttttcccctccccttcttttctcttcttattccaccg

SEQ ID NO: 12748 - DNA, 1501 bp, Oryza sativa
taagttcccatccggaacagtgatcacggaaaacataacggtacaatagcacgtgattaattaaatatttgctattttttttcaaaaatagattaatttgatttttaagcaattttcgtatagaaacattttttttttgcaaaaaacacactgtttagcagtttgaaaagtgtgcacgtggaaaacgagagagaggggttgggaaaagggcatccaaacacagctttaggatgcgtttagttctttgggtgtaaagtttttgaagtatacagacgcacacttaaagtattaaacgtagactaataacaaaacaaattacagattccgcctgtaaactgtgagacgaatttattaagcctaattaatccgttattagtaaatatttactgtagcatcacattgtcaaatcatggcacaactaggttcaaaagatttgtctcgcaatttacatgcaaactgtgcaattgtttttttccacatttaatgccccatacatgtgaccaaacatttgatatgatgtttttggctaaattttttttgatctaaacaatgccttatcttttttccttgtgcaatccatcaatcaaagtgttgtacgcaaggagctgtaacaaatatagctgctgttgtaaaaacgctgatatgtctctttttcacttttttttttgactgaaaaaggtagagagactctaccttataactattgtattaatggtagtcaaggtgttacataaagagttacaaaaggctctttttcacttgaaaaatgaatctatatagaacgaattaattgtacactggaacactttttttttttaatcgccgactcgccgttatagcttagcgaggctgtgtacctcctgcagcatattatgtgcttcctcgtcaggcctctgtaatgatcatcggcatagcttgctcgctaaaatcgtgagctgaggagagagaagagagatggaggaaaggtggtagaggaagaactggtctaatgtagaatattttgtatgtatgctatgtgggtctcggtctctgactcagtctggatgatcgaagtcagctcgtcacgttagctaaaatcggaagcaatactgtcttgtaactgacccggatttataagattacagatgcgttgggtttaaggatgattttacaactcagacgacaagacgagggacttggagtgaaccttttccttcctggactgcaataggcctacaaattcctaacttgaaagcccagcccaatacgcgtccgttcccccttcgcaacccaacctctctctttcttcttcttcccccatcttcgttttgccgggaccgatccgacccacttccctccccccccgtccgtcctccgatccgatccgatcccgacaccaccgcctccggtggtagatctggatcggagccaccccgccgccggcgatccccggcatcctcgccacccatcggtagcccctccgccgccgcagccgacgacgacatggacgctgcccccgccg

SEQ ID NO: 12749 - DNA, 1501 bp, Oryza sativa
ggaattctgctgctgcagttttgcattgagcaattcagtgtgccaaacaaggcaacctttactgccatatgaataagcagtgcaagagcaattattcagacaaaccttcatgcattcatctgaactgtcaacatcctgcatgctttcagctttgtcaggcaagatgatatcagacatggagtagaacttatcagttgaatctgatgaactcgtgttgctacctacacaatccaactgattctttctcacacatccaccagtttgatcgccttgctcccaatccttcactgatccaacagtgaatcccttcatgcagctgcagagtggaagcaaactgaaactgcagaccgagaaagccccacatacaccgtacacatcacactgaaccttcggattggagtacagcgtcagccaagactgcgagctgtccagccaaacctgctgcttgttccggccatcgacgtcgatgaagttgcgtgtcaccacagcttcatttgacacattgaactggagatattcctctctgctgttgtcgaagaacccaaggtgaaagccaggtgaattgccgatcagctcagggatgccagtgaagtactgaccattccatggtccactggaccagtaggtgacagacgaattgcagagcttgagcacgagctgaggcgtgtcttcgtctacctcgaagcagtaggctccgggggacgggccggccatgctcttcttggagacgagacggcggttcaggccggtgagcttgtcgcggccgagcttcgcgccggggaggagcgtgtcggtcgggtggtcgacgctctgccacagcgtacgaggttgggacatgttcgaggtgtcttgcagtacgaggtttccactgttcagaaggacggctgcagtgttgttgctgttgctggtggagttcttggctgaaacgttggttgaccaggctattgacttggtggttgggtgtaaggcaaccaggtcgccgtcgtcgccggagatggtgagctccggcgagccggcgtcggcggcgtccatgattggctctccgccgttggctacccataccgtggtgcggttgggcaccgtgttgaaccatatgcccaggaaccatttctcttggtttggagccggggctttgaagaagccgagcgcgaacttgccgttgttggagacgaccttgtccttgccgccgacgacatggccaggcttgacggtgtccgtcgcggctgaacacgccggagcaccgccgccgaggaagacgacgatgagcacgaagaggttatacagaagaggaggcatgtggatcggatgtgcgtacgtggtacgtgccaacgtacgtatagtgaggtgcacgcgggagaagagacgaggggcattaagtagaggaggcgacggttacggttcgtgcgcggtgagcggtgtgagtttgaccgaaacataagtggtgataaacatgtactataagcggtggcgacggcgacggtcgccgacgtaagatcgccgg

SEQ ID NO: 12750 - DNA, 1501 bp, Oryza sativa
tgatatgatcacaaattgcttgattgattattactctgcatctgccgcaatacttatagtggggatgtcttacaaatcagaaacaaactctaacaaaccttggaagataaaatgacaaatcctaacaaactgataaaatgacaaatcctaacaaacttaatctaaccgaattcctattcgtattgcactgttactcgtcacgcgtgttgtcgccgatcaggattcctgtcacgacgccgggcatactgcaatccccacatcacattcttatttcccacataatcactaaaccctagccacctccaccaagccaccgtcccctgccgcctatcgtttgccgtaccgaggctctaccgtgaatcgcgtctagcctaccgttttagtcatagccatccgtctttccgttaactgttcgttcgaacgaagtgtcgtcccgtgctttgttcgttcggttgttttgaatcattccctagttgaaaccgttcagagccgccggttccgttcgccggtttcagttgatcatttggatggtcccgtgtcacgtagaattgactcgttgagtctcatgaggcttgcttaccaatgttatatttccgttgatcctattcctttttggcattaatatatgataaatgaataaggtttttcggttaatagtaataacacatttcatcttgtaaaattcatatataattcattcgagctccgttttaatccattcaaattgccgtaaattcgttaaaatgtctagaatccattaaaattggtttcttttgctgtttcagtagctttatagcttgtatttattgtgtgccttgtttgtcgtttagaatccagcagttccaatgctccagtttattttgaagtggttgccaaggttctgtcagctcaagagcaaggaaagtcatacgaatatcattgatcatattgtacccatttgcaaagtccctgcttttctcttaaaattgcattattttcataatgtcatgtgggatggaatttacccgtactcagccttttgaataccttaattgaattaatagcctgggatattaatttgactagatgattggtttagaaatgcttagccatgcttagatcaattagctcacaatgggattcattataatttagtccttaattattattattattatgatattataccaccatggtatataattaattaactaaaacatgttatattggtgggtcgtgggtgcatggttttgcaagtggcacccatgacaattaaggaccggttctcgggaatccctagaagataaactcgtactatccacaagcctgatgggctccgggtttgatctaagtataatcttttctagctaacacaccgttggcaagggtgggcatgatggagtatggatggaactgtatattggtctatgctgctttcggatttacctaggcacgagcggggactgcccatcgcctatatagggatggggtgaaaccggaggtggatgtgttggttagagga

SEQ ID NO: 12751 - DNA, 1501 bp, Oryza sativa
tttgtaggaagtttaatgtataattaatttttataatgtatggttgttagaggtagaaattaggagaagagacggaagggaagagggtcagacagggagggagggagagtatgtacatatatgtgcacgttctgtttttcttttcaaatatattacgtgataaatatgcgaacggaaagtggagcgtgtacagattttcattcttggagataagatgtagtggtgaaaattagtataatttaatgatttataaaatattgggtccacctgccacgtggcgatataagaacatttgtaggagcgccacgtggcggtttagaagcgtttatagaaaatttaatggactaatagatagctagatgctcttctcttatttcagcacattacactccactccaccacgtgctactatcttgatggggtttatatcatctcccatccaagtactaatgttctatggggtttatagggtctcccatcttagcactatctatcattacacaccatgcggagtgtaagaacttgataagatacaaagcgttgctcgccttgcaacaaggatatggttgacatgatttttatacagcacacatatgcatgtgagagtgattttagtccttatattatagccatatgtaaagggtcccgtttccagtcaatccccatctgtggacaccctaataagtgttggaaggtccgaaggtgatcagtttctccatcaactgcccctcccagtatctatcatcatccttatatatccgacttatagtttggtaaatctattttatgcaaggtgacagtttcatgaagcaaaataaggtttatgcaaaataattcaaatcatcaagatcaaaggttcgcttgcctgaattctcgtagttcaaatcaaaaatagctggcgctcccaactgaccagactccgcctctagttcccttgttgtattccgtcaaatgcgtcgagatttaattaaactatactaatagaaatacaataatttacaaatacaaatgtgcttacaaatttgtaacctttttattgtaccgaaactccagttgtgatgtgctagataatttatcaaactatacttggactacagaattgggtcactatgctcaggttggtgttctgtgtagcctactaatgtacatctagcaatcagtccacattttcctttcttctctattctctcacctgcagaaacctctccccgtctctcccctcttatcactcctgcaggtaaaagcatcagctagctaatccccttcttccttcctccatttgccattagcagtggatatcttttccctcaaatcctcactctactactctagtactgctgctgctaccaccatgttgctctcggcgacctcaatgcccaggctaccagcaagacctcccctcttaatccttctctctatgctctccaacccacagctccaagaagtggacccccccatggctagaatagggtcacgcatggagctctagacccagacgcca

SEQ ID NO: 12752 - DNA, 1501 bp, Oryza sativa
taggaaggtagcccgtgcattcgcgcgggcacatgtataatttgtgcagaaaaacaggtctaacaaattaagtttaaattaaaagcaagatgttctctttttttaattgaatgtcgtccattgtctcattgtctcctttttcttaagaaacctcaaagaaacttttactaacaaaatgtattttacttgtaacattcgagtcatcactttaattggttcataagcatgcaatttgttgtatgcattcatgtcaatgagtaaagacggaagaaatatacatatcttggacattgtttcttcatgatacgtaggacctgtacgatattttagagaaaaacatatagtccacttgggtcttaacatgtagatttaataggaacaatttaaactattttgagctagtggcgtgtatatatacaagatgtagagaaacctataaagctactacgtacaaggatatgagtttattgactcgatggatttattattagcttttgtctcttggcatttatcaaagcaaaatacgacttgtatatatgaagagaaacataaaataaagaagataagaaaaatataattagaacgtcaaatgaactttttctgtagctaagagagttaattcattaaatgttagcttgtggattaataagttccaggagtaacaccagtggagaaaccatctttgatcggtcagacggttggtaacaccaactggaactaaagatcccctttatatatgtcttcttcctccttcagcccgagcaagcttcaaaatttcttcaaaaaagaggggaggtcatgccaaaatttcttgtgaaatttttttggtgattatatataaattggaggtgtatagaaggttagtaacttcatcctccaatgttttttttgttgttatattactttgggagcaatgtttcacatattttttttgtctccaaaactttgttgtaagttgatgagagagaaaatttgtgtggggaagaagaatatataggaattttgtttgtttacttaagaaagttttattctcatagtttaaaatataatgaaaattaatcttaaaaaatagaaaacaaactaaattaaaaattaaaagaagtacaacattaatattagtttaaaacttcaaaaataataaataagaattgtttgttggattattttatattattgtatgaataatgatatgtcattattgtataactgttgaaagagtttttaactcatagtttaaaatataatgaaaattaatcttaaaaaatagaaaacaaactaaattgaaaattcaaagaagtacaacattaatattagtttaaaacttcaaaaataataaataagaattgtttgttggattattttataattattgtatgaataatgatatgtcattattttataactgttgaaagagtttttaattattttatcattattgtatgactgtcattattgtacgaaaatttatttatgtacgattttttttttcattttatgtaga

SEQ ID NO: 12753 - DNA, 1501 bp, Oryza sativa
ggcttgtgtaagcgcggtaattctattcttccagggtttcccccgaaccggtccttaattgccatgggtgcgactagcaaaaccatacacccagagctcgttgttaagccatattttagttagataattacgaccaataaaacatgaccatatgtctcgagctcatagctcatcaagatgctaatgcatatagtgtgattatcccataatgtgagctagtggtaattaaaaatggctaagcatataaagattctagcaagatcaacataagtgacacaagctagtcaaattatcacccaagcttgacaaaggagggatcacaagtaaacatggaacacgcgaggaaataggtagtcccataatcccatgtactcctaattagcaaaacgtgcaattttagttgcaaagagtaaaacatttgtaaattagcaaggagggctaccggtttgaggaagaactggggagtgaagctcattagctgcaaacttgagggggatcaatcaataaaacatcacgcaccaacagaaaagagaaggtgagaatttcccccatactaccaccacaaccacatcctctagtaaattaaacttaaaacaatccatcaccactgtgtagtttttccctagcaccttagttcagcttttaatagaaaagaaggagcggtagcaggctagcagcagataaaatggaggaggaaagaataggagcacttacctaggggatgattgctcggtgaagtcgagctccatggggcgctggtcatggcgtctgggtctagagctccatgcgtgaccctattctagccatgggggggtccacttcttggagctgtgggttggagagcatagagagaaggattaagaggggaggtcttgctggtagcctgggcattgaggtcgccgagagcaacatggtggtagcagcagcagtactagagtagtagagtgaggatttgagggaaaagatatccactgctaatggcaaatggaggaaggaagaaggggattagctagctgatgcttttacctgcaggagtgataagaggggagagacggggagaggtttctgcaggtgagagaatagagaagaaaggaaaatgtggactgattgctagatgtacattagtaggctacacagaacaccaacctgagcatagtgacccaattctgtagtccaagtatagtttgataaattatctagcacatcacaactggagtttcggtacaataaaaaggttacaaatttgtaagcacatttgtatttgtaaattattgtatttctattagtatagtttaattaaatctcgacgcatttgacggaatacaacaagggaactagaggcggagtctggtcagttgggagcgccagctatttttgatttgaactacgagaattcaggcaagcgaacctttgatcttgatgatttgaattattttgcataaaccttattttgcttcatgaaactgtcaccttgcataaaatagatttaccaaactataag

SEQ ID NO: 12754 - DNA, 1501 bp, Oryza sativa
cctcggattcgtttggaaacctctcccctaacctcgccggcgccatcaatggcgaccggatcttccgcgcccgtttccccctcatccggccgttctctccccctcccaacactatataaacactccccgtgcctccctccaccgtttccgccactcgccgctctctctccccgtcggaatcgagctcgcgccgtcgttctctctctccgccgtcgccgccgagctccggtccgccgccgtcgtcgccccggaccctctcccgtttcggcgtcgccttcttcgggttcaccgcaacctcgccgacctcgtccacccctccgtttcgcccgccgaccgccggaactccgccgtcctcgtcgacccgagccgcgccgccgccttcctccgctccggtcgccgttcccgtcgtcgccgtcgacccggggtgagccgtggaccgccgtttcacttcccccttccctcccctctctcgggcgctgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccagtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatagagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattattaccttgttcaccctagaataaacaaaaccccaactagtggaccctctactcatggtacccctagtataattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggt

SEQ ID NO: 12755 - DNA, 1501 bp, Oryza sativa
aagaatccgcgaccaactatgcttaggttcagggcttccatctgttgactaagttcgagtggaatgccacggacattaagagtgttgcaatggctttttcgacttagagcgtcggcaaccacgttggccttaccaggatgatagtaaattcccacatcataatccttgatgagttctaaccatctcctttgccgaagattcaggtccgactgagtgaagatgtatttcaaactcttatgatcggtatatatttcacagcgattcccaatgagatagtgccgccagatttttagagcatgaaccaccgcagctaactccaaatcatgggtggggtagttgccttcatgaggccgtagctggcgtgaggcataggccaccacatgaccatcctgcatgagcacgcaccccaatccttggcgcgaagcgtcacaatacaccatgaaatccttgcgagtatccggcaagattaacactagcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactctcttgggttgcttccaatcggtaacggcggtcactgtttcggggtccacagcaactcctttagcagatatcacgtgccctaagaatttgacttcggacaaccagaactcacacttgctaagtttggcatacaattgatgttcccgcaactttcccaataccagacggagatggtgctgatggtcttcctcggattgtgagtatatcagaatgtcatcaatgaaaaccacaacaaacttatccaagtattccatgaacactttgttcattaagttcatgaaaaaggcaggtgcattggttaaaccgaatgacatcaccgtgaattcatacagtccgtatcgcgtggtgaatgcggtcttcggaatatcttcttccctaatgcgcaactggtgatatccggaacgaagatcaatcttggagaatacagtggcacctttaagctgatcgaacagatcatcgatccggggaagagggtacttgttcttgatggtgacttcattgagagctctgtagtcaacgcacatcctcttcgtcttgtctttcttctccacaaaaatcacaggagcaccccagggggaagtactcggacgtatataccccttttctttcaactcttccaactatttcttgacttcggccaattcatttgctgccatacggtagggtcgcttgtacagaggagtggttcctggagcaagatctatccggaactcaatctctcgcttgggcggcataccgggtagttcttccggaaacacgtctccgaactctctgacgatggggatttctgacagtcctatctgatggagttctgaactactgacagaggttgggggtgcaaagaaaacaa

SEQ ID NO: 12756 - DNA, 1501 bp, Oryza sativa
actttgttttctctaagagagtagagacattttctaggggcattagattgtgcaaaaatatcttgtagaaacatttttcaaatactacagaagcatttttcaaatgtctttacaatactatggtggtattttcaaaaatgcctcattagtgccatctagtgagtttgttatacaaatgaagacatttatgtattgcagcattttttatagaaactggcatttatgtattgcagcattttttatagaaactttttttctcaaagagagtatagatattttctaggggcattagattgtgtgacaaacatagcaaaccactgtgaaaaaataagtgaaaactttatgattccttgctactttaaatcctagaactcgaaacctcttgagaagttcattcttatcttcaatgcactaaccatctcaacctcatgtggctacatgtttaatatatgccttgtgttgcttatatctagatgttttgcacatattaatgtgtgttgcttatatctagatgtttttcacatattaatgtcctaaaaagtgcctctacatatgttagaatctcacaagaaaatgactttacatttgaggcaaatgttggcccaaaaccgggagacattgacccaaccgggagaaagccttgctacacccttgctacaccccaaaagctagctcaagaggtgaggggctccccccacttttaagttggttcaactccccctagataagtaatgtgggactattcccaacaatctctcccgtcacacgttggtgccccttagccctgaccggcctcacacacaggcacatacgggttacattggtgccccttagccctgaccggcctcacacacgggcacatacgggcctcacacccgcggtccactgaccgaccccacacacgggcacatacaggcctcacacccgcggtccactgggctttgggtttacaccaccctgatagtgcacaagcactagagattgtgggtttggctctgataccacttgttggcccaaaaccgggagacgttggcccaactgggagaaagccttgctacaccccaaaagctagctcaagagatgaggggctcccctcacttttaagttggttcaactccccctagataagcaatgtgggactattcccaacagcaaattcttaattgcctatacaaatatacaatgccgctggaagatgcaaattttaaagtgtctctagactatatagctctaaatgttaaaggcaaattgtaaattgtatcttgaaaagtgtcaatatataaggtttttgttgtagtgtatacatgtgctcaactcaacttttttttttaaaaaaaaagaggtcagcaaggtgatgaaaatgtcagctctcatatgtggattccctgaaactagtgaccataaacttttttgattgcctggtatagtgtgatggacatatgtgtagagaggttgttcatcgcgtcgagcgagtttttgctaaagtggaggatatataacg

SEQ ID NO: 12757 - DNA, 1501 bp, Oryza sativa
ctattgtggagtaaacaagtgggatatacatatactgtgttcataatttttttttgaaacactgttcataatttgattaaacatagaaaggagcatctggtgcatttatttatagctgcttcatcctgtcacaaatacgtgttttttccatttaagacgatcacttctaatggtattatcattatgtgaatttttaacgatgtgaccagaaattaataaagtgagggggtgaaatatgttttatttagtcaaaactatgtatacactgtttcaatattgtttgtgcttgcatgtttacctatgaaaaaaaataaaactacgtacaagctatttcaattattatttaaatatcttattgtttatgtgacatccttataaacataaaaatgacatctcttacttaaaaatggaaagtcaatgctccctccatcaacatttatttgtattcgtggcgtttaaaattcctacacaaatgtaaacatttttcttgactactccaccttccaagttccaacgaaccatcattaattaatttatcttccaactacatgcttaagctcctaatcttgtccaatcaggaattgatacgcgctgagttcatgaaagtattttcctatcacgcataatatgtccttacatatattataaatgctagctatacaaggacaaattgacccttttcaaaaacttatttcgaaactaacccctgccaaaaacttcaaccaaaattaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccacgttctcctcgtccaatctcccccaaaaacctctctaatcgaaggtgatttgtgcggcattgagtttgggatcggaagagaaggtaaacccctctataaaccctaagttccccaaagttttattggatattttgcattgttttagttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagc

SEQ ID NO: 12758 - DNA, 1501 bp, Oryza sativa
aagatatgccacctccacacttcatccccacccatattatccatctaataatccatccttagccaactattatcaaaccacgtctacaactaaaacaatgcaaaatatccaataaaactttggggaacttagggtttatagaggggtttaccttctcttccgatcccaaactcaatgccgcacaaatcaccttcgattagagaggtttttgggggagattggacgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaacgccacgaatacaaataaatgttgatggagggagcattgactttccatttttaagtaagagatgtcatttttatgtttataaggatgtcacataaacaataagatatttaaataataattgaaatagcttgtacgtagttttattttttttcataggtaaacatgcaagcacaaacaatattgaaacagtgtatacatagttttgactaaataaaacatatttcaccccctcactttattaatttctggtcacatcgttaaaaattcacataatgataataccattagaagtgatcgtcttaaatggaaaaaacacgtatttgtgacaggatgaagcagctataaataaatgcaccagatgctcctttctatgtttaatcaaattatgaacagtgtttcaaaaaaaaattatgaacacagtatatgtatatcccacttgtttactccacaatagttgattttttacagggacatggacagttggacacatgtgggacaacaatgctttgaaagttgatagggaagttcgaactaactctggtcatcccaagcagtaaatggtgcaccctatctatctatcgacagactaatagttccatgccatttgctcaataattacatatgctatttttttcgttaagtacttatacgtgcattacttttctgtgattaagtgtaagtttcaatttgaggaattaaataacttttctatgt

SEQ ID NO: 12759 - DNA, 1501 bp, Oryza sativa
tactaatcttgaagctatggtgacctttaagaaagagaatgaaaggttaggaaccttggtaagtatgggtgcatgaaaacttatgaatccaaataggcactctacaagactatcaccactcgcaacaagaagtttggacatggtcttggcttttgtccccatgaaagtcgaccatgcaagtgccgttgtgaatggcaaacaatgcttgacgttcggcaaggaagggactgctacacatgcgaaagaagaggttttgtccaagttagaccaggggcccggaggtttcatgattttcgctaggaacttccgtgagagctcctctaatcggtcttaggggatgaccagaagtttcaggccaggggccaaaaacttttgggcaggaggactgtaaaagtggtaaagtagttgcttaattgaatggcggtcacagtgatagtacatgacatgagtatgtaatactgttgtttgctaacaatgagtcaagttggtgataacttgtgctcggatatggtttcttggttgatgcatgtcagggttatagatactacatacccaatagtaatcgactaagctcagtggggcccacaatgtaccaagtcttgtacggaatcaacaggaggactataaagtggtaaagtggttgcttaattgaatggcggtcacaatgatgagtacatgacatgcgtatgtaatactgttttttgctaacaatgagtcaagttggtaagaacttgtgctctgatatggtttcttggttgatgcatgtcagggttatggataccatatacccaatagtaatcgactaagctcggtggggcccaccatgtaccaagtcttatacggaatcatacctcatatatagaaggagttccggataaggaaggacgagtagagttctatatggaaattacaaggactactcggattgcatcaatattggtctccctagttctacttggacaaggggacatctatgggtataaatacaagaccccctaggagagggaagacacacaacatacaagataaaccaagaccaagatcaacacacgccgccagacatcgatatcagagattagcctagacaaacccaatatggtgcctgcagaggctgataagagggatctagcgctatctttgatgtcgacgagtttatattcgaggaggcagactatcctgtcgtcgactacgtgttggttatctatgccaccaagtcaacgacgactagatacgttatcccaaatattgtacttgtgtgattttgatgagtatagaggaacaccggcttcgcccaacagaagtaatgctattacctataaaaaggggtccgaacctgtataaaatccttctccatctcttttaactcaatctcgtatataccctggtaccaatgatccccataccatgcaaataatctagtcgtgacctcaaacatcgacagtggcgtgccaggtaggggattttggtgcttcaaggttttcgatgggatgggttcaagaga

SEQ ID NO: 12760 - DNA, 1501 bp, Oryza sativa
cccactatttttaaattttattatttgactgacatgtgggcctatatattttgttttattttttaaattattaaattttgtttcatgtgccatgttaatgccacgtcagatgaagatcgagtcaaattggccacgtaatctaaaaccgctatgggacctatattgtaccggttttaatagttgagagaattatttatctggtttttcggttgaatgatgaaaatcggattcgttgacaagttaaggtatcttagatgaacttattccatttgaggaacaacggttgaacttcacggcccatataaaatagttataaaatcacagtagttcaggccaattggatcggaattggattttgttttgttaatttgcagtaagtatcagtagaatttgatcatgttctgctaaaagtaaaaggaatttgatgaaaaaacaaattctgaccatgttgacaaaacaatacttatagtcgatgccggatgcagagctacagtatgatccttgtgatgcatgtaccaccatagaatggaccaaggcccattacctgcatacactactaaaaaaacatcgatgcttcgttgtttcgccgcatgacagcgtctacttgaattctgccttcccacgcacgtcttttgtgaaacgacggcggcaaccggcggtggcgatttgaagcagaatcaaacaccggcagcaaggacgaatctacaatgctaacattggtgtcaggcgatgccgatgactttcagcaaaacttataattaaactgcttatccatataacactatattctaagtatatataattagtatgctatgacatcaatagacatattatgaccgctgcctgtaggcaacatgttctcatctcctcccaccctcgaggttcaatttcattttgatactggatttcctattagaatggtaaatttaaagatatttggttcattttattatactatagatgtaatatgccaacgtacaagtgtagaatttacgaaacgcaatctgatcaaataaaaaaacgttggcacattaaatctatagtgttcttaaaaattgttgagctgggccacctagcctgaaatcctggatatgccactggccaatgggagtaactagctagctattcgaactgaaccataaataattcaatccatacaaaaacaattatgaactgtgtcattgttttggcaaaaatattgtcaccctctgatatgccttgcagtccaccagaacttgagcccttgaggtgctactgttggggggaagatagggggacctccccctaaccgactggctaaactctatcggtgtggagcctcctaaaagcactgtggccttccttccactcaacctggggaagatgaaggatgcgggctataagatatagcccctccgtagaataagaggaggacctccgataccttacatggtccacaggtgcagcacaatctgttcattcactaagctgcacgaactgaataacaatggagtacatggtt

SEQ ID NO: 12761 - DNA, 1501 bp, Oryza sativa
gcgtcacaccgctagcgggaccccaccggattttcgaccatcaccggcgaggcggaccggatctggagaaaaggcgtggctccgtggagatgcagggacaccgccggcgaggacgggtttcctgtcctccctagcgccggtagcccctccggcctccccgtctcgtctgcgcttgccggtgtggagagatgagagagcgtcggtagagagagagaagatagaggttaggagaaagaggtggaggaagtgggacccactgacatgtggatcccactatttttttttgactgacatgagcctcaaatattgtttttaattttttggttttcaattttttattttttattttcttgggatcaaactgccacgtaagtgccacgttaatgccacgtaggacaaatgccgagtcaaacgatccacgtaagtgccacgtcagtcaaaaccggggtcaaatactgccgtggacctcgtttgtactggttttgtaagttggaggatgcgttgtatccggttctccggattgaggatgaaattcaggctgggcgataaattgagggacctaaagttaacttagtccctcctcaatttggtgtaatgggcttgaatgatccaggccttttcccaaagagataataaataacagtcatcttaaagtattttacaactattttctatgaggcaaaaaaatatatattaccaaaaaaaaacaagcactacaacccttaatgaatcgatcttagttgacactagaaaatcaaaatctcatatacttgttaggctgtcatgcactggcgatgcacccgtaatggcagtgccactccccactaactaaaccttgtagcacacacgtatgtagcaaattgattagcaaaaaagaaaaggattcaggtcctaacataatgagattatcaaacatgaaagtagctggacaagtggccaaacttgtcatatatcaagcagaaattaaaccccaattccactaattaatcggacaccactcagcagctaaatcaaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaac

SEQ ID NO: 12762 - DNA, 1501 bp, Oryza sativa
ggagatgttgttactcgagacgcggaggacacgcagcgacgcgcacgcgttcctcccgaggccgggcgggatggcgccggtgaggtggttccacgacacgtcgagcacttcgagcccggcgatggcgccgattccctccggtatcgcgccggcgaggccgttgtacgacaggttgagcgtcgtgaggcccgcgcagccggacagcgacggcgggatggcgccggtgaagcggttgccggacaggtcgaggacggccagcgtcgcggggagcgacacgccggagatgtcgccggacatgttgttgccggacacgtcgaacgaccggatattgctcgccaggagcatcccgggaagctcgccggtgaggttgttcctcgcgaggctgacatcggtgaggttggggtaacacgccagaaagccgtcgggaagccggccggcgaggccgccatcggagaggtcgagctgcagcagcgcgcgcgggagcttaaccaggtcaccggcatcaacgtgcagctcgccattgccggagaggttcaacctgcacaacgtgtcgagaccagagagggcggcaagctcggcgcgcccggcgaggccgccggcggcgaggtcgagctccgtcaccctgccgtcgccgttgcacgtcacgccacgccagcgacatggaccaggatccacccacgacgagaggactcctctaggatccttgtggacgaacgccttgaagcggaggagcgccgccgcatcggtttccgccgccgccgccgacgacgacacgtagatcgaggagaggagaagtgggatgagaatgtccatttggcatgtggatgcaatgttgggacaatgaggatggatggatggagaagaaaagagtgacagagggtgagtgagagcaagtgttgtgttggtcactcttgatgatgatcagtggtttacaaagaaagattatggcttatggtgtgtaatcctctgcttttgagagataaagatggctttttctcttctttttttttttgaagtggtgtttataaaacatcaccagttaagggtgctttggtacacttttgtgtttgtgagttggattgatactgccttggacaactatcagtgtaggtgggttttataggggattttggtccaggaaacattcctttggattacttttcaaatcaaaggaagaagagctggcccaaatgtagtttgccaaaattttagcctgaagttgcctttttttcttctttactgtatttgctactcctgtacaaaagtttttttttaagtcttttctcctaatatgaaacggcagaactcctgctcgcctcctcgaaaaaaagtttttttattcagtttatgtggaaaatgaattgttttcagtgaaattcctaagcgccaaagtagccatcaggggtttccttgccttcatacaatgatcatataagcaggggaaaagtacgaattaccccctcccccggcccgaactatcgcggtcatccgaattaccccc

SEQ ID NO: 12763 - DNA, 524 bp, Oryza sativa
agatgcagcagccaatatgttcagttgtggaacttgtttgcaaatcctcctagactagcgacttctgagtttatgataaaattgactttgatgggctttatctggcatcaaacagttggtttattttcatatttaattgtcaactttaagttagaaatttcatctggctgttgcatgatttgttttgcttattaatttttttctgtgaaagaatgttattgaatatgttcagcttactgtcagcaccgaaatgtgaccatgtcttgagatatctgttttagttctctttttcatgtgatattaatgacaaatcagtaccttagcgtaacaaaattgcaatgttgtgttcagtcttgaaatgatgagcacatcaattttggtacactaattttgtgttttgctttcagggaggttgaataagtgcctgtcctgcccttctctacttgatttggatgcagtacattctactgtaccaagaataatgccttgggacttcccatgtaaattatcagaaacaatataca

SEQ ID NO: 12764 - DNA, 1501 bp, Oryza sativa
ttcgccatgcggaaatttggagcgagagtatctctcgacttgtggagagcgagaaaggaggagaagaggattctaattttttgatacatctctaggggagttgttgagtaagcttttcacaaaataaacctcaattttagaattgggtttcatttagggatattgttggtcatgaactaagagaagcacattttgtgcgcagcggaagtttgttctccattttcgttaaatttgaaatgtgccataagtaatatactcccttcgtcaaaatttttttaaaaaaagctttatcgatttgtctcgcaaaaatgtatttttaagttagagcatcttcatcccactttaaaagacaaaaattagcacttgtggataaaaaaaatcgcattcatatagtctctccatcacactctccaaactattcggccggccaaactccttaactcgtcaaacttggccaacttactccacttacaatccacacaccttctgtgggtcccactacctcatattcactttcttcctccattcgagagcaatgttaaaggttgcaactcgggaaggtgagcggcggaaccggcaccgtcgagagcgcctctctctcgactctgtcacagtggcctctcccttgactccgtagccacagcctccacgtgcctcctcaccgccgtggcctcccgctcattgtcgccccaatgatgctgccatagcacgggcgacgacctccctttcttcggcgtcagccacccctacctcgcactcaaggatcctccaccaccatccaccttcgcacggacatcatcgctgcggagagggagtgggccgggaggagctctgggatggccccagtgagagaagagggagagagggagaaagaggagaaagaggggggagagggtagaggctaacatatgggtcttaggccctgttctattcttcaactccaaactacaatttcgtcgtttttctttcaactagttaaatggtgtgttttttaaaaaagttgctaaaaaaataaatctattttttttaatttataatagttaatacttaattaatcatatgctaatgaggtttctcgttttgcgtgtatcaacaatctatctctaaaatggaagatcgaacaaggccttagtgtcataaattcagagtagagaaagtagaggaacagtttgttggagtgagcaacaagtttggcttgcgaaaccaattatagagctagctatatgggtgtttggagagttttatttgggaagtctaattggagaaagactaccgcgaaataagccctcaatccctttgagggcgggattaaccgaacaaaattcaagaaagaagttaagccatataagaagcacaatgggtggcttcggagatcgcaagcctaagtgcaaggtcattgctaatgcatggtttcgcggcaaatttagtttttttactgacaagatgaaaaatattatcatgtggtgatgaccctactataagtcagctataaactcatatc

SEQ ID NO: 12765 - DNA, 1501 bp, Oryza sativa
cataaatctagcttccccaaattgatccttagttctctcttgtgcatgctgaatttacaactggaatatttccttcctgtactttttcgatccatcgagccgacaaagaaaacaagaatcatgcaggaatttctctcaggtcaacgagaagatgaaaaattcagtaagttctgatgttcttgtacataagattaagtaagttcagaccacttgagctttgcttatggtacacaagatgaaaaatgcagtaagttcatgtacatctcagattactggagctagcttatggtacacagaaagatgaaaaattcagagagagaactcctttggatcttccaacgaacaaaaagagaaagagatgaagagctacagcacgagctgaattagcatcagcaataatccagcaccatggccaaaagccatctgagtttccgactagatcaaccaagaaaagcacccacatataccttcttcagactttctcagagcacgaagaccatgttgtcgttgagcccggagaatcggctgagcatgtcggcggaggcgcgccgccgcggccgcgtcatgctccggtggaacccctggagctgcttgaggaggagcacgatccgccggcacgggacgaagaagagggtgagcgggatgagccacacgcccagctccaccaccagcatggcagccaccctaagctccctcgagctcactcaaactgaaactgaaactgatggcactgcagctgttttgggttctggagtgtgctttcctctcgcttaattatgcttcactttgcttatatagttagataactaactagatagatgtcgctaaagcctttactctacctcgtgtttgacaaattgacagcatcagcagagattcaatcagggctatctgctggacccatttttactaacggttcttggaagaaactggagaacacagattcagagagttttttttaacagagccacagattcggagatttgctctaatggttttcttttacccagtggctttcatcctacatggatatgcttcgtgcttgtccatggtggtagtgagcttcagtgaacaagctatctttcggttgagacggacagaaacatctcgatctgatgcgtacgccatcagctgctgtcgtcttgtcgcatttgctaaaaaaaatattatgatcaagcatttcagcatgtggggtttccaaccacttgatatgagatcagaaatttgtgagtgccgttgagtgtcaacagctagtgtggctcttcacagtttttgggtagccctgacataacctccggtgtcttttctgttcgttttaaccattttactgattcggtaaccctgtaatcttgcattaaccctaataagtgtttctgtcatttcgtcctgattataaaccgtaacgcttatcagtgaaaaaaaaatgtatttttataaatatgttttagtgacttaaaaaccaacaacagaaaataaactacgatgaaaaaccatcgaaatc

SEQ ID NO: 12766 - DNA, 1501 bp, Oryza sativa
caaagcgataattttatacataggagattaagcaaaagtaaatccaacggttggattccagcctcgaataggtaatgcatgtttggctgcatgattaatataacagcaaagctttgatcaaagcaacaaataataagactgaatcttttaagttgagaatttaaacttgatgcgcatgtatataatagggatcttgttagtttgatagattatataaatcttgcagctaataagtataccctgaaatttctttatctaagtaccctaaatttttggactgaaagcaaagcagaagcagtaagcacacggccatcgtctatagattatgataggaaagacttaaagtgagaaatgaatgaaagagaattaaagacgcgctagtcccaagtcccaacctatcttaagatatatacatgattccaaactagcaaactaaactgatcgatcagtaaacaggtcgctgctaaagcgatataatatacgtatacgagtagagctagagaagaagtaatgaagtgaatgagaaggtgatcgacctgtggcctgagagagagaagaggcgtgccgtggccatccatgagcagcaggtcgccggcgaaagctttgcggcggcgggagtagttgtcgacacggaaggcgagcttgccggcggagtcgtagacggagaagccgtcggtgccctgaaagcctatgctggacctcttccacaccgtgtacaccaccggctgatctgccgcctgacgacgtgcacggccgccggtgccgccgccgccgccatgtgaggggtgtatctgtatccttctcatgctagctatagcttgatgaggctggtggaagtaactaagctagtttgagagggagggaggaagctataggctatagcttatgttagctaggggaagctagcaaataatcaagatttggttttgccaattagatggctaatcgatcgatcaatcgatgagcaacgcaacgtatggacgtacgtggctgcctagctttgcctgcactgcagtctgcagattgggttaattattaatgcgtgagagtgagagcagctgaaatgggccggcgaaaaaaaaggacatgcagcttaattttgcaagtaggaacgaatgggagtgaaggtgtggacagatagtgcagggcacgttggattgggatttggcttagcgtgaaggagctggcatgcatgcatcgccctactacttattcaaagcacaagcaggctgaccaattcagatagagaaagtgacaacaattaatgggcctgatttgaatagtacgtagtatttctgatgggcttgcctggcttctaccgtgggaggggagcccatcaagatcattgacttgacttgacccggcccctcagttccacaaccattgacaattaattagacccaacgcaactcagctgcttctctgctgcttcctcttctccctctccatcgccgtcgccgtccaagaagaggggaaaaggagatggatccggtcgcgggaa

SEQ ID NO: 12767 - DNA, 1501 bp, Oryza sativa
cttgagtttatatgtattttcacataaacttctctgtactgttaaaattgagtatcaaagtctcacaggcttattctttaacctgactggcgtgtttcatacgaatacataaatgacggaacaaaggtatcacaggtgtgtttcatatggagagatgaatggcaaaacaaggtatgtaaagttataattttcttcactggtcatgaaacacaggtattttgcttgcaatagataaattccattaaaccaggaaaacataaaattaactgtctcttaatcattatgatcttcgataacccgcaaactagcctcaacatagtatacacatgaaacccactcatttaatgattatttgcacctatagatttctaaataatcacgaccattattattttattattttttcctaagaaaaaactccttaggcagtgggaaactttcatttttcaccaaaatgatgatatgtataggcacgcctatttcgcgggaaggatatgctaaattgctacacgcgcgccaaggttgcccgcccaaattagttttccctccttttggtgcattttactctccaacccactgattctttatttttcacatatattcctcagtggtccagcagagctgccttgctcctcgctagttgttgtacaaaggaataaaattagcaaatgagacattctatggggtgttttgtgaaatctttgttttattttaatagaggggattgttttggcggcgggaggcctcatcccaatcccggttggtgccacccaaaccaatctcgtgccccaatccagagccgccgcgaggtatttcctttcttccattttcttaaccatttctacttctcaatctttctctcacgcagatccaaaatgctcctcttctttctatggatttttttatggttttcacatgttagggttctagtgagctttatctctttttttcatgtgatttttcggcttttctcacttcttaaagccctaaatctacttcttttaccatgtgattctaatttctaggtgcgccaacaaggaactcttatccggtttgctccccatctcatgtattgggttggactggaagatccatccgggcttggattgatttcttcttttgttggtaaggaaccctgttttgcttaattagatatctgttgtagtcttgtcccctttgtttgtggtgtgagggatcaaatccaaacttcttagcgcaccacgtcgccgtcaagcgagcgctcgggtaaggtttatggtgttattcagcggcggcatgcgcaagccaagacacccaatagggctacaatagatcttgatgtagagaccacacgtatttgacatttggatctctggattagtaccattataatactagcaactttgagtatttcactgtggtgttcagttagggcgtgtacgtgtttggttcccagcagatttgcctgctcttgcagaagccatggatggggtcaccactcaccagtaccaccatccctcct

SEQ ID NO: 12768 - DNA, 1501 bp, Oryza sativa
aaatagcgaaagaatgttccagttcactgcaacatttgatccatacatagtgaaacactataagtacactaggtgaaacatttttggtagaacaaaaaaaataaagcgaattctcttgatagagggtttctaaaatatgtgggtaatttcttgcaaaagaatgttttaattcactgcaacattaagtctatacatagtgaaacattgtgagtacactaggtgaaacattttttgtggagtatgtagtgggaacacgtggcagtgttgcaggggagacgtggtggggcccaaggggagcatgtgcgcacgtggtggttgggggggagcgtccgattttctccccctcccccgggcgaccgaggcgagatcttattgtaaagatttaattgaaacgaatacaccgaaataaatggatcatagactgaatgagtagttttggagaaaaatgattttaaagattacaacttacatatgcatatatacttgcacaaaagttatgcgtatatgtatcctgagttcctgacatgacaaagagatgaggaggcattagcatgatgaggcgtccaaagtttcttccgtgatcggacgctagatgggaagtatttccggcattctcgaactatcgtaccagtttcaacccgtgggagagggttggccgccagctccgatgctagcgcgtatgcgccagatagcagcgcccgatattttctttccggggcgtgggcggaatcattcaatcatcgatttcttccccaaacctagcctcctccactgctcccaacctgccttccgtcgccgccgcctaccctcgactactgatctacctttctccgtcggcggccgcgggtgcccagcgcaaccgcaccctctcctctccagcagcggcgacccctcgcctcataccctttcctgggcaaggccgggaggggatcaatctagggtttccgccgccgccggttccccggacgttgctgcatgacgatggaagatggaagctgtccttcaccagtcacccccagcgaagccgaagctggagccgaagattacgaatcttggacactgaagcagaagattgaggatctcgtcaactgtgatcctatccatggtatcgtgccaaaaaatcctaaatataaagcatatttcgaggaaaagttccaggtacgtacgtacatattttcttcgatccatcatccatggatgcaaaactaattaattaattttgacctcaccagctagcatatattttttttattgtatgcaatcgatcgatgaatcaagtggtatcatatctattgctattgtaggagaagttaagtaagtacgtccgtgttgtattgccgaaacttcgtccagcaattcagaaggatagcgtcaagcaattctttcaagtctacaattgttggtcaggtttcatgggacggggaaacttccttttacctgatatcctcaccaacatggccaacgagaacgctctgcgttgtgccagggtcgcactccaggg

SEQ ID NO: 12769 - DNA, 1501 bp, Oryza sativa
gccactaaagctaagcatatatcttataaatagaaaactgcatcacgattcatgtgtgaagcacatagcaaatttcatttcaggttccactctcaaaacaatcgtattaagataacttggttgctacacggttgcactggacctgcacacagaaaggagctaataccctggactgccataattgtctgtttgtgctactaattgtaatgttccggtcattctcttgtcgcgattgtgacgttgatgcttcgttgactttgttgctatatgatgaactaattatggttttggacattttgttgctagtgacagagcagagattcttgcctaaggttcgatgaattggaacctgtgcgatgtgctactaatagtgaagtgaagtgaaagagatggcatgaactgggaaggtaaagaagaccccgaaccgagtacctggacgatgcccaagaaggagctggaccagccgtactgcgcggcgaacgggacgacggcgacggacatgacgacccggtcggcgttgcagagcagcatcacggccgccaccagcgccaccaccttggcccgctccggcaacgccgacgccgacgccgccggcacgctggccacggcggcggcgccgtgccggaccccctccatgccggcgctgcacatggcggcgacggcccgctcccgctgcccgcccctcctcccccaccaaccatcgccaaccgaaccaacgacaccgctgcccctgccgctgctactggcgcacccggcatccctgcacccatcaccaccacctgcggccaaggacgaggaagacgaagagcaagatatcctcaggcctttcgggtccaacccggccgccccgaccctcgcggatttgtacttgaccgggctcaccgccgccgccggcttcaccgacacgcacgacctgattgacgccatgggccccccccccccccccccccccgcgccccggcgagacaaacccgatccaccaaccaaccaatggccagcaactcggtagcgagaggcgagggggatcagaggcggcggcccatggcaatgggaaagagagctaaccaatcgaccatgtgcgtgcgtgcgtgtgatcgcccggtggatgggttggtataaattaggactcggcgaggacgaacgacgacggtgaggagctggaccgtggggggaaggtggtggcggtaggtggcggatgagagagcagcgagccacagcccagccagctacggggagaaagtgaggttggttcgtcaagtgtaagcaagtaagcgtagcacgagtagatttaaaacgagggctcgtgttggtgggatttggaaagggtcaaggattgcggggacgcgcgatcggtagccgagccgcgccgagtcgcgccacctacctcgcgcggccgaggccgaacgaagagcgagcgagcgagcgagaccgccgtctcgttcgttcggcgtgaccgtggtgagaaactgagaatgtaagaccggccaggtggtggactggt

SEQ ID NO: 12770 - DNA, 1501 bp, Oryza sativa
gcaggccggcggtgaagtcgtggacgcccaacagcggcggcataatagaccagccgtgtaggcagaggcaccaatcggcggcgacggaggcaggccggcggtgaagtcgtagacgcccaacagcggcggcataatagaccagccgtgtaggcggaggcaccactcggcggcgacggaggcaggccggcggtgaagaggatgtcgccatcagcaacggcgacggtgcacaccaaccgtggaggcgtgtaatccaatcggcagcgacgagggcggccggcggtacgtgcgttaaaacaatagatcaaataataattagtgatctgttaattaatctatttcacataagaaaatttaaaacgataaacctgatagtagtttatcttgatgcacgtatgttgtcccacggccggttttggagtgcgcagcggtggcccaattcatgcacgatcaggagcacacatgtgtagatcattacttcctggttgattgctatgccacgtgtagttgctaatgacgctgtctctgtgtccatgtcgattccgctttgaactagtaattcaatcttgccagataatttgatatcagtcggcaagaggcgttggcagctgggaaccgatctgcatcgctgagtagattgatacagatgatgactgcggcagtacggcaacctttttgacgaaactgatgaatacaacggcgaccaaacgagatcgacatggtcttgtatgtggcaagaaccaaagcgataaagcaggaaacatgtacggttagattgatataagaccgatcaaaacatgtgtggctctccggtgtatgctgttcaatcatattcatgcatgtatctccacggctgatcttgagaaaagaaaaaactccatagctgtccagtcttgtatctcgctgttgattgctatgccacgtatgatctcttagccgactaattggggctggtcggattttcggcggcagcgatgaagtccagaaagatcctggggaagacagaagtgaagctggtggcagccatagtagattgaatctctctgtagattgatttgatcggcgggtggtgtcgacggcggcggatctcacgatacagaagcgaagataataccggcgactcgtggagttgattccatcgcactcgtcgatagaaaactcgacgcaacccctacctggcgcgccaactgtcgaaacatgaattcggcaataatgaaacggggtagcgcacgagacctaaaagtggatggatgtggagacaaaggatttagacaggttcaggccctctcaatgagaggtaataccctactcctgtttagggatttgaatccgccgagtgtgtattgatctgacgatcaggttgtctcatatatgccccctagagggcctcctgcccaccttatataggatggggggcaggattacaagatagaaaccttaaccaatacggtatcggtttcctagatcaggactttaggccgttccgtaatatacaaggaaacgt

SEQ ID NO: 12771 - DNA, 1501 bp, Oryza sativa
acactgcacatcgcctgctaagatgactccatgaccacctcgccgctgcagccgccacaacgccggctccgacgaccacctcgtcaccatggccggcaccatcgcgcctgtcaccacctcgcagccaaggctgcccacacaccagccgccgccgctacctcgtgaccgcggccaccaccaggccaccgccgcgcccaccaccagcagcaccaggccactgccgcgcccgccaccactgcacccaacacaacctcgccgcaacgaaccacttgccgccaccgccgccgccgccacctccgcctcaaacggatcagacgccgccgcctcaaatggatcagccgccgccacgccgcctcctcccacgaagcaagttgccgccgacgaagcaacttgccgctgccacgctgcctcctcccacaaagcaagttgccgccgccgacgaagcacgaagcaactcgccgctgcctcccctgaacactcctacgcgaaaaagacaaatttacccttccaccactcgaaattttttggtacctcctcatgggcaaatttgtacctagaggtaccacttattttccaccgtccgatttcgctgattgaatggctgggatttggtaccggacagtcccgatggtacctgctggatgggagcaaaactcttctaagtggttttcttgctttgtctgaaaatgctctctctttcgtgccaaaaatgtagtattgacgtaaaaatgacaagtcagattgatcatagcatagttgagttagccatggaaaactgttcttcaggccatgctgccatgttagaacacctgtaaggattttcttcgaagctacgtaaggctgatcccatgtatgagtgatcgcagtgagacagttcttcaaatcatttcagacttcacgttttcatcacagcgagagtgccagtgacttggggtttttgttcatgccttcacagaatcacatttcctccggtgtaacgcaacgtcgcaacgagtgcttcgccttggttggtgtagttgcggacgagtaaagacggaatgcattttaaaatagacatactctaacgattatggataacagtatgtctgataaatgtacaacaattaatagtatgcccttaacaggtgtcaaatactaaaaatttagtactactagagtattaaattttggtaggagacgtaaatgaatacaggtgttcagaccccttacacctgttctgaagtgaatcgtgagaaaattcatcattccaaaccgggtcgtcaactatttcgatgagagaattgatcagcatatgtgagcgctagagcttgttaccttgagtgggctttcaacaagatatatatatagaaaaaataacaatcgcggtcgttcgagttacccccctcaactctaataccagttatttttaactctaaactttataaaccggatgaattaccccctatgtcgatccagggcagttttgatcctacgtggatgcatacatggcactccagtcagc

SEQ ID NO: 12772 - DNA, 1501 bp, Oryza sativa
tacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatatgagacaacctgatcgtcagatcaatacacactcggcggattcaaatccctaaacaggagtagggtattacctctcattgagagggcctgaacctgtctaaatcctttgtctccacatccatccacttttaggtctcgtgcgctaccccgtttcattattgccgaattcatgtttcgacagttggcgcgccaggtaggggttgcgtcgagttttctatcgacgagtgcgatggaatcaactccacgagtcgccggtattatcttcgcttctgtatcgtgagatccgccgccgtcgacaccacccgccgatcaaatcaatctacagagagattcaatctactatggctgccaccagcttcacttctgtcttccccaggatctttctggacttcatcgctgccgccgaaaatccgaccagccccaattagtcggctaagagatcatacgtggcatagcaatcaacagcgagatacaagactggacagctatggagttttttcttttctcaagatcagccgtggagatacatgcatgaatatgattgaacagcatacaccggagagccacacatgttttgatcggtcttatatcaatctaaccgtacatgtttcctgctttatcgctttggttcttgccacatacaagaccatgtcgatctcgtttggtcgccgttgtattcatcagtttcgtcaaaaaggttgccgtactgccgcagtcatcatctgtatcaatctactcagcgatgcagatcggttcccagctgccaacgcctcttgccgactgatatcaaattatctggcaagattgaattactagttcaaagcggaatcgacatggacacagagacagcgtcattagcaactacacgtggcatagcaatcaaccaggaagtaatgatctacacatgtgtgctcctgatcgtgcatgaattgggccaccgctgcgcactccaaaaccggccgtgggacaacatacgtgcatcaagataaactactatcaggtttatcgttttaaattttcttatgtgaaatagattaattaacaga

SEQ ID NO: 12773 - DNA, 1501 bp, Oryza sativa
ccggacgtggcgctgatggtagcgtcgcaggctttgttgatagcgcgcggcacgcaaggccgctccccttctctgttcttcaagataatcgagatcgtcgcggcaaaggtcatcctggttggcctcgttgtacaacacgacacgaggcgacccgagggaaagctcggagggtaggaccgcttcggcgccgtacaccaagaaaaatggtgtttcgcccgtggcgcggcttggagtggtccgattttcccacaacacggtgggcaactcctcgagccatgaatccccgtgcttcttcaggacgttgtaagtcttggtcttgagtcctttgaggatttcggcgttggctcgctcgacttggccgttgctcttggggtgggcgggtgaggcaaagcacaatttgattcccatgtcgtcacagtaatcgccaaacagctcactggtgaactgggtaccgttgtctgtaatgatacagttgggcactccgaatcgagacgtgatgcccttgatgaacttaagagcagaatgcttgtcgattttgacaactgggtaggccacgggccacttggtgaatttgtcgatggcgacgtacaagtgctgatacctgcctcaagccgccttgaatggcccaaggatgtccagcccccaaactgcgaaaggccaagatagtgggatgacctgtaaggcttgggccggctggtgggtctgcttggcgtggaactggcgtgccttgcaccgttggacccattcttgggcatcttgtaatgcagttggccaataaaaaccttgccggaaggccttttcgactaaagttcgtgaggccgaatgggctccgcactcaccctgatgagagtcggctatgagctcgatgccctgctctcgagaaatacacttcaagagtatcccgttggcggcacgctggtatagggtcccttctataaggacatactgtttggagatgcgcgcgagcttttcagcttctgcgcgatcctcaggatgagtattgccttcgagatacgcccggatgtcggtcatccacacgacctgatgaggggggtcagggttgaccccctcgggccccgaggggcgcgggtcgcccggagtcgggtcggtgggcgtgtcattggggtccctcaaagggctcggtcgcgccgatggttgtgcgagcctttcctcgaaggtccctggggggagtggggctcgtgccgacgcaacacgcgacaactcgtcagcaattgtgttgtcgcgccggggcacgtgccggagctcaagtccatcgaagtggcgttccatgcgccgtacctcgtggacgtacgcttccatttgcgagtcggtgcactgatactctttggatacttgatttatgaccagctgggagtctcccaagaccaggagacggcggatgcccattccggccgtagccctcaatcccgcgaggagcccttcatattctgccatgttgttcgtggctcggaagtcgagacaaacgacgtatttgaggaca

SEQ ID NO: 12774 - DNA, 1501 bp, Oryza sativa; identical to SEQ ID NO: 12770

SEQ ID NO: 12775 - DNA, 1501 bp, Oryza sativa
acgtcatcatccgcccactttcctctctcttcctcctacgcagagtatcagaagcgcgcgacggagacggcgaggaggtcgacgagcgacgaccggaagtcgaaaacccacacctgcgcgacgacggcctccacgaacgacgcgtccctggcgcggaggtacgcggagaggagcacgaacgggagcgcgaggtcgagtatcacgacgagcaccgatttttgatttggcttggattgctgggctacgttaaggccgacggttgaaagggacgaccgccgcggccaccgcgcgacgacagccatcggcggcgctgcccgtcacatcggccctcctcttcgctgcgctcctcccccaccgccggccacgccggccctcctccccgccgcatcgaagacgccgccacccaggggaaaaaatgagagaggaaggagagaagaggggaaagagagatagaggggtgacgtggacaccctgacacatgggtcccacgctgacttagccaccacgtcagacaaaaccggggtgaaaaccacctaagaaccttaagtgaacggttttgttgtctcatgtctttctatcattatcagaaattttgaacacctccccccaacacacacacacatgcacgactagtttaaattaggtcataacagtataaatggttgattttactgacgtgacatcctagctagcaaggagtaaaaaaggtgggacccacacgctttctttttattttagttttgctgactagggtggcacgctgacaaaactaactattgatactatcatgagatctaatttaacccaggtttgtaagttgaggggttagagatttccgttattacgttcagggatatgagttaaactcggctaaaagatgagggatgtatagtggacttattcatttccccaattcttcttttccaggcccaacggattgatttgccataagcaatgaattatccttcctttttttttttgctaaatagctggatggttttgtacggtgtgccgctaaatggaacggaccaatactccaatactacggcaagttcagtaaattttcccataaaaaaaacctctcaattttgtttcagcactctctctgtgcacttgttgatcttttctgtttttgttctggtaagtagttggttctttgttgcaaacttgcagccgttgtggtatgtgggctttgctcagattgatgtcattttaaatattcctttttttttagagttatcaaatatgtgcatccatttaattttttagtcaaactttaacaaacacataagaaatcctatcaaaattttagcaatattgctaaattgccaaaaattaggcattgccaaaatttggtaaagtttatcttggctacaatttaaacatcccttgtatgtttatttttcttttacttgtacagaatttggacttcacagagttaggtccaacaaaactaggcatatgaaagtaaaacctcaaattcggtctatatatataaagt

SEQ ID NO: 12776 - DNA, 1501 bp, Oryza sativa
gactcaaaggattcttaccaagaggttggacctcttgctaattttcctccaaaaccaatatgcaataagccattccataggaaatttataggatttggaaaacttcaatcctttaaatcaaagggctacataggaaaatttcctataggatttcaatcctatgaaattccttcgtaatttctttgattcaaaggggccctaaagctctggctaaatttcctccaaaaatctatataggattgtcaatttcacatgaattttaaaggattggataggattcaatcatttgtgtcaaagggcttcataggaaattttcctataggtttaaaatccaccaaaatttctatgtttttcctctaaatcaaagggccctaacctaaacactgttccctgaatgatttcttctatgattacgaatgatctaccagaaactccatgcccctgacagcaacacaccaccagatagcaacatcaaattggattttaggaattaagcaacaagctactctagtatagcaacaagacctgacaagtttagccagggggccagccagcctctcccgacgaacgatcgaagccagctgctgcattattagtgtgcagtgcagagctctgtagcaactgaatcatggcggactccttcctgcctgcctcccttccaaagctagccattgcgtgctggagcgatggatcgagtactactaagtagtactccgttctagtggcgatcgaactgccgatccatcgagcaacgtatgcaactttggggcacataatgatatacgatcatgtactgatgtaccgagtaaaaccatggacaggccagtacttgacaatatgtactccttcctccaaaaaaatacctgcatcttttgttactatcttcaaccctgctaagtacaggggaatctacaattacccatgtttaaatgcatgtgttaagctgcaccctgtgaaatctgtgatgtataataacctacaaaattaagatgcagtcatgcagacaatcaatcaaagtggatgcattttgttaaaaaaaaaattcataaggctggtagcctcattatctgagaaataaggctgtcaattctgcttcgttgtttgctggtttgagtacggattgagcatgcttcactgaaatcatgaactggttcttcccgaaatgagatcatggaaggcttgccattcactcatccacaaccggagcttcttttccatgataacagtatgggtctcataaactatggctctgtgatgtattccttacaaatgagtcccagaattcgacaaacacaattgtaaatgatcttataatggaatggccatgggtcaaacatttgctcctaaaattggtgaatcattgataatctaggagggccaagacatgataggtgtcttcctttaacatctcccctttttctgttgttgcccattccctgctgttctttctcagaaattttaccctaccatgctaccagcagtttatgatttatgcttgatt

SEQ ID NO: 12777 - DNA, 1501 bp, Oryza sativa
ctcttatttccaaagatcacattaatcatattgcagcttggcaactactactacttgagttcaaaactttatattttggggacaagccattgcttcgacggatagcaaccgatcctgtgaaaaattccccataaaacccaaatcaagaaattttcaactgctatgattttattttttaaatcactattgatgatgaatagtgattgtgggatcatgtcgaattcaactgctatagtaccctgtttgacaacagatcgagaccttgtgagacaaccaattatggtgagtagctacgcgtattaatcctgttctggcccttcggtgtacgaatttgctaaaagatgtccacggtttttctaatcgatctcagttgatttgtcatcctattgcttattgatgtcttccaccaaatggatcttttggcaagtctatctccttgtgttgtatccatctactctgctctatcgacaaatattactaagcttctactcgtgtgtcagtttgcactttacccttttatcttcttttgaaaaatcaaagatatgtaaaaattatagtgcaagtatatgtaatttacaatgttaaaatatttaactggtttttatgaaaaatatggcgtaaaaaatatagttagtttctttaaaactactggcacatacatacaatggcacgtacttatgaaatatttactcccaactaacatcacatgagatccaatgtaagaaatcatagtgaacttcactatactgttctgtagaatattctcgcagaatttcttcacgtataccatttcactacaataaataactccggacttccatttaattttaaccccagaagatctactgacatctcaaatcctcgtattgcacatttgcacgtacgtaccgtcctcgagcaagcaagcagggactaccgcatttgcaccgtggtactcacccagtcacccacttcacccaggcggcagtgccccatgtgcaacgccacggccatgtgaaccgaagtaccaggtgaccgggagatatttaactatttgccggtagattcaaatattatagacacataagaactcatatgtcatatattatgagtggcaagttcttaattgccatatcttaaaagtgacaaaaaaaagttaaatgcctaggtgacaagagccatcttttcactaattagttaccagtctcttcgtttaacttacaatttattatagaccttaatatttatgaacaataaaaaggtaatttataagtaaaacttttgacttttgcatataacttaaaaatcaatgttgaaaaataaaccacaattaagagtttattcactgtattactaaaatcaacttaccaatatttaccaatattaatttttggtacatattttgatgttactgtattttagtggtgttaaatatgtttagtttttaaacctttttaaaattttggtgatgtttttataagagaattttcggaacttccaaacaacatatttagtttgtcat

SEQ ID NO: 12778 - DNA, 1501 bp, Oryza sativa
aacaaacgacaatatatatagctcttggaacttatccgttggacgctctagtcctcagtcaaagttatgtacgtcgcgatgaaaagacccataagtgcgtcgtacgttcaccagtgggccgacatacgtgtgtcgtacgttcgctagtgggccatacgtgtggctcgtagtctcttacgttcactggtgggttgatcaatttgcctagtagcttggacgattgcctttttaagtacgggccctccagttgacggatcctgctcactaaacttacgaccatacggactttctcggatattgcccatgcagatactaatttgtgcaaatgcaccgccgcacttggcgttgctcgaccgccggcggtggtccccggcgtgggatcgccggcgaccagatcatcatacgcgtatgcacgctccgcgtccacgtggtaaccaaaacatccttgcaaacttttaaggcttggcactacgttttctaaaaggatttttacttatgtttttttttgtaagaattcgattttagaattactaaaaagaagcccgttcgttgcaacggatgaaaatcattttaatcttattatttttatatggtttagttaagatgaaatttactgtgggaattcacttggatacatatattttttaaaaatcaccagctgcagttaggagtccattcgtctaaggttagtatgcgagttttcttatacgactccttctgtatttctaaaagcgaatgaatttaaaaaccgatccatacacggatgacataccaaagtaccggcagaaacatttttaatttttataatagtagagatagagattcgtataaggtattttcttcaccgctaccattgtccaatcttatttatcttgattgcaaagtgaacgactgaaattcaatctatagcaaagtttgtatcaaaaatgtttatacatgggtcgccaatttaacccctctgcatccgacaacataccatgcttatcagttgtgatgccccgcaatcttaactaattaaaaaatgggatcacttttacatttatcgataaattttatcctaaaaatttgacagatataattatagtataatcatgatgtaattacattgtaacttatatgtaacttgcacgtaagttccaaaaatctttccataacatattattttcatgaaatggaggtcgtgggaacaaattctctcacatatatgcgtgcagtgatttttttccttcttcacttacacaaatattaaaacaaatcaaacggttcaaaattatgtgaaagttacatgtaaattatagtgtaattacatataagttacagtataattataatataattgtactgtggttacatctattaattttttgagagaaaatttatcgataaatatatagcaaaattgttcgtcacacatctttttcgtccgtctcatcgtgatcgcgcacgcattatcagactttcgtccgtcctctgctaacttgcagccggcccaatccacgcg

SEQ ID NO: 12779 - DNA, 1501 bp, Oryza sativa
gtgaagttcgttgaccacttaagcggcgcttgcgaaaataattttcgcaggcagacaatatattttcacaggcgcaccttatgtgatccgcctgcaaaaatcgtacctacccaaaaaaaataaaaaaaactttaatacttatctactcctccaacccctccccaccactcatttccccacacttatcttctcaactctctctctccctccctccactggattctcagctccccatcccctcccctcccttcccctctctccctccaccggcggcggcggcggtggcagcgcgtgcggacgaggcggcggcgacgacggagcgcgcggacgcggtggcggcagagcgcgcggacgcggcggcgacccggtgtggcggcggcggctccctggcctcccctcccagatccggctagagggtgaccgggggagggcggcggcgacgtgggcggctcctctcccctcccagatccggccggagggaggccgggggagggcggtggcggctcccagagcggcggcagcgatatgggcggctcccctcccctcccctcccagatccgaccggaggccgggggagggcggtggcggcgactcccggtgcggcggcgaggcaattttttttattttttcattggattttcgcgggcgggccattgccccgcctgcgaaaatggatgattttcaccgtcgttggtctgcaggcggttctcccctctacttgcaaaaattgcttttggcagcccgcgaaaatgctttttcagtagtgtccttcaacagacttgatgcgatcttctatacaatgattctactgcgcttcagtacatatcttcagcaaatgtacgcaatgcttgcttcgcacttgggccgatgcattatttatactagtttcatgcccgcgtgttgctgcaggattttgtggtaatgataaacaactttataaatatgtgcttataaacataattgaagaattgaacattctaaaattataaagcgtaaagttggcatgtgagtagtagatggacaagggacacagcagtggcttaatatgggggatgcatgcatgaccggagcacttaagtgggtcatccattgatgtgtttaattacccatgacagtttgcttacttaaagcctgcatggctgttcactatgctagatcctcacacctttgatgacatacctaggacgggcatatataagtgctggtcagtgatgagggtcacctttaacgagttctacgggatgccgtcatcggtgagccatccggctatggcccgttacaggtatctagtcactagtgacgggccatatagatccagcccgtcaaagatgttatgaaaccatctttaacgggtccgagaccacccaacccaatccttatctatcacccaccgacagtctgagaccactcatctctcgtttttttctttcttccttatccatccctctctctctcttttctttctttcttcctcctccgcacgcaccgagcttgcatgctc

SEQ ID NO: 12780 - DNA, 549 bp, Oryza sativa
gcacttctactattcaaatttgtccaaaaaaagagcagtactatttttccctccaaccactttcactctcaaccataactcatttaaggggcatctattttgttttcttaccctccatctcccttattgtgatgtaggagaaatcatatatcttctgtaaaaaaacaatgcttaaaaaaaattcttccaagagtgattttatataagagtgaagtgcacgagcggtccttaaacttatgtgggtgtgtcatctagatccagaaactctcaaaatgcattttcggattctcgaacttgtttagaagtgtcatatgagtccaaacgagctccaaccccttccatgcgctgatgtggcatgccatgatagttcatacgtgttagttggacacacgtgtcagccacatagaaaaaaatataagtagaaaaacatattttctcctctctaccttagaatttttatattttttctgtctacctaataggagaaaatatggtttttaattttattttgtatatatgcttgacatgtggattccactaacacgtagg

SEQ ID NO: 12781 - DNA, 1501 bp, Oryza sativa
aataaaagataactagagctaaaccttgacttggactgcagcgggaacaccactccacaggcatcctcgacggcacgaacgaagcctattcctcggagaaaccaccatctgacgcatactcaaactctggggtttggggaaaatagagcaagactgagtacaaccaccgtactcagcaagtcataccggaacagggggtatgatgcaggatattaccaaaggatagctagagaggttcttttgcgtaaaacgagcatttataaacagtagttgaaagcaggaaatcaggtgtaataattaatcaatattagccatccactgtccaacgctacaccacgttgcaacaggcccaaccaaccacctgaactaatcagttccatcatattaaactagggtgagactaatcacggtgaatctggttgaccgcccataaccgcgggcaaggctattcaaatagttttactctgatcagaggtgtacaactgtacccacaaaacacagccccacgacacgtttccgtgcgccgacatgccaccacgacataccggaaagaggccgtgacaggactcttcgcataaccccctctagccaagcacaccacacctcaggtttcaccccgtccccagcgggcaacgggcagtcccctctcgtgcctaggtgaatccggaagcgacagaggccgtcacagggcccgccctgctccatcacgcccaccctttcctggatgcgtcaactagaggaaaactacactacaagcccagccgttgcacacgctggcttgtggtaagtatgataagttcttccagggcatcccgcgaaccggtccttaaatgccatgggcgcgaccaacaaaaccatgcacccacagcccaccatttgatatattttaattaaccaacaccggggcggtggcattaaccaacgtcattactagaatctgatatctatgcattaatgtgattttccccattgtgtgctagttgaactaagcatggctaagcaatccctagtccaatctctagtcatgtttatatcccaagctaacaaaggagcatggtacagaaatagcatggctgtaatagtaggtaaacatcccatagtatcattgtaaaataatgcaatatttgaaggaaaacaatagaacatttgcaatataggatcaacatgttcaagtgacaagcatgacttgccttgctctgctgctggaggaacctcggcgactatttcaaagtacaccggagcatcgggagagccggaatctaagcgacatacaaagcaaacaatacaaacaggctataagactaccgaaacagagaacaaaaccattttgaatggattctacacatttttcttgatttactaagacatgaatgggcttaaacggagctcggatgaattagatatgaattttagaagattcacagaaaaatccttaattgatttattgcacaataaataaaccctaggagagagggggcagcgccgacatgcgggccccaca

SEQ ID NO: 12782 - DNA, 1501 bp, Oryza sativa
gcaacgggcagtcccctctcgtgcctaggtgaatccggaagcgacaaaggccgtcacagggcccgccctgctccatcacgcccaccctttcctggatgcgtcaactagaggaaaactacactacaagcccagccgttgcacacgctggcttgtggtaagtatgataagttcttccagggcatcccgcgaaccggtccttaaatgccatgggcgcgaccaacaaaaccatgcacccacagcccaccatttgatatattttaattaaccaacaccggagcggtggcattaaccaacgtcattactagaatctgatatctatgcattaatgtgatttcccccattgtgtgctagttgaactaagcatggctaagcaatccctagtccaatctctagtcatgtttatatcccaagctaacaaaggagcatggtacagaaatagcatggctgtaacagtaggtaaacatcccatagtatcattatgaaacaatgcaatatttgaaggaaaacaatagaacatttgcaatataggatcaacatcttcaagtgacaagcatgacttgccttgctctgctgctggaggaacctcggcgactatttcaaagtacaccggagcgtcgggagagccggaatctaagcgacatacaaagcaaacaatacaaacaggcaataagactactgaaacagagaacaaaaccatttttaatggattctactcatttttcttgatttactgagacttgaatgggcttaaacggagctcggatgaattagatatgaattttagaagattcactgtgcttttactataaacagaaaaatccttaattgatttattgcgcaataaatagaccctaggagagaggggcggcgccaacatgtgggccccacatggcagtgactcgggtggcggtccacagtggaccgagtccacggaccggagaagggggaggcacacgacgtggcgctgacgtggcgccgacgtggcgcacacgtggcggccacatggcacgccacgcgggtggccgaaccgacggccccgatctacccgagagtagatcggacggcggcggggagcacgcggccggcacacacgggcggcccaagccggcccgatggccacggtgcacagcggcgctaccgcagggcggcggcggcagacagcggtgaccgacggcaagcggcggcggcgcgacggcgcgggtgatgctagcggcggctaagcagctaggcggcagcgcggcgactaagcggcgtgggagagagagggaggaaggggaggaggtgtctcaccgacggcgattgatgacggcgagcgacggagggcgatgacggcaacgggacgagctctggaaccacctagcgaacacgatgaaaggggttagagagagagcaagatggaagagggcgaggacgccggccgaaggcggtggccatggcggtgctcaccggcgcaaggcgcggagtgggttccggaggcggaatccgacgggagaggggcgga

SEQ ID NO: 12783 - DNA, 1501 bp, Oryza sativa
tcgagttcatctccaaatttatcccaaattccccctgtactaatctcctttacggataccgcagccggcatcggtggcatcacgtgcaccacacaaaacctcgaccatgtcgccgcgcgagcaggaaggggaacaagtaaagtggcggcggcggcggcggcggcgagggcgtaccgttgaggaggtcgaggtcgagcttgtcgacgtcgaggccggcggcgaagtggccctggttcatgtggcccggcgcgtcgacgtgggtgcccatgtggcactccatcttgagctccgacaggttgtagagcgtcccgttcgccatggagtccctgagccgcaccaccggccccgtcaccgcccccggcgcgaacgccggcaggtccgcccggtacgcgtgggtgatgtccaggatccgcccgccgccgtactcctccatcctccccgccgccgccgccgccgccgggaccccgcaggtgtcctccgcgccgtcgtaccccgggtgcgcgtcgctccccgccgccgggagcgcgtggcgcgccgcggcgacggcgaggacgaggaggaggagcgcaagccgagatgccgccatggcgcgccgctgagctctcacctctcactctaaacttgagctgagctgcctttgctagttgctactactgtttggtcttaacttggctaccaatctatttataagtgaatttttttaaataaaaaaatgtaagaactcacttgagcaatctgtttttttaaaaaaaaaacactagggtttctatttgtaagagtttctttcagcttggaaatttcaagcaagaaaagttaaaagtattcatgtgacagcaactgtgacgtactccatggtcaagcagtagataagctattaagagcaagtttaataatatagcccaatactaactccaaatcatttatagctaatgtaataaccaattcatacaattgtttactatactattaatacctaatcttacctgtcatacacacattacgtcttggagtccgtgctgcagctggctacagatctatagcccgctacttttctctatttttctttatctttttaaaatatgtttatagctggtttatagcctgctattgtacctgctctaccattgttgagataagggattagtattcgccgtccagtgcagcttactgtaaagcatcaggtttagtcttcttcagatagaaaatatcgatgccatccatgaacaacaagtcaaaagtgtagttatttcaacagcaaaaaatgtctacaaaaagattcagaatctcatccaagtagtcaacaaaaggaaatatgtatcaaatatgaaccattcatcaacttacagttactgatgccaatgttcatgggcatgatgataaattaatcttttggttaaggtttgctttcatcttaactcttaagatattttggtttagattctgatgatttgatggtggtgataattaattacagtacttagtggggagagcggcatgaggc

SEQ ID NO: 12784 - DNA, 1501 bp, Oryza sativa
caaaactcgagcttacttagtagccaaaacaaatataccagcagctaacccagctaatgacaatagctgtctgcaagtaaaacacccggtattttgtcacgtaccaaaatgacacttttttttctgacagcaatggcacatcattaactgagccccgcattgacgccaaaacacgggacacgcatgcgtgcgtacgtgtcccgatccgacggtggcaaacacacaaacatcatcatcaccagacacgcaggatacagccacgtagtacgtcgtacagcacaccgtaccccaccctgtacactagcctgtacgtacagctcagcgtccgttgccgcgctgacgtggccgcaccgcgtggcgtccggctcacgcgatctgggccgtcggttcggcgcgggggcccacgcgtcagacacgcgtgtcaggtggtgggagcccaacggtaacaaaagaacgggggcgtgctgcgtgaccgcgtccacgcgtgcgtgacagcgttagggggggtggtcacgtgcgtcgcacctgaccgcaacggtcacattgaccagagagggggggaggcaatcaggcaacggtcacatcccggaccaccccatctcgcaccgtccggtcgcgatccgacggcgtgggagccgcctcgagattcgcgcctcccgcactcttttcctccccttgggttgcccctcccggcctcttcttcccttcccttccaccacaccggagaggtgagtgagagtgagagagtgagagcagagaccaccaccaccggagaggttagtgagagaggagtggtaatggtgaggcaacaagagtaggttccatttcatatcatcactaggatagcgtagtttgtaggctgcatctccatctccatcgccattgattcgcattgcatccatcattttaggatgttctactagggttcttgatttttcttttggtttgttgttttgacgaatggaggtattgttgggattcgccgcctgctgctcgtcgtcgtcgtcgccgatgaggaggccgtgcgggctctgccccggcatgtccgatcgttcgtgatttgttttttctacatgttttagggcccatttgttcttgatcctattctttgattcttttgtactaagcattctaaggcgaagccacccattctttcctgcatatatacttacaaacacatagcccccatctgatctcacaaacattatttctctctctttttttctcagttttttctttgttgatttactgaccaaattctttggaagaacaacaagatcatctggtttttatctgctcattcttttgtacatcgaatcatatacatttccattccaccaaagccttagccagataccacagagagagtgtgagagaaatcagagtgagaaacagaggaggaagaagaagaagaagacgaggaggaggaggaggaggagcaggaggaggaggaggtctcttcttggcacgtcgcgttccggcgagtgacgtgtctccggga

SEQ ID NO: 12785 - DNA, 1501 bp, Oryza sativa
gggctggatttcagtgtgggttggctttcggtgggtggaaatggattgatgcagctaatggataggggtggattggatggagatgcagaacggttttgattgcattggttttggttaggaaagtattggattggttttggttaggaaagttcagatagaaagtggattcagcccatgggcatccattggattgtgcccaaatcccgttcgtcttcctgcgacactggcaggtgaaagccacggcgccgccaccactgtgctcaacgccaccggtggctcaacacattcctctccacctcctgcacccttctgcgccaccagtcattgccggcggcggcaggagtacgacagggagatcaccatggttcatcatcatcacttcgttgccgtccacttcgccagtgccgccacagcaccccaccggctcatcatcatcacctcgcgccgctcccgccggcatcggtgacctcttcccagcatgcgggcctgctcggctggctgttcgcgctcggcgcggcgccactgctggtggggagcgcggcatcggctgtcactggtggaccagtaacagcaaagacgttttcgcctctgctctggctcaccgggctgttggacagcagcaataatgtggtgacatgcaagctgacggtcagcagcggggctcccatgtggccggagttctcagcaacagcgacagcggcaccggtggtcagcctgatgcgtggaggagggtctcagcaaccacagcttttgtgatactgcagtggatatatacgcatccaagcatggtgtccaatgcatggtgcatgccaccatggttttcccagggacagttgaatcaaggattggacactgcggttccagtccatggatttagaatggattgaacccactttactagaatggtatggactggtttggtttgaaaatgttcatggattggattggtttggagcttgaagaaggagaagtggtctgggttggtttggttggggcaataatggattggatttcaacccattagcacccctatgtgtaccgacagaagcacttaagaacacatacaatctaccactggcatcaacagaatgtatctggagatgcctggtttctggctttacaaagaccaagacagaagattcatacacagatcatcgtaagccgtctatatagaccctggtatacgaaatcattaattttcttaaaaggaaaactcggctctatgcttgaccagcaggtccaaaaattgtgctattattttcgttaatctggattacaatcatgagcaatacaatgtaatggcatgctctctaacagaaccagttgttctgtgcttccagagccttttccactaactattaacacaatgaaattcccaaccataagacattttagagccgactcgttgcgaatttcgcaaaccacacgcaaacaaaacaaaacaaaataaaatatctagtggagatgtagaacgtgtgaatgattatataggaaggaaaaa

SEQ ID NO: 12786 - DNA, 1501 bp, Oryza sativa
gttataggaaagttgtttaaaaaattatattaattcattcttaaattgttttaactaatacttaatcagccatgaactaatctgttttgttttctgtgcatgggatcagttcccaatccactccaaagaacacatctctaaattttcatgacatggtaccatactacaaatccatcgcaatggcttgttttgatgtaacagtagaaatttaaatgaattttgtttttgatatataggatgactcttcggaatcaaacaaaattattggttgtgtcaaagcccagttccggttttgacactatcaaatttgagaattcgtactagcctaggtaaaatttggaaccaaacaaaaaatccatacagtacactattgaaatagtcaaaaaatagcttcaatccaaaccacaaatttgctcatttgagaaaatttgggcctgaactgtacagcacatagacagacaggtgggcccgaactgtcagcctcctaggtagcaaaatccccaacccaaccgtaaatttccccgaccaaatccacgcaaaaaccctttcgcatctaaaccctcccctcccgtggatcatcgccgccgccgccggtatctcgctgacctttcctctcgtcggaccaagttttcgcgcgtcccaatctgcggatccgtcggtcgtcgccgtcgtgatgctgtccttgtcgagggcgctggggaggcggctcttctcctcctcctccgccgccgcatctgatgccaccgccgcggccgccgcggtggtgaggaaggcgcaaaacccactggaggagttcttcgaggtcgagaggagcaccgaggaagacaagccccctccgcactacggtatccatacctcccatttttccttcctatataatcattcacacgttctacatctccactagatattttattttgttttgttttgtttgcgtgtggtttgcgaaattcgcaacgagtcggctctaaaatgtcttatggttgggaatttcattgtgttaatagttagtggaaaaggctctggaagcacagaacaactggttctgttagagagcatgccattacattgtattgctcatgattgtaatccagattaacgaaaataatagcacaatttttggacctgctggtcaagcatagagccgagttttccttttaagaaaattaatgatttcgtataccagggtctatatagacggcttacgatgatctgtgtatgaatcttctgtcttggtctttgtaaagccagaaaccaggcatctccagatacattctgttgatgccagtggtagattgtatgtgttcttaagtgcttctgtcggtacacataggggtgctaatgggttgaaatccaatccattattgccccaaccaaaccaacccagaccacttctccttcttcaagctccaaaccaatccaatccatgaacattttcaaaccaaaccagtccataccattctagtaaagtgggttcaatccattctaaatccatggactg

SEQ ID NO: 12787 - DNA, 1501 bp, Oryza sativa; identical to SEQ ID NO: 12784

SEQ ID NO: 12788 - DNA, 1501 bp, Oryza sativa; identical to SEQ ID NO: 12471

SEQ ID NO: 12789 - DNA, 1501 bp, Oryza sativa
atattttttttgcggggaacaaatacgaacatttaatactcatttcagaatataacatgttaaatctcaatcaatcttctttctcatctcaacccaccacaaccattacaatttatatccacttgctttcctaattttcacatgaaactttagaaatgcttatattttagaatggaaggagtgtcaaaaaagttcttaaaatttacatttaagatttttagcttaaaaaaataaactgatgccatcaccgtccatttgtttagtaccacaactacttggaaccatactgacatggttgagatatagagagaatacttaattagcttgacctgatgaaagaaacatgaattaattggatatctgagcaaaattaatggattggattagagagtcaaatcatctaatatatccgctcggaaacaaaaacatcaatatattcacatgcatcagctgctctatataattaagcagcattacacgctcctcctcctcagttaagtggtactactcccttcattccaaattgatatacatatttcatggtatatcaagaccaagaaaaactaataaatctctcatactatatttactctagcaacaaactcgatgcatacaccattctcactatttcctagccaatagcaaatcaagatattacatgtgggttataaatacttgtatgcatggatgcatgcatcaatgtccatttactccaatgtacaaataacgaatagacttaatgaatgaacacaaatatgtagatcatttaggaataacttcaaaaaaaactatatgtagattaatttggaatggagggagtactaagtaacattaattattgatcgattaaaaagggtgtcagagatgatgtaaactggacctgacaggaatccagcttggccaacaactattccagctgtgctgacactgtgcattatctttttttttctgtgatcttgaattaatcacaggcaccgatcgatcaagatgcggacatgtatgcatgtatatatatactccatatacattttattattattattttgaaagaaatacacttcatatacaattatacatggctggcttgattttgatgggtggctgataaccctgacatgatacgcattgccctttccctgctgctatatgaaaccgtagttacagatcgtaattaaagagacccaagccgcatatatttgtatgataactacatattttctagatggtaatcaatcaggctcgtatatgccatgtcatgtcatggattgtgcttcgatcggcattctcactgatttcctgcagagaatcatgaacttgtcggtgtcaccagcaaaacagctgaagtagaacagtaggcagccagcaagcagtaatccatgtgcatcattcgtttgtggatgcaatgagttagtgtcgatggacaattgggcatgacctaaccaagaagagattatggtgtgcatatacgtgtgatcatggattaatttgttgtcaaaatttt

SEQ ID NO: 12790 - DNA, 1501 bp, Oryza sativa
atagtgtaaatataatgtatcattgtaattacattgtaattataattatggtacactgtaatcacattataattacagtttaattgcattataattacatttgagtaatttttattttaaaaaatatctttcgtatagcagtcctggaccggaggagttagcggaataaaatagggcaggatggctataagcctataaccaaatatacgtttcctttttatgtttaatgtctatgcccttatatctagcttagcgttaaaaaaaaattgcctacatggccgcatccaacggctgaaactgtcaactaggatttttacttattcgatggataagtaaaacaaaatctgacgtaaacatgatatgcagtggcggagtagaaattatacaagactaagctaagatagaccttgactaatggagtagtattagttttttgaaaaatatacatggtgaatcaacaaaatttaagcttcggaggcaggccagccctagctgccctagatatgtgcgttaattgatctattttcctcttcaatcgattattttccaactccaacgaccatgtccgccgccgccgccgccgagctgccggacgacatcgtcgagaagatcatctctcgcttgccgccgcgcagcatcgtcaccggctgccgcgccgcgtgcaaggcctggcgccgcctcacctcccggccggaattctaccgcgcctacgtcccacggccacggcctgtcgccgcaaaggtcaccgtgaagatcaacactacccgcgccgccgacaccatcgtccggttcgagttgttccgcagccactggaacgtcgacggcgcggccgtgccgccgtaccggcgcgtcctctcgctcggcgccgcggcgacgacggacaagtacagcatctcgtcgctggtgctcggctcatgggacggcgtgctgtgcatggccatgacgacgggtggccagggcgccgacgtgtacgtgctctggaaccctctcaccaacgcctgcgccaccgtctccgcgccggccgccgccgacagttcgtcggcgcctacgcgcacccggcgacggggcgcttccacatcctgcacgcctccggcaagaccgtcggccactactactaccggaagcagctggcgccggccgtcttccgggtccagacgatcggcgacgccgcctggcgcgtgggccccgcgccgccacccaagatcaccatggcgacgacgggacacgccgccgctcgctccgccgccctgcacggcaagctccactggctggtgcagtcgggcggccgctggccggccgtccggaagctgaagctcctggcgttcgacatgtcccgggagaagctccggctgaaggagacgccggagcgcatggcggcgatggacctagagacggcgcggatcagcgtgctgcccgccgccgccgggaagctgtgcgtcttcgccgtggaggatcgcggcacgacggtgagcatgtgggtgctcgacgactaccacggcga

SEQ ID NO: 12791 - DNA, 1501 bp, Oryza sativa
tttggccaaaaaaatagtatacattagcctttgtacggtcgaacattgcctataattattttgggtgttaattttcggaaacaaaccctacctttttgccgcgcatttcatgggatttaatgctgcttttgccctcactgatgaagcaagcaaaattaaattgtcaacattcaatcgacttgtgcaggggacacaacaccgactggcttccccacaagccgcttgctttctaaagccatgaagatcacccccatcaaccaacaccagtaccacagaaagccacaaataacatttattagagcacacaattaggacatgtttagttgccagccacagcttagcacaatttaccatatctagagttagacaagtttgataaatacagatactaactgtttggttgcattcgtaattgtggtaaaattccttttcaacaaattagatcgcacgtggtaataataactaaaaagagaggcaaaattctatctacgatatgaccaagattttaagcacataaccttaggtaagtttgataatttctattgataaaaaggtagcaacctgtagttgccaatcaaacatgtcttacggcctgtttggtggaacttaaaattctgagaagtagttggttgatagccagcttctgaggatctggaaaagctgggttttccagtttctggctttagttcattttctggattctagaactacagcttctcaaaatctggaccaaaagatgtactgtttgtgagagcttctgattatgggagaagacgcagccgcacaaattaagttaagtagttgacaactaagtcaagattttaatctcaaccatagatttacaaagccaagatacacatcaagattggtgcgattgagaccaaaagcatggtgtacatgctccacatgagtgtagcattgcaaattgtttgcaatttgacaatagaaatacttgatcatagccaaagggcagctgcacactagagactagagtagctaagctcccattgtcagtgccacacccaattttcttctcccttcttccctccccccaatgcacccccttgtctctctctctctctacacacacatcaccaattgaatagagagagaagaagcaaaactttgttaaattgtgttggggagaagcccaatgcattgaagcaagcacccacatttcaccatgacaccaccaccaccactatccatctggagcaagcaaccaagcaccaagacacaagcaaacagctcaacctgttgagtgttttgaggaggaaaagagagagagagtagctagagagagagagagagagagagagagagagaaacaaggtgtttgttttcactcttgaaccatggtgagtgagtgaagagtgagagtgaagttcatagagatcatcacctctcttgaaccaagcaagcttggttagcatagtgtattgtgcactgccccaagcaagcacagcacgatttttgatgcagctgccattgccaccattgt

SEQ ID NO: 12792 - DNA, 1501 bp, Oryza sativa
tgcacggcgacgacgccgacggcgaccagtccggcggccgcgccgccgtggtgttgagccattgcgtcaggaaggcgacctccgatgaagccgaggcggcggtggaggaggagaaggagaggaggtggagtaagaggagaaggaagtgcatggggcttggcaacaatggtggcaatggcagctgcatcaaaaatcgtgctgtgcttgcttggggcagtgcacaatacactatgctaaccaagcttgcttggttcaagagaggtgatgatctctatgaacttcactctcactcttcactcactcaccatggttcaagagtgaaaacaaacaccttgtttctctctctctctctctctctctctctctctagctactctctctctcttttcctcctcaaaacactcaacaggttgagctgtttgcttgtgtcttggtgcttggttgcttgctccagatggatagtggtggtggtggtgtcatggtgaaatgtgggtgcttgcttcaatgcattgggcttctccccaacacaatttaacaaagttttgcttcttctctctctattcaattggtgatgtgtgtgtagagagagagagagacaagggggtgcattggggggagggaagaagggagaagaaaattgggtgtggcactgacaatgggagcttagctactctagtctctagtgtgcagctgccctttggctatgatcaagtatttctattgtcaaattgcaaacaatttgcaatgctacactcatgtggagcatgtacaccatgcttttggtctcaatcgcaccaatcttgatgtgtatcttggctttgtaaatctatggttgagattaaaatcttgacttagttgtcaactacttaacttaatttgtgcggctgcgtcttctcccataatcagaagctctcacaaacagtacatcttttggtccagattttgagaagctgtagttctagaatccagaaaatgaactaaagccagaaactggaaaacccagcttttccagatcctcagaagctggctatcaaccaactacttctcagaattttaagttccaccaaacaggccgtaagacatgtttgattggcaactacaggttgctacctttttatcaatagaaattatcaaacttacctaaggttatgtgcttaaaatcttggtcatatcgtagatagaattttgcctctctttttagttattattaccacgtgcgatctaatttgttgaaaaggaattttaccacaattacgaatgcaaccaaacagttagtatctgtatttatcaaacttgtctaactctagatatggtaaattgtgctaagctgtggctggcaactaaacatgtcctaattgtgtgctctaataaatgttatttgtggctttctgtggtactggtgttggttgatgggggtgatcttcatggctttagaaagcaagcggcttgtggggaagccagtcggtgttgtgtcccctgcacaagtcgattgaatgttgac

SEQ ID NO: 12793 - DNA, 1501 bp, Oryza sativa
gctatgaataacgacgaatcaatgaattttgtataacctatagctatatgtactagtattatgaaattgagaaattaaaaaaaacacagcacaaccgtagacgtttataatatgcacactcatacctataaacacacgcgcacacacatgtcacctaccatgaaaataattttagagcagaaccttttatatttttgctctgaatggtctaaaagaccatgatgaaaaaagaaaattgacagaatatctcaataagttttaaaatttaaaatttatctatgacttataagcgaacaatcaaacgagggtgagagaacaaagggtttgttcacttctttaccattatcaatcattccaaaatttagtaataccaaaatagccttatcaatagttgataattaactttctattcaaaaaacttttctcagtatttggtaatgcatcaaactaaacactactcacctcaattttaccctaccgaaacttgataatgccaaaatcgagtattactaagtgtttttttttcacaaaatgaacaagcccaaaattccaagtggtacggggccatcactggtccattgttcaactacatgggcccgaaagaaaggggctcaaaagcacactgatccagtacaaatgatgggcttttggcccattagtacaaaacctgttaaaatatctgggcttctcaaataggcccataatatgctcatcccaaattgggcttaaaatctacagtcaccagcccaattaaagagcagcggcagacgatgatgatatgactgaaataccctcaccgtccttgtggccgcgtagccgccaatccgatcgcagccgtccaaggaaatatcaacaaccctataaaaaaagtcaacccatgtacaccgtccgatctccatccgactgctccagacgcgcgagggcacgatggtaattaaccaccccttggcgcttttcggccccaccgcgagatatttccggccgctttttccccgcctccctccgtcatccccacccgccaccgacctgtgagccccaccatcagtcgggcccacctgtcagccacccacccgaggatgcgggtagaataagcatccgtcccagcatcccgggatgttttttctcacctgaacgtcgacgagcaatcacaatgacatgtgggcccggtgtcatgcgggacccacgtgtaagtgatagagtgggtaggtagttgggtgggtttaggattcgtatgtggataacgtcctttgcttcgtcttcccccactttcccgcggcaataagaaaaagcgcgggagcaaaaggagaaaaaaaaacaacagcgagaaaaaaaaaatcaagaacacgagcaagcgagaggggaagagagagagagagagagagagagagagagagagatcacgagatcggaggaggaggaggaggaagaagaggggaggaggtggcgtgttgagtcggatcgaggtttgcgtttgtgttcgtttggtcgccggcggaagcga

SEQ ID NO: 12794 - DNA, 1501 bp, Oryza sativa
ggaaagaagctcgcctctagaaatcgcgtatccatccccaagactcctagctagcttgcacacaaccaaattatacatgttcgggccgctatgaagcgtaataccctactcctgtgtgtaggatttagactgagagttacaagggttcctaaactcggaagaacattcttacttccctcctccacaagctcagattttctgagagtcgtccactttctcggtgggcaaggtcctccttttatacctcaagggaataacacatgcaccgcctctacctactcttctttcgggtggggacccaccctatcttgactggaactcgacccgtgctttcgcctggaagctaaaccacagcttgtccttgagcggggcccagcaccgtccctcgcctgacacgggggacagccctgtcattccctcattaataggtgaagacttgtggtggccgccgtccgaatgaccccccgatgggacgggtcatacctacctccactccgccggaagcagatgcgacgtgggagcacggttgtccatccagtcagacgtgaccggtgtcaggccggtcacagaccggtcattcttgaccatcgcgcgtcagtttagcacgccgcacatctgccccactgcattaaatgcgacagggggcagttggggcgctgcgcgcattaaaggaagttcagcctgggccccctcctcgcttgctccccccgccaaatggcggctgggcgagggcctcagggcgaagcagtgcaagggcccgaggggcatgacgtggcaccccgaggccccgaccccccggccgctcctgcggttcgcggaatgcaaggacaggaccaggctgtagggacacgtggtaggatgggaaggtagattcccctcacttcgcatacccccgggcccatatctccgacagtagccctcggcaccacatcggacattggcctcctgaggtcggtctgacgtggtgcctcacgacttcccaagctggggttgtgggcctggcagggaatctaagcggatgccgccgcatggccaggttggcgtatcaacaacaacagcggtttgaccaccacagaccgcgctgatgatgaggatgcttaaggcgtgaaaatcagggggttagttggaccacacctcgactccctcgcctgccacgcatgcggcggtactagtgacggtttgcccagattacgcccgtgaccatcgcacgccctacgccgagtgtgccgctgacaggcgcactaaatgcggggcgcggattcagtgggcaacatgatgagtggtcgtaggaaatgacgaggcgactgcaggcgcgagaatcgtgggggcaaccgagagggcgtgaaacaaggaggcgagcgagggcgaggcagggataaaaggatacggaggcggggactttgcctccttcctttcgccaactgcacactcgctccctaagccctaacattctcgccactccacgctactccgctcatcaagcccctcgtcgtttctccgc

SEQ ID NO: 12795 - DNA, 1501 bp, Oryza sativa
catccgcttagattccctgccaggcccacaaccccagcttgggaagtcgtgaggcaccacgtcagaccgacctcaggaggccaatgtccgatgtggtgccgagggctactgtcggagatatgggcccgggggtatgcgaagtgaggggaatctaccttcccatcctaccacgtgtccctacagcctggtcctgtccttgcattccgcgaaccgcaggagcggccggggggtcggggcctcggggtgccacgtcatgcccctcgggcccttgcactgcttcgccctgaggccctcgcccagccgccatttggcggggggagcaagcgaggagggggcccaggctgaacttcctttaatgcgcgcagcgccccaactgccccctgtcgcatttaatgcagtggggcagatgtgcggcgtgctaaactgacgcgcgatggtcaagaatgaccggtctgtgaccggcctgacaccggtcacgtctgactggatggacaaccgtgctcccacgtcgcatctgcttccggcggagtggaggtaggtatgacccgtcccatcggggggtcattcggacggcggccaccacaagtcttcacctattaatgagggaatgacagggctgtcccccgtgtcaggcgagggacggtgctgggccccgctcaaggacaagctgtggtttagcttccaggcgaaagcacgggtcgagttccagtcaagatagggtgggtccccacccgaaagaagagtaggtagaggcggtgcatgtgttattcccttgaggtataaaaggaggaccttgcccaccgagaaagtggacgactctcagaaaatctgagcttgtggaggagggaagtaagaatgttcttccgagtttaggaacccttgtaactctcagtctaaatcctacacacaggagtagggtattacgcttcatagcggcccgaacatgtataatttggttgtgtgcaagctagctaggagtcttggggatggatacgcgatttctagaggcgagcttctttccccggccaaactcacgaaaggagggtctcacgatctcccgctagagaggatcactcctcgacagagtagtaaataaggtgggacctagtaaaagtaggtatttgttgttaaaagttccacaatgtataactagtaataaggtgggcccaagccaatagcatgaagggagagtgatgaggatcaatacatgccaaaagaataaatgtttttttactccttactactaggttgtagtgctcttgcttggtagtagctatttactggttccacaatgcttactacctggtatgaagattaaaatattgcctattacttggtttgggagcacattgtggatgccttaagagatgacatattcctatgagagctccagattcctgccaagcctaccatatacaacagtcgcagaagcatctccatgatctaactgttcgtctattacatattactttctagtactagctatcagctatgtactagt

SEQ ID NO: 12796 - DNA, 1501 bp, Oryza sativa
aactgtgtgtgtgaagtgagggagtgatgtccttttatagggcagttatgacggttgtgagaaggggaaatgtccgaactgccccgcaaccatcattgggagagcatctggagcgtccacgccaaaccccaggatcaacagcgaccaggggggttcggccgatccagggggttcgggcgaacctatgatgggctctcctggcctggccttcggactgcggactccctaggctctcctctatccatttctcggagttttggattgattcgctgatgtttttatgaagttcacaacccctccttgtatggatacataattctcctcactttagtctagatttcctcccaacgtcagggtttatcatctgcatacaaatatacaccaacacttgtgaaatatgtgagattaagcacctatcactatgttggttgttttattatctgaactttatgcatatgttggcggtatagaatcgacatttaacagccgccaacagcaagcatggaacttaaattatttaaccagaatcagaatctgaaatattgaaaacaagaataacgttgtaaacattagataaacttgaaatctaaatggcatgaacaatcgcatgaacataagagtcacatatcacatagaaaataatgaaaataaatagatagagcaaacaatccatgaatcacataattagtttgtcgtgcacttgcctttaaccttgacggtaactcgaggcaacactctccacaccagatctctacacacatgtggagtaaagctacaactaaacatctatatttgactaactatagttacaaaggacatttactaaaataaacacctaaaatatatattttatcgattaatattaaacaatctatagcagtttcattattgttttatgcgtaactcaccaaccgcataacaaaattttgcaagtaatagaactcaggacatccaaacaaaattttctacaattttcatgttgggagcaaaatcagattaagcctctgtgaatcccagattaaggaaaacaaattgttgtcccagattaagcctccataaaaaactaattaagcctctgtttctgttgtttctcctaaaccgtttatcggaatcgagagaaaccagtggcgttaaaaagatcttgacgatgactacaaactttatttaggacaactaacttgaatcccgattgtttaataccagattggaaaatattactttcgacccataaacaacaactaaaaaaacacacaacaggctaagagaagttacccttgcagaggataaaaattgaacttccatggactaagagaagttacccttgcagaggataaaaatcatatttgaggtgaatttatggaatcccagaaaaatccccaactttgcctctcttccctttttccttcttttcccctcctgctttctctgccctctgaaccatttcctcgctgatcgttgtagcagcagcagcaacagaccacccagtagcagcagcagcagc

SEQ ID NO: 12797 - DNA, 1501 bp, Oryza sativa
aatttgatttttttaagcaactttcatatagaaactttttgcaaaatacgcacgtttagcagtttgaaaatcgtgcgcgcgaaaaacgagggagaggggttgggaacttgaaggtaagaacacagcctaagttatctatttaagcaacactttattacaaataaataaatatagtgtgcaatacaataatctctatgattttgtcctcaggacatatcactaactgatgatcggatgatcaatcacagctttatggcattgaggaggtcgatggtgatggtcgtcgccgcgtcaatctccttaacggtgggaaccatgtcacagtacttgaacagataacctaacttgcacttgcttgtggccccgttgtattgggtctccaaattcttggtccacttgagcaccgtttccacgtcctccttcttgcgtctgccttttccggcggcggcgaggcggtcgagtgcggcaagcaccgagttggtggactctgaattgctggagccaatgccgaagaacgatgtgcagtcgtcgatgttcttgtccctgatgccccgcttcttaccgcgcccacctccctatcgagggcctggatcttggtgagcaggatgatggtggccacttgggtggccttcatttggttgtcctggaaggactcggcgtacgggaggagttcgccgaagcagcagatcttgtagataggatccttggggattctgcagatggtacgggagaactggtacgccgctggggagggctcctgcccaggcggcgtccgcggtggcagctcaaggctgagcttcacccagtcctttgctgcataagctgccggcgttgatcgctatcaacactacctgcaggaggacggcggtcatgctcgacctgctcattgtatttacacacactcacactctctctctctctctctctctctctctctctctctctctctctctctctctctctctctctctctctctctgagtttagttagtagccagctacaggatggattaatgcatatatatgttcaatcgatgaggtaccagttaatttatactagcttgctaggctggctcgattggtcattacaaattgtcaacctttccaatataatttcttcaatggctgtgatatcatcacggcatgcttagttatataccactatttcgatgcaactaataatagtcattatttagacttgatcgttgtttgtttcctgtccattcattaattgttggagtatatatttttggcaaatccaatcttactgctacaaaacattaaataggtgtcgccattataggtgccggaagtgctaaaacacgtacctataagctttttccctatctccgcgggtggaaatagtaaaaaaccggcacatttaaccaattataggtgccggttctaaataagaacctacacctattctataggtgccgattttttataaaaaccagcatcattaaaaactgacacgtataatatattataggtgccagtt

SEQ ID NO: 12798 - DNA, 1501 bp, Oryza sativa
tctagccatgtggggcccaactaattgattcatctatataagtttccttccatcccacataatttgggctgctaatgcttgtaattttattaagtatgctaattatatgggttaattctctcaaacttccttttaatcatttgtatatatggaatgtgtgcatgcagtgcgtttattaaataaggttattgtggtcattttccaatcctactattttgtcctaaattagctagaaatataatttttatgggacggaggtagtagtggatgatgatgtggcatctttacatgttaagcttaaggagttagtaggggataattttataggaagataggatatcattttgcatgcatgcatggcaatgttcccagcatttcacgccaacttcccacacattgcaaatgggggctcactttatatatagcaaattaaaaggcaaaatcaagaagaacttaattaataccaaggaatgacacggcagtgtgcaaattaagaagaagataattgcatctctgtgttaactaaaagtaactgtgaacaagagtaaatctgcatgcttaggaaatcatcaaggggaagatataatgtagtactggcttgtactccattaaggggagtagtaattacaattacaagcatggaattaacacgaggcagagcatatgctattggagtatctatcaatatggtttgttgtggatgtggataagaccccagttatgcaaaactggttcatcgcctgtgtcccaaatcaatttaataattgattaaacagagcaaattttagcttgcagataagacgaaccatcttgatttggagtatccatcaatatggtttgttgtggatgtggataagaccccagttatgctaaactggttcatcatatgtgtgtgccaaatcaatttaataattgattaaacagagcaaattttagcttgcagataagatgatacttcttgattatggaaacagctaacaacccatcgtctagcttattagagaaatataaaccaaaaataacatatttgcaaaataaataatttataaataaaaaacttctatgtactttctcgtaacgatctaaaagtaaacttaaaactaaatcaggatgagaataccctgtgaccaacttttaatttgaagttgaaaattttaatttttactataagcataaatacaagcgaaaagatagcccgtgagctatagcgtgctgttcactcagccgctacagctaacctaaggtagtactgtaaggtgagagagtatgggcaataagccaataatgcatgcagctagcaagcatagcatgacaaaaagatgagataaagctaagctaagcttaaagctaatagtaatagctaaggttagctgaaacgtacgtgttgccgtgcatgcagctcgcctgtgtgtctctggtgcccccgtcgccctcgctgcccccgacacgtctccccctctccacgcgtcgccgtcgtcttcctcctcccctcgccgtggtg

SEQ ID NO: 12799 - DNA, 1501 bp, Oryza sativa
gaaatgttgaatactcctgctactacgactcctatacaatggaactgatgagagataggatcatttgtcgtcttgttcagattcactctaccaacatgtttcttttgagttttgaacatgaccagtaatcactgtactgtagtgcgggggtactatagccacttagcgtgagaattagcctaaccaatgcatggaacagacaaaacaaatcaatacggtatcattgggcatatgttgtctcggtcgtcgaaatttcaccaacagttcgcaggatttaatcccattctgaccagaatcctaagatcaagtttaatagtatagctaattatttgctccaaatcacatatagtcaatttaatagacaattcatacaatagttacttataagagcaggtacaatagcaggctataagccagctgcaaatatattttaaggagataaatgaagagagagaatatcagcgggctacagatttgtagccagctatagcacggactccaagacacagtatgtgtatgacagatgggaccaggtattaatagtgtagtatgtaattagttggctatactattaaacttgctctaaataattaatgtttggtcccacctgtcatacacgtgtatcttgaagtccgtgctgcatctggctacaaatctttagcatgctgctcttatctcttatcttttatctccttaaaatatgtttatagttggcttatagtctgctattgtacctgctctaagtgaagtagtataattccacacttgaaccagaatgaattaaatatttaaaaagtgaagaagttaattttaaaaagttttctacgaaatctcttctttctataaaactaatgtacactaatgaccgataaacatgcaaatatggtatttattaccactcctaaaacctacatacaagcatatcacatcaacccattaaaacacacaaagcttaacatgcaagtatatagtaattatatccataatttatttctttctaaaactaaacatatacatgataaatcatcattctcaaatcatttttaaaatatttcaattcaaatcatttcatcatttcttcattatataacatatatttgcagcaaagcgcagggcatcacctaatatataccaatgaagaaatttttagcaaggaaatatagggtgtgtttagttcacgtcaaaattggaagtttggttgaaattggaacgatgtgacgtttcgatgtgatgaaaaaattgaaagtttaaagaaaaattttggaactaaactcggccacaataccattaggaagcgtgcatgcaataatcaataagaaaaaaaaatgaacatgaccttagaccggagcatggtaattccataaaaatttttgaaactcaaacgagtctcacacatggttcgcaaaatcattcactgaataccactccggagtggtcttgtctatttttatgaaaaccataaacttaaacaaatgttaacaaaattctaaattttatttga

SEQ ID NO: 12800 - DNA, 1501 bp, Oryza sativa
atgtgatttgttagtagacatcaaaacgtgtcattgctgaaagacacttaaaaattaataatttgctggaggataattttaactcgattggagagaatttcttctaaaagacgataatgtctaggatcgaaagcttttgatctgaagttgcaatgaggatggaatacgatgtatgctagtgatgtacttggaattatggtaaatgtggagttgcataatttttaattttttactctagcgttatatttgaagcatgttgttatatgggcattctcttctttcttaagaatttatctttcgaattgaagtaaattactagttttttaaagtgtctttcaaccgtgacatattttttttacaatgcctatcagcaacttacacaaaatttagatgtcctatagcaaaatttatcttatttttttatgttgctgaaaaaggaaggagggtacgggtcaagactccagaatggtttgaactccaacagcaatctctccattaaagaattcaccaacgatgaatctgatcaagctagctagctaatgtctactaacatgttaatcagctttaattaactagtgatcgattagcaagaacatctgtctgtcagtctgtcactagaagctcgaacgtcgttacactcctagcatatcgatttggcgccccattttaatcagcttcagtttgtggaccattgcaactagcatgtttttttagtactaaaccgaaaattgacagacgtaccattatatgctctgtaacttgggcttccaagactcttctctctaattatggagcactaggttgttgttcggaatcttctacttgaataagagggattaggttttcagcacgttgaagtgaccaatcatggtagactcctcttcaccgacgattgaccgcaatgtaaagtactagtcgattatagtattgcaatgaccaacaaccctataaatttcactcctttttggcaacatgcctccactcgaacttgctgaactttgttaggattatattgttggatccatcatggcagacaaggtgagtccttggtcctcctttctggcttccacagttttgctgcaaagcaaaggttgcatatgcattaaggtttttgcagaattaagctctgtttttgtattgcatggatgcttttatagcaaatggccagtttgatcattaaggcaaatctcgagtgtgaaaagtgttgcaagaagatccagaaagtccttaacaaactcaaaggtatgtatggatcaatgcacttgctgaattatgtaaatttaatcccataactaagttgtggcgtaaggccaaaaaggtggtacagtatatgattaagctgtggtttgaattgaacgaacatgaagcagacaaggagaagatcattaacatcgtttatgagaactcgaacaatagggtgatcatatcgggccatttcaagccagaggagctcgcccataagctaagatgcaaggcctgcggggtcatcaaagacattgaa

SEQ ID NO: 12801 - DNA, 1501 bp, Oryza sativa
atagatagtagatgattatacgacgaacaactccaatggctagtgtagtattatcgctattggcatttatgcgttcctatgtattgtattcaagttatagtaatccttccctttttaataatacctccatccagaaatatatgggattattcccaattgggtacaaattaaggaagaaagtatacaccaaatctgattgtgtgaaaagacatatatagttaacacgttgaatgatgtgcatagagtacatctttaaaaaaaaactactaaagtttggtaggagtgaatgaattttaaaatgcactacatattagtattaatgagtttgtgagagccttatatgctgaaatcagtttgttgctgcccttgttgcctcagtataacaaaaatcgtctatattcttggacaaatgaaggagaaataatcccctatattcccgggcagatgagtagatgtcgacaatgattttgtttgcaaaatgggaaaaaataagataaaacctcctgaaagaaaaaaaaacaaaaaagagatttgacaaaattccatagcccaggtatcgtgatagaaaattttgaaatacgttttgtttgcaaaatgggaaaaaaaacaagataaaacctcctgaaagaaaaaaaaacaaaaaagagatttgacaaaattccatagcccaccgagtcaaaggagttactaggccgagggcaaaagttgggccgtaatcggccagccgcgcaagaagtaaaggaggcttggactgcgacgtaaagcgcgctctgggagtctgtgggctggaagcctgcaagcgccgggtctgggaggaaggctgggccgtgttgtcgcgacgctatcacaggcacatgcttgaacaacacgctgggcttgcttttgaccgcgatctcactcgattctcttctcgttgacttgtctcgtgccattttctcgtctcttcgctgtatgcaccatgtgttcacgtggcacgcacgtgcaacgtttcatataatccacgcatgtgttccctttttgactcgtacaagtatgaatagtatattgcggtgctataccttttctttgcgtatcagccatctactgaactgcaagtctgcaacgtgatgcgaaaagaaaaaaaaagagctgcaacgtacgtgatgcgaggactgtatgaaactgctcgcttgggttgggccttaaggcccatcaatatcgagtgcttagtaatatgggccgcttcgctggcgccgctgtatacaaacgtgacgtgatacgtactagtacagctttgaacgcacctcgtcgatcgatgcaaagtgcgatctgcattaatagcgttgcgtctccttgccaacctcctctgcatgcggtcgcttcccaccgacgcctccatcacatcggcgcccgtcgcggtcaactcgaaatcaacataccaccagccgcgcgcgtgcagccgtcgtcgcatctcaccatcgcagccatatcctctccctctcccacttcgcctcatcactac

SEQ ID NO: 12802 - DNA, 1501 bp, Oryza sativa
atgcagaaaaaacagaggttggagaaatagacacaagggctccttttgaatccgtcaaagctgcagtaagcttatttggggaagttcgattttcatctgacaaatcagctgcaaggaagccaaagcctcctcaggcagaggtaggtacttatattaaacatttttttcatattagattaataatagtacttcaatgtgtgcatgcatatatctttatgaaggttgaacataccgatttgtgtggaatgttatgcgtgcctactattacatggaatacttataagtacagcaatgttgcagaccttgatgttcttaagccttgttgattccagaactgctaacttcaaatcttacgcaacaaaatgctgtgaccttcaagtgtgttatactgatgccaatatgccataatgttgataaccattttcaaatgtctaagtagtttcatgtagcacttatttgaagctaagtaacacagatcttggaacgatgctgtgttcctcgtccagtgaactttgtcccgaaacaaggaacgggaacaacacaagatgacgtaccgaacgtggatggatcacatcctaacataaggaggtatgaggaaggcaaatctgagaggggttgggtttagggatggggaatgcaccagggtcacagccgcaacgggcgagcactgttattgctccctcgctgcttgctgccatcgcacctgagtgcatggaggaacgccaccgctgttgcgctgaggaggacgggggagtgctgctgctgttgtgccgaagggggttgggggagcgttgtcgccactgacctgagggaggacaggaagcaccgctgtagtcgtgctgcggggcttggggaagtgcggttgccgctgtcgcgccgaggggcatgggggagtgccatctccatcgtcgctatcacgctgagtggctgagaacgatgggatggattctttccatcgatgggataagactgtgagtggataagggattcatcttatttcatttttgctcttggactctgaatattatgaacagttctttattgaattgatttctttcatataagccataaaatttcatatatattcatttaagcttattgtatgcataacaatggaatgctcatatttataagcccttggcttctaatttctgatattgttccggactatcatcccggaaactaatggaacgcattccatactttgaacaaacgttttgaagaggtatttcccccttcataccatatttttcaaaatccctgttccgggatctttttatgacttaggtttgaagccacgcctttgttttttttaatgaaatttgtcatatcagcaaactatttcctgcatgttccagtgaataccacaagatacttgttttttatatgctctaactcttttcatttgcatttactttcctgttcattcctatttcttttttgcaagaaataggtgtgttcccactgttagaaatttcaggctgttccccagcctatttgc

SEQ ID NO: 12803 - DNA, 1501 bp, Oryza sativa
aaattgccacacggcttcgaccatcacagaggaaacatgtaaatatgttttggcctgcagatcttggtgtttagtaactagtagtcctcgttggattgaattttgggaacagctatgtagtctattggtatatatcccaggttctgaatcgacgtttcacgaagagacttgtgaactgccagtgtagtgtagagtgattttttcgaaaaaaaaaaactctcaattcctttttacttgttatcgttgactcgtactatcactaataattcttaagatctttcaataaagatggcatctcatggtcgcgcgaacgcgcaactccgagtggctaagtacatatggaacaaattcaccaaacgtccctcaactttagatcgagtttgtatgacatctctaatctctaataccaaaaatctttacccctaaactatacaaaaccgtgcataaaggaacactttacactatacccatatactagattcccagttaatcatagaaatcttcttgttctttcgttcaaggaaaacaatctccttattatctcagaataaaataataataagacgatttcttctcatatatatatgatttgcatctgtgatcatattaggttgtgtttagattggtccaaagtttgaaatttggttgaaattggagacgatatgactgaaaagttgtgtgcgtataaaaggtttgatgtgatggatagttagaagtttgaaaaaaaaaactttagaactaaacacaccatgagggaaatcaaatcaaatactacgtactgtatttcgtttatttaaagattagagacattgcttcgttggactaaaaaaatcatgagagatcgattgcttcattagctcaaagtttcaaacccacacgaaaaaactcccaaagtaaataaaaaaacgaataaagaaaaaaaccgacacgaacggattccacgtcacaatcctcatccaatcctctcacatcgtaaagcgtgcgatagaaagtccgcggatcgacacgtcatcatgacgagcaaacgaagctcgacacgcaccgtttatctctcccatcctttcctattaacccaatgacatgtgggaccagaaaatgcaaaggaggttgtggccccacctgtcagtgagatagtgggtcacgagaaggtagttagtcaaagaaaggtaagccttatctacacatcaccatctgcttgttgccacgtcaccccatatctcctctcgcttccttgccttcgctgtcttaacagtaccaaaattaccaaaaaaacgcccacagatttcttcattattacacagatttcctcagaattcggaggttaggggcatatatgaaaatattagttttgttaggggtcaatctgtgagagaggtcaaccttttgtgcccataaaaaagcaacgtcctaacgtaacggcaacgaccaccgcttcgctttccgtcgcgcgcgcgtttcgtcgaacaccacgccggcgaccacgacatggccaccgccgcct

SEQ ID NO: 12804 - DNA, 436 bp, Oryza sativa
aaacaggccccaagtgtcaaaagtggagagctctcaaaaaaaaaaaagtgtctagccgccgggggaggggggcgcattttcacgaggcggcgtcgcggcgacgaggagggagggaaaagggtggccgttagttacgcactacgccgtcacatgggggaggccgatgtgcggctgacgcgcgcacggttgtgctcgcgcggcgtgcctaccctaatgttttacacacgtatatatacgtatgaggatatttgtatatacaaaatttatacgtatataaagtatatgcatacatgtgtatgtatatatttttgatatgtaagaaaatataaacacgtatacaaaattagtatacgtatatctttacctattataaaaattaaagatgattccgtactaatagagtgtttcatccgtctttcttcccatgtttccaaag

SEQ ID NO: 12805 - DNA, 1501 bp, Oryza sativa
cctccgtcgcccccgcttgcacggtcgccgccgtcttccgcctctgctgcgcggcccaccgccgtcttccgccttagctgagcggcccggccactgctgccttcgccgcccgacacggccgccgccgtcttccacctcagctgagcgggctggccgccactgtccccgtcgtccactgcacggccgtcaccgtctttcgcttccgccgcgtggcctggccatcgccgtcttccgacgtatgccgcacggtcgccgccgtcttctgcctcagccgagcgacccggccgtcgctacccctgtcacccgccgcacagtcgctgccgacttcgcctccgccgtgtggcctggctgccgctgcccccgtcactcgccacatggccgtcgtcgtctttcgcctccgccgcggcccggctgccgctatctccgacgtctgccgcacggccgccgccgtatttcatcgtcagtgataggttatcgaggggataggagaagaagacgaactgtgaggggataggagggagaaagaggatgtgaggtaggagaagatggtgggtcccacgaatcaataaaatatgcgtgttacaatatttctattgtagacattagctacactgttttatatagatgatatggctattttttttggagtcaacagcggtctatattattgaccttgctcttagtacaccggctgcacgctatcaccccgttaacccccctatttctatctccaattagacctctttaatttctttcagcaataaaataataatataaagttgaatcggaagttttattatctaaacacatattaatacaaagttgaaagtttcaaaaattttgaattttcagaagaaaattttaaaaattcagttaaacgtttgaaattgagttcaaactttaaaattccagttgaaaggtttttataaaaaattgagttgaaagtttaaattttggttaacattttgaattttgaggtgaaagttctaaaattttgttgaaattttaaaaataattgttcagaaattttcagtataaagttttaaatattcagttgaaagttttaaaacttggttggaagtttttgaaatttaaactgaatgttaactcactttttcaagtttcaattcacattttttcattggaaaaataaaatgagagcgaaggatcaggcgcggctacacggacaccgcatccgctctactccgtatgaccatatcaatagacagatatgccatgagcctgttgggctcaaaatgttggcacgtagcgaagctgcacaaattagatttctcgtataacgtgtacagctgcactaaatgtctctatcttcaatcggtgaaatttgactcgtcaaaggtagcaaatttttaaggtaggtcgatcagtagtgtactactccctctgtcccatactcccattagagcaagtttaataatataatcaactacgggcttcaaatgatctataaactaatctaataacccattcatacaataat

SEQ ID NO: 12806 - DNA, 1501 bp, Oryza sativa
  unsure (1)..(1501): unsure at all n locations
ttggaagaaaaacccgtcactgcctcacatgtgacagcttttcctttcggcctatcacaggtaacaggatacctatgacgggccgcggcagaatgcctcaccgatgacgacatcccgtatgacccgtcaaaggtgacggtcatcagtgaccaaatcatttgcccgtcgtaggtatcccgtcagaggtgtgaggatctggcgtagtgggcattccataatcccaccatcgatttttatttaaattggtgggcctattttacaccgttagattggatctatttaaaaagtttgtgctagagaatccatttactggaaatacttacatacgtatacgtatgaaaatatttacatacgtatatgatggagtatatctttaggtactgcttattacagaagaaacaaagaacgtacgtatgtacgataaatattagttcacttggatggaaaaatacaaaggaacatacgtatgtacggtgaacgcacgataaatatacgtacgaagttataaccgacgaaaaaaatatagacggtatttttaaaataggatcttctgtactataaaaataaaatttattgctccacaaatatagtcacgtggtgcttgtataagcactcttagaccatcacgtggcactatataatttcactatcgattttcatttaaattaatgatccgttattttatacctttacattagcccgctgccttttaatatcgtatattatatattgtggcatgccccccagcgctctgtctagaaccggtcagaccggccatacagccggtcagaccgcctggggtggcccgtcagaccagcggcatgtggccggtcataccgcccctggtaaccggtcagaccggccgcgcaacgccagtcagaccgcccatggtctgcaattttgtcaatttcgcacaaagatttaaaatcaagaccgactcttttaatataaaaaataatccctttttcacattataggcagatgcttattgtgccaaatcatttgttttagaattatcatgcttagcnatatgtctaatagcanaattatcaaaattgacaataatatccaagtatgagtcaagatacttatttagtggtccgtccaagcatttgtaaactccggcaacttgttgcaccaccaattccgaatcaccaaacgcttccacatgcttagctccaaccatctccatcacttataagccgaataataacacacttaagccaccacgtagcactcctacaaatgctcctacgccgtcgcatgacattttaataaattaaaaaattcacaaaaaaattaagagtaaactaaacatttagccatcgattttcactaatatacatcgattttcactaatatacagtagacccattgttttctaacattaaatttatttatccaagtaaaaaaggataaaaaggcccacatattcctaactcctcccatccagtacataccacgtatttcctttttctcctattttcctattatctttttg

SEQ ID NO: 12807 - DNA, 1501 bp, Oryza sativa
accggcctaccaatgcaagaaacattatcacttttcatatgtgcatttccaatttctttatggtctcaggtgtgaattatatattatgatggtcctggctatttgaaacatgagtcttatcttatgatggtactggctatttgaaacatgggtcttatgtattatgcggtgagtcttatattattagggtgctggctatttgaaacatgaattatatattatttcatttcatatgtttgttttatggacacatacgagcacaagttgataagttctgctaaaatttaatgtggctttatatactatttgtattgatgagtatatatatacactgctttattgttcaggcttacattcaacagttgaagtcaagtaggattaggctaagccagcttgcacagcaagttcacgtggcaagagtacaggtaaaaagctagccttgaaaatgtctgattattagcatattaattatatctcccagcattcttttgtatatacattactctctgctatcctatttgatcaacggaggtatatacattactctctgttattttgtgtgttaatcaattgttcatccattatgtttattttgttggctatgtgttgttttaatattcgttgcattgttactctctttgcgtttagtcgctctatggaggggggtcatgtgattgcacctcttcgtcgacgggaccgccgattgctagaacgccatagtgcttctcttagatgtatgctttatcatcatttgttcctttgtagctggtttgtgatctgccacagcttgttgtgtgtcatcgttaaattgtttgtttcctgtttagcgtgctctcctgtttcggctggtggtgaatatgcctgggaaacagttgctacgcagcgtaaaagtatgtgcgttgtttgttcctattgtgctgctgttgtgccccatcgctgctcacccctctgtttgtttatgtgatttccccccctccactagatgatgggtttttccctatttatcctgcttggtactcttcgaagagacgacagatacgatcaaaaaaattggctctcaaacgactggtggctgcaggtctttatgcttggtattttttttacttcccttcatatgtccctgtcagcctctcttatttgcaggttgtctgttgatttttcctgtaggtaaaaggctttctcgtatatcgtccctgtcttccaataggtttgatagtgattacggcaaatttttaaaaagttatttccactttattttacccctttccatgccttagtttatcgtgcaccgacattatatctaaatatagatatgtttttgacctgcatgtgcatatagagacgtcgaaggatataactcagtgccgcatgtgtggtgctcagttctggtaccaagaacgatgcaagagagattcagctataactcagcgccgtatgtcttatagtctttgttgcaaaggcggcaaaatttttgttcctccatttgcacaaccaccagaac

SEQ ID NO: 12808 - DNA, 1410 bp, Oryza sativa
cgccgccgccacgccacgcccgccgccgccgccacgccacgccacgccgtctccgccaaggcctcgcaacgccacgccgccgccgccgtcgccacgccgccgccgccgccgccacgccgccgcgccaaccgccgccccgatgccgccacaccgccgttaatgaacgagaacgagaacgatcgaacgaacgagagcgagaacaaacacgtcaacgtacgttgccgcgacaacgtgaacgagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatgtgtgtgtgtgtgtgtgtgtgtgtgtgtgtgtgtgtgtgtgtgtgtgtgtgtgtgtgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 12809 - DNA, 386 bp, Oryza sativa
ccggggaagagatgggccgagcggaattcggcccatcgaacccgggggaggcaaactagacttttgcggagggattcgatttggaaggaattggattcggaattgatctcgacgatcgatcgcggattgagaccttgagatggcacggacactagacaacaagcaaagaaacaaatttcgcaattagggtttttaagagataattttcccgctaggcgccacgacggaacgggcgctacaacaccccttgcacctctctcacactcacttgagctttgtgttcatccatctagtgtgttagagggttgtttagccaagagtcaagtgcatttgcttccattgtagagctagtgtggcacttgatcatctccacaccgggtcattgc

SEQ ID NO: 12810 - DNA, 1192 bp, Oryza sativa
gcgatggtaaaattgtagaagttaagcaaaagtcaatggcatattgtagaacatgataaagtcagtggcaaatcgtagacgtgtgacaaagtcagtggtatataatggattctctctttgcatttttatccgcctgcaaaattgaggctgagcgaccggcatacgaaatccgttcttttagcagtgcatgattccagtatttgtattccaatttaaaagtactcaatttgcccgttaattgcaaataccacaaatgcaatcctctcggctatagaatctgttctagaatttttcatttattggaaatactgcggctgagtatcattctaaatcctatcatactgcagggttgaaatcaacaaagcgaatcattttcttgtaactttgattgtttgagctacgaagaaataaacgagcaaaaatactaatttatggggaaaatatttatgttattagcagtttaaaagataagactgaacagtagagtatgatgaaaaaaaaatctaaaaaatcatctgtaaataaaattagatctcaaaatttaaattttggttaccgttgaataagatttatgattgactttgatccttatatgtatcacagacgacagtacgtgcacacatgaatattagtaacgggtgagatgtcatctaaatataataaaatttcgatctctcttgttatgcattactagtactcttactatttatatgtatagtactccctccgtttcaaaatgtttgacaccgttgactttttagtacgtgtttgaccattcgtcttattcaaaaaatttaagtaattatttattcttttcatatcatttaattcattgttaaatatactttcatgtacacatataattttatatatttcacaattttttttaataagacgaacgattaaacatgggttaaaaagtcaacggtgtcctaaaagtacagtccaaccgttttgtcccgttgaaactgcttatatagaaagaacaaatattatatagattccagtgatgacagcaattagatagtagacctaaccaagagttatataaccaaaagatgcactgaagctttgcattacattgtgcaaaaacaaacaccattaatggtgctcatctaatatgctggccatgcagttcttgctttaaaaagctcagaagagaacaggattctgctgcaattaaaggttgctg

SEQ ID NO: 12811 - DNA, 1501 bp, Oryza sativa
ttagtacagagcggtatgtcactaccccattaattaattaaattaaactaatgctcacgataagtgacatatgatcagggtgtagtttaagggcccactcgaggccttgtcattcctgggctgcaatttagcagaatgaggcccacaaaaattaggatcaagacctacatatatacacaacaatataactataaaattgtttctacgaatttagtcaaacttaacaaagttttataattgcgctgttgtgcatgtaggtcttgatcatggaatgctgactagtaaaaaatacaaatgacttataatatgaaatagagggagtagctaataagaatttagagaaacatcacgtttggctactagtttgtttatgtgaagtacagttacgagccttttcaatctagactgtttggctaataagattttttgaagtggatatagctatagctttgccaaaaaaaactccttgaagaggaccaccgaccatagaccttgtactgttcaaaaaacttcttaccttccctagctgaaggtaagaatttaagttttagtagtgcaaacatttcttaccttcccaggcaggctctaaaatttcttaccttccctagctgaaggattaaacgctaactaaagtaactagctagacaatcgattatacgattaattatcgtgtgatgtatgatatggccaaattaattaataaatgctcttttatccaactatacatgcgagagtgctgtgggcccactggaggcccatcccattactgggccgcacggcccttcatcagaatgaaacgtccgatcaatttcattcgtaattgaaacttctcgatcagtttccatgtgaatgtttttatttgtttttttagtggaaatgttttgcattttgtgaatgcatgcctggccacaaatccatagtatgtaatacgcacatttcgaatatggaatcgtatcatctgattgatccatatatgctatcttgataaaaactaaaaattcccacccatcaactcgtttgattctccaagttttttttttcctggtactttctctaccttcctttcgaaggcacctcacaaagaagaaatccatcaaacaaaatgacaagaaatcgaaattagaaaaaagaaaacgtgtacttttccggtccaaacgagtgaagacaacacgagttttaattcctcaagaagaaatcaaatagtattcatatttttccaactaaattcccagcgaaccaacgatggggcccagtgtcagcgcccgccggccacgcctttgacttgtgccccctccactcctacgtgccacccactctccgaatccatctcgtccgtccatctccacccttcctcccatctcagccgtccgatcttctgctgaccaattccctcctcttcaaaaaccgcgtcctcctacgtcgtcaagaaccggatgaacacctcgtcgcgagctcgccattgccactgcccattgctctgctcgctgctccatcgccggcg

SEQ ID NO: 12812 - DNA, 1501 bp, Oryza sativa
cgcggcttgcaagaagtggggcggcgattgcaggaagggcaaggagtggggaagtgggtggagagggcactgggtgcggttgctcccttcgatttcgccggccggaggagagatattgatccgacaggtggtccacctgttggtgtctgaagagagagagaggggcataggctcggctgggccacggccatgggtcagcgagcggaggaggcgagcacgcgtggggaggcaaggcggaccgcggcccatgaccgaggggaaaagatagcaaaaatattttatttaattccgataactgaattctaattattacttacttctttgctctgaaaatttcactgataatcctgttgttgtattttagaaggggaacttaagaaaagttctatttgtatctctagtagataaacttgtaaaacacatattttaatatatataaacttgtcggggtgcgtacgaaccaagacaaacagaataaaacaaggataatcttgctaatttaagtgttgattaggatgttacatacatatttacgtaagaaaatgatacgtagatgtatacatctgttcataaaaaaaggttaataaggcccgattattgcacggagaaaggcattaaaaccgagaaatgatgcaaaaggtagaacccgcaataataaagccgatgaatggagttctcaaaacaagatccgatgaatgggcccaaacgaacaatagcggtgaataaaaagcccatggaacagtctaagtttggtgaaggattttagggtaggcaccgtagaccttgaccccgtatatactttaaacatgttatgagagttacagaagtacacaacaccaaacttgtggccagtatattacgataaaataagtggtctcagtacatttacgagacagtgcccattgatacgtggcagcagaaccttgaattcacggcgttggtctcgtatcattcatcaaaacaggctgcatctaacacacgacgtatatttaagttgccagagtgctagagaagtaaacatttgtatcaacaaagtaattggtcgctagctggactgttatatatatattcaacacgtacgttaatttacggtcaaactttgcccagcatcttcatttttagctaggcagcctgcttcgttaattttcttcagcatgataatccgacgaaccttggttaattctgctgtttcgcgtgcgtggtttcttacttaacgcacgctagctgtagcgcaccagcttagcaaccttctggtgctggtggtacgtgaagcgcgaattgtcttcggattatcggatatatccctgcatgcccacgcggcgggcgccgcgcgcacacaacataagacaacgcgtccatccagcgatcgacgacgcgcgcactgtccatctatcctacctatcgctttatatatccatgcatgcacctccctatccttcacacctagctcgctcgatcatttcatttctcgaggcaggcaagctagctaagattcgatcaa

SEQ ID NO: 12813 - DNA, 1501 bp, Oryza sativa
tgtcatctcggtgcagttgtgcacattctgcagagtttaaatctattcggatagtcgtggccatggtcatggacaactcggtgaaccattccttgttatccttgcattattacggattaccattggatacactaaaagtcttgcggagtacgtattgtactcacacacgcttgtgtgacttctttttttttagagattgaggaggacctggcaatcgggtacttctatacaacaggttttggagacaatgatgttggtgcttactaggacttaacggtcagttgttgtgtgagggcagagacacacttgctgggttttggtgcctttatattatgttttcgctgtgttttactctcttatattgtcttgtattcggcggatgacccatgatgtaattgttaaagtctagatcatttatttacttaagtttggactcctatgtactgtactttgatgatgtatgaactctagtatcaaggttgaatgtatgtgctagcaattgatcgtgtaactagcacggcatacatatacgatttggggtcaaacccaggtttgacactaggcaccgtaggcccaatccacgtgtacagtttaaacagtcttgagagccatgcaacaccacaacctatgtggatagtatatatagcatgataaaataagaaggggtttcaagtaaatatttattatcagtgcccactcatgcatggtcagcagtagggtttgaaatttcggaaccccgggcaaatatctcgtccgcaattttttgtttttttacaattttttgaattcgatcaacatttatttaaattcaactaaaatttatttaaaattttaaataattttgtgaaaaaacccaccattttttctgaaattattgaaattcctgtgaccactgaaattgccatattttcggtctttaccaaaattggaaaccctgggcaagagaaccttcaattcacccaaccctcatcacagttccgggtttgggctcatcaaaacaggcaacatctgacatgacatacattttctaagtagccagaacgctagagaagtaaacattacagcaataaagtaattggtggcgtgctgggctgttatattaattcaacaacacgttcacggtcaaattaagtttatcccagcatcttcctttttgctaagcaccggctttgttatctcttctgcatgataaactgagagggacgaaacggggttaatttctgttgtttcgcactcgtggtttcttacttgcgcacgctagctgtaacacaccagctactggtggtgaagcgtgaaggtgaaggcctagctagcttcgtcgttatctttggacttatgcctgcatgcccacggcgcccgccgcgcgcacacaacataagacgacacgtatgtccgtccagcgagcgcgatcgatcgctatatatatccatgcatccacgttcgtatccttcacacctcgatcagtagctccatcgtaagatcgattcgaccaacatatcaa

SEQ ID NO: 12814 - DNA, 1501 bp, Oryza sativa
ggagtactcgccgccctggccgccgatggcgaggaggatgagtttacccttggactggcagtacttgatgtcggggccgacggcggagacctggtggccggagatgtcgagcttgtaggtgcccgggatgtagccgaaggcgctgaggaaggagatgatgacggtggtatagcggccggcgtcgcaggcctccctgagggagccctcgtccttgttccggccccagatgatcacggtgtcgccggtgttctgggacgtcgccgacacggcggcgaggccggcggacagtagtactgccaaggagagaagtgccgcgaggcgtcgaagcgccattgttgatatgttggtcgaatcgatcttacgatggagctactgatcgaggtgtgaaggatacgaacgtggatgcatggatatatatagcgatcgatcgcgctcgctggacggacatacgtgtcgtcttatgttgtgtgcgcgcggcgggcgccgtgggcatgcaggcataagtccaaagataacgacgaagctagctaggccttcaccttcacgcttcaccaccagtagctggtgtgttacagctagcgtgcgcaagtaagaaaccacgagtgcgaaacaacagaaattaaccccgtttcgtccctctcagtttatcatgcagaagagataacaaagccggtgcttagcaaaaaggaagatgctgggataaacttaatttgaccgtgaacgtgttgttgaattaatataacagcccagcacgccaccaattactttattgctgtaatgtttacttctctagcgttctggctacttagaaaatgtatgtcatgtcagatgttgcctgttttgatgagcccaaacccggaactgtgatgagggttgggtgaattgaaggttctcttgcccagggtttccaattttggtaaagaccgaaaatatggcaatttcagtggtcacaggaatttcaataatttcagaaaaaatggtgggttttttcacaaaattatttaaaattttaaataaattttagttgaatttaaataaatgttgatcgaattcaaaaaattgtaaaaaaacaaaaaattgcggacgagatatttgcccggggttccgaaatttcaaaccctactgctgaccatgcatgagtgggcactgataataaatatttacttgaaaccccttcttattttatcatgctatatatactatccacataggttgtggtgttgcatggctctcaagactgtttaaactgtacacgtggattgggcctacggtgcctagtgtcaaacctgggtttgaccccaaatcgtatatgtatgccgtgctagttacacgatcaattgctagcacatacattcaaccttgatactagagttcatacatcatcaaagtacagtacataggagtccaaacttaagtaaataaatgatctagactttaacaattacatcatgggtcatccgccgaatacaagacaatataagagagtaaaacacagcgaaaa

SEQ ID NO: 12815 - DNA, 1501 bp, Oryza sativa
gatagagagggagtgaggatgacatatggggccacgtgggtcccaccattttttttattattttgtgtgtggaactgacatgtgggtcccatgggttttattattttttcagctcaaattgccatgtaagcaccacgtcagtgccacgtcagataaaaaccgagtcaaattagccacgtaggtgtcacgtcagctaaaaccgccctcaaaaccgtcgagggacctcatctgcaccggttttgatagttgagggacccgttgtgtctgattttccggttgagggactaaaatcggattcgctgacaagttaagagacctcagatgaacttattccagagagaaaaagagagaaagctagctagcagcccaaccaaagcagcagcaagccggcccagcaaaaagcaactacagcctagcagctagcccacagagcagaggagcagcagcccagcacaatactgcatgacactgtagcaaccaagcacgaacaataccacctcgcttttccagcttgagcaacacagcttaaataggaggcttgttgaggactattaatgctgcatagagtttggacttacacaaacaaggatcgaagaaaaaataacacatttttaaagttataataaaaacaatcacatgccttttttttaattgaatcgtgtttacataacctaaccacatcatcagtttttttttctttccattcattgcacgatttccttctgatttttgtagagtgaaatgattttacgattggagtgtagtgaacttgatatgatagctagccaaaaaacatttcttctactatggctcttctttgctagtgaattttttttatcaatatcaagtaccggaaaaaataaccattcattgcaactgaatctaataataatacatgacaaaagtaaatgtttattatggtttcaaattttagtttgtaatacataattttattttaaggtggtattaatagtttttttataatcatccatgtcagtggatctagagcaacaaataattatgttatgtgagtgtctttcctctttttttaagaaaaaggacacccatgtgagtgtctttctggcactggaaatatttgatttgcctataaggacttcacttaacctggtaatcttacgcttccacacattcactactacttttttttatacttcatctagtgcaacgtaccaacatttttactagtatatgggtgatcatattccatctcacttgaccatcatccaaacacgaattttttttatttataattttttttattaaaagttttacaaaaataatttttcattttgaaaattaacggaaatagtcgcctaccgccctcccagagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcc

SEQ ID NO: 12816 - DNA, 1501 bp, Oryza sativa
agggtgagggaaggatacagggtttttcatggtgttaaggagaaggacattgcactgtaccatgggttgatgaagggattgatcaggatcaagcgagctcgagaagcgacggaggttttcagagagatggttgccacggggtgcgagccgaacatgcacacatacattatgctgcttcaggggcacttggggaagaggggaaggaaggggagggatccattggtgaactttgagagcatctttgttggtgggttggtgaaggccgggaggacattggaggcaactaagtttgtggagaggactatgtggggtggagtggatgtgccaaggttcgactataacaagttcttgtactacttttcaaatgaggatggggtgtcgatgtttgaggaagttggaaggaggttgaaggatgtggggcatgttgatcttggggacatctttctgacttatggtgagaggatggccacaagggataggaggagaagagcgatgaatggacttctaacagaggtttaagataatacttgatcataatcatctcaggagcttggtcttttttttaccacaaggtaattgtatagatgacctgctcatatagtgaggactttgtgggaggaatagcagatactccctccatttcatattataagtcgtttgacttttttcttagtcaaacattttcaagtttgaccgagtttatagcaaaatatagtaatattttcaatacaaagcaaacattgtaacaaaatatattcaatgttaaatttagtgaaattagtttggtgttgtggatgttgctattttttttataaacttggtcaaacctaaagaattttgactaacaaaaaagttaaacgtcttataatatgaaacggagggaatagttcttttttagtgaagtatagcaaatagtccattcttgccttcgtttttgaacttttgataatgattcaagaagctggatagattaccattgtgcagtgtcatgcatggtatgataatctgagggttcctttagatgtattcatgctatgttgcttgaagattttagatttgcaagtttgagcttgattcattagcactactctgaggtttttggtcaaacatgactacagcactgtctcccaataataatttgtgtgcaaattatattgaaaagtgaaaacagtaaaataatacactcataagtaaactaagttaacttcgtcaagaaagcttccatcctgaacaatataaaactcaaaagtcaactgatcaggttatctttgagtaggctataaacaatctccttttcaaaagaaagctggaaacagtctccattttctactcaagtgacgtaggctacagttttattgactttggactgtggaaaggattcaaaaggtgaatcccattttgctgactctaagcttgtattttctctcccagctttcatttgaggtcagaagtgcggtagagcttgtttctggttctttgttcatcttctatcctagataga

SEQ ID NO: 12817 - DNA, 1501 bp, Oryza sativa
atctaggatagaagatgaacaaagaaccagaaacaagctctaccgcacttctgacctcaaatgaaagctgggagagaaaatacaagcttagagtcagcaaaatgggattcaccttttgaatcctttccacagtccaaagtcaataaaactgtagcctacgtcacttgagtagaaaatggagactgtttccagctttcttttgaaaaggagattgtttatagcctactcaaagataacctgatcagttgacttttgagttttatattgttcaggatggaagctttcttgacgaagttaacttagtttacttatgagtgtattattttactgttttcacttttcaatataatttgcacacaaattattattgggagacagtgctgtagtcatgtttgaccaaaaacctcagagtagtgctaatgaatcaagctcaaacttgcaaatctaaaatcttcaagcaacatagcatgaatacatctaaaggaaccctcagattatcataccatgcatgacactgcacaatggtaatctatccagcttcttgaatcattatcaaaagttcaaaaacgaaggcaagaatggactatttgctatacttcactaaaaaagaactattccctccgtttcatattataagacgtttaacttttttgttagtcaaaattctttaggtttgaccaagtttataaaaaaaatagcaacatccacaacaccaaactaatttcactaaatttaacattgaatatattttgttacaatgtttgctttgtattgaaaatattactatattttgctataaactcggtcaaacttgaaaatgtttgactaagaaaaaagtcaaacgacttataatatgaaatggagggagtatctgctattcctcccacaaagtcctcactatatgagcaggtcatctatacaattaccttgtggtaaaaaaaagaccaagctcctgagatgattatgatcaagtattatcttaaacctctgttagaagtccattcatcgctcttctcctcctatcccttgtggccatcctctcaccataagtcagaaagatgtccccaagatcaacatgccccacatccttcaacctccttccaacttcctcaaacatcgacaccccatcctcatttgaaaagtagtacaagaacttgttatagtcgaaccttggcacatccactccaccccacatagtcctctccacaaacttagttgcctccaatgtcctcccggccttcaccaacccaccaacaaagatgctctcaaagttcaccaatggatccctccccttccttcccctcttccccaagtgcccctgaagcagcataatgtatgtgtgcatgttcggctcgcaccccgtggcaaccatctctctgaaaacctccgtcgcttctcgagctcgcttgatcctgatcaatcccttcatcaacccatggtacagtgcaatgtccttctccttaacaccatgaaaaaccctgtatccttccctcaccctcct

SEQ ID NO: 12818 - DNA, 1168 bp, Oryza sativa
tcacttaagtttacacaattcagcttactagatatcaaacatcattaatgttgaagggatgagtaaatttctgtcaggttttgccagctatcaagttaattagaatgccgtaaagctggagtgctgcacaagtgcattacccatagaaatttatttacatagtgattgtgcgtgattgtaggtgagttatatcaagttagatcaaaaggaaggtgtgcaagatctatatgtggtgaattgaagatgttcagtgcttcaagcggtaactaaaatccgaatagacgaaaataaagaaaataggtctaatcgttgacatggtaccataaaaagttaaatatttttggctttaactcgtgtcgttctttcaaaagttcagtttcctagacaccacacgtcttcattctcccatgtcttcaattgtatcttgctaatcattactccctccattccataatataaggcacaaccactttttttttagatgttccataatataaggcatgcatacatgtaggcaattaactatgatccattctccattaaattattacttttttaaatcctacactctcatgttctctaattctattggatgcatgcattgtatttactaggtgaaactccgcgtattgctgcgggaatttagtatgaagatatacattgaaacattatttgaattatgtcggatgataatttaacatgtttgtgtttgaaaagctcttaaattataaaaactataaagatatagcatgtttgcatgatgtccaaatgtgatgattgttagtggatgatgatgtggcatcttgttaattagtggatgatgatgtggcatctttgcatgaagatatacattgaaacattatgtgaattatgttggatgataatttaacatgtttgtatttgaaaagctcttaaattataaaaactataaagatatagcatgtttgcatgatgtttaaatgtgatgattgttagtggatgatgatgtgacatcttgttaattagtggatgatgatgtggcatcttgttagtggatgatgatgtggcatctttgcatgttaagcttaaggagttagtgcgggataactttatagtaagatatgattaggatgatccaaactacaagatgataataattgtttcttggtctttgggttaggggtggtta

SEQ ID NO: 12819 - DNA, 1501 bp, Oryza sativa
cgtcatatgacatatcattaaaaggcttttcaagaaatagggattttagccgaaaggtaaacacaggatttgctttagtggaatgagtgattcgatgtcctcttctttttttttcctccaacgtgtaggtcataggtggattcatagtagatctcgcaggtgaattttagttaacaattcctccaatgattgtatcctatacttacatagttgcctcccactaactgtagtaagtgctaattctctcatctctcatgtagacacattacctcaattgttttcatagtattttaggtgattgtctaaggtacaaattgtctctcttttccacaccatgcatatcaattatgtatagcctttggagaaatgattaaaggttcttatcgtacaaagcacatgaaataaaccatttggtaacaagaaaattccgacttcgctcattatgcctaccattttatcatgcaattttcccacagcaaaaacacggggtctcatctagaagattgataagattcaaaaatcagagcactaaaacatcaggctaacattcactccactagtccacttaccatgcaatatgtcaaaatcagttttgtgatgtgcaaacttgttaaggcttgaaaaccttagtatttgtcttttgcggtatcagagtatcatgaattcatgatataaaaaccttggtatttaagttttgcaaagtataatagtgtttccttactagttctttcaaaacctcagtatttataagttttgcaaagtataatagcatttccttactagttgcttcaaaaccttagtatttaagttttgcagagtttcagtaatatttaagcttaatcctagctagttggttcaaaaacatgaaaatatcagtctcctcaaattgttttagttagagcttttcgaataaatattcgagttcagaaagttgtgtcaggactcgggacctaaaaactgctcataatgcatatgaaagggcacggttccatttcaaacatcacctagcaaacttcaacaagcacaccaaaagtaaaacacaataccatgcttcacacgaagctataagcaaacatcttattccgcgtccttcacattattgcacaatcaatttctccgcaaataatagctaaccattgttgtcatccatgtcactcgcaggagccatttcacctaccaagttactactatccaaagctccaaaccaagttgctctatcccaattttgcatgagtccaggtttctcgtaaggtggcaaactaggcagctaaacaatttgtaactacactacagtgagagcaatgaaaaattgtgtagtagtaccaagtaatgatggaactactatgagcaatttcagttgaacccctaactttttgttttggggaaaaaatgctgttttcgtactaaagttaagacaaatagaaaacctagcttccagtcccagatctagaagagaagatatggataacgcgaattcgagaaaagtgtgcgtagaacgaga

SEQ ID NO: 12820 - DNA, 1501 bp, Oryza sativa
aacctggactcatgcaaaattgggatagagcaacttggtttggagctttggatagtagtaacttggtaggtgaaatggctcctgcgagtgacatggatgacaacaatggttagctattatttgcggagaaattgattgtgcaataatgtgaaggacgcggaataagatgtttgcttatagcttcgtgtgaagcatggtattgtgttttacttttggtgtgcttgttgaagtttgctaggtgatgtttgaaatggaaccgtgccctttcatatgcattatgagcagtttttaggtcccgagtcctgacacaactttctgaactcgaatatttattcgaaaagctctaactaaaacaatttgaggagactgatattttcatgtttttgaaccaactagctaggattaagcttaaatattactgaaactctgcaaaacttaaatactaaggttttgaagcaactagtaaggaaatgctattatactttgcaaaacttataaatactgaggttttgaaagaactagtaaggaaacactattatactttgcaaaacttaaataccaaggtttttatatcatgaattcatgatactctgataccgcaaaagacaaatactaaggttttcaagccttaacaagtttgcacatcacaaaactgattttgacatattgcatggtaagtggactagtggagtgaatgttagcctgatgttttagtgctctgatttttgaatcttatcaatcttctagatgagaccccgtgtttttgctgtgggaaaattgcatgataaaatggtaggcataatgagcgaagtcggaattttcttgttaccaaatggtttatttcatgtgctttgtacgataagaacctttaatcatttctccaaaggctatacataattgatatgcatggtgtggaaaagagagacaatttgtaccttagacaatcacctaaaatactatgaaaacaattgaggtaatgtgtctacatgagagatgagagaattagcacttactacagttagtgggaggcaactatgtaagtataggatacaatcattggaggaattgttaactaaaattcacctgcgagatctactatgaatccacctatgacctacacgttggaggaaaaaaaaagaagaggacatcgaatcactcattccactaaagcaaatcctgtgtttacctttcggctaaaatccctatttcttgaaaagccttttaatgatatgtcatatgacgtattcgtcaaccctgagtgtctgatgcttggtaaagttggcagcgatacgtcatggacgtctcctttttatcctctgtcatgtccaacatacttatgcatattctcagttgtcagttatatatgacaatttcgcaagatgtaacacaaccctctgcatgagaatgagggaggagtattagatcatccatcaaagccttaaattattcttagttctgttttatctaggcatctgtttgattactgcaccatgtgttttgc

SEQ ID NO: 12821 - DNA, 1501 bp, Oryza sativa
atgcagtataagtaaatatataatttcttaagtagattttcattatgggtcatcttttattacccatgtttcgctttaacatactttaaccaatgtatttactttggacgaggtaatcttgactttgttttattttggattatccttttttttaagcatatgaacgatgttgagtacatcggctcctatttatcaataaacttcctcagttgtatggtgtagaccgtttaaattttaaaatatactgttcattcaattttttctcaaaaatattcggtatgtaaaaaattttacagaaatataccgtcggtctcgcacaaacattacgtgaagatgacgtgggaatgacgtggcagacggtatcacgcaggaaaagcgcgagactgcgcggtctcgcggaatgaaagagcgagaccgttcggtctcactgaagcaatgcgcgataccatgccatgccgatttcattagcgattaattatccttattagcgtttaattaattattaattattaattcgttaattatgataattaatcactaattattattagttaattgagtaattaatcactaattaaaagaagctgtcagacagtgtcgctcgttgcttcagcgagtgtcgacgggtgatacccgtagaacggatatagagggtattggggtacgttggtacaaggatctacgtaatacgacatcgagcaaacaaaagacgaggattatactggttcaggccccttaataggtaatagccctaattcagttgatatgggattatatgatggaaaaccacaggttacaaagggaacgatggaactcgatgaaaccggcgagatcgtaatcgagttggttcgactagatctcccggcgacttggctcctgcaggctccgacttcgtaggctgtgggggtggtgttggctgtgagattcgatgccttaggtcttcccagggggtcccttttatatcgcagatcaggtggtctccagtagaactcggagacatcggaccctacacgatacattaacgaccctgtcttgtccgagtaggactcaaacactgtggagaatttccttagtgcatgcagataatgtccgtgtatgcgcgggtatgccatgtcgatatgtggcgcatatcgaagggtaaggggtatacctaatccgtaaccctgacagtagcccctgatttctgcttaaatgaactcgtgcgaccaatagcgacttctgatgtcgagactgatgtcgttctcggtgtgggaaccgtagagacaggacatgatcgagaacaccgtgtgaagcccaacggtcacgagtgaatttaaactgaagtctgaaaaactgccgcacgtaacggacccagaaatttccggcggccatctctctcctttccttggaattcgcaccgtcggtagtgcgtctatttaaaggaattttggggatccatcttgaagtccgcccaccatgcagaaaacattccgcctgtaagcgctcttcgccttcctcgctg

SEQ ID NO: 12822 - DNA, 1501 bp, Oryza sativa
tataaataactaaacaaacagtattgcgaagttctccttgtacattaaaacagagcaaaatagatccattgaaggattttaaggaaatactaagaactagaaagagatgatctgcagaatgcaagataagaaactgcaaactgtacctttttcccatttgaagtctgcacatgaacttcattgtcttttatgctaacaacctctccatctatccaggctagaattgggtcctcgacccaaacatgagaaccaacaataatattaacaggagtcccctgcaaaacacatggtgcagtaatcaaacagatgcctagataaaacagaactaagaataatttaaggctttgatggatgatctaatactcctccctcattctcatgcagagggttgtgttacatcttgcgaaattgtcatatataactgacaactgagaatatgcataagtatgttggacatgacagaggataaaaaggagacgtccatgacgtatcgctgccaactttaccaagcatcagacactcagggttgacgaatacgtcatatgacatatcattaaaaggcttttcaagaaatagggattttagccgaaaggtaaacacaggatttgctttagtggaatgagtgattcgatgtcctcttctttttttttcctccaacgtgtaggtcataggtggattcatagtagatctcgcaggtgaattttagttaacaattcctccaatgattgtatcctatacttacatagttgcctcccactaactgtagtaagtgctaattctctcatctctcatgtagacacattacctcaattgttttcatagtattttaggtgattgttctaaggtacaaattgtctctcttttccacaccatgcatatcaattatgtatagcctttggagaaatgattaaaggttcttatcgtacaaagcacatgaaataaaccatttggtaacaagaaaattccgacttcgctcattatgcctaccattttatcatgcaattttcccacagcaaaaacacggggtctcatctagaagattgataagattcaaaaatcagagcactaaaacatcaggctaacattcactccactagtccacttaccatgcaatatgtcaaaatcagttttgtgatgtgcaaacttgttaaggcttgaaaaccttagtatttgtcttttgcggtatcagagtatcatgaattcatgatataaaaaccttggtatttaagttttgcaaagtataatagtgtttccttactagttctttcaaaacctcagtatttataagttttgcaaagtataatagcatttccttactagttgcttcaaaaccttagtatttaagttttgcagagtttcagtaatatttaagcttaatcctagctagttggttcaaaaacatgaaaatatcagtctcctcaaattgttttagttagagcttttcgaataaatattcgagttcagaaagttgtgtcaggactcgggacctaaaaactgctca

SEQ ID NO: 12823 - DNA, 1501 bp, Oryza sativa
accgccgtgcataaatggcaatggcgaaacaaagtaaaggacagataaactttattgaatttcggtgatctaagcctggaagccatggaaacctcttctttatttttttggaagaaagctgggattgggcaagggccatgctttggtgatgattagagtttgttgaattcggaattctgttggagatcgatgggcaacgcgtacgtgtgtggatcaagttgcgcgcgagcacacccaatttcatacgaaaatggtggagtttgtttgaaactttgaatgggggtggagtgtgatcggtgatgtgacgccagttaggcattgtgtttaggattcataagttccacgtgacatttaaatatgaaactaaaaaaaatgaataaaaaaaagacttgagcctctccagataaagatttgaaagtatcgctcttaaggagtactattttcaaaccttgcactagtcacgcgttttcggtcctgctcctgcttgggctctgagttcataattttctcatgccaaacactatggccctgtttagttcccaaaaacttttcgcaaaaacataacattgaatattgggacatatgtatggagtataaaatatagatacaaagaaaaattaatcgcacactttgtatgtaaatcgtgagacgaatttttttatctaattaattcatgaatagctataagtgctatagtaacctatatgtgctaatgacaactaaattaggttcaaaagattcgtctcgcgtttccaggcgagttatgaaattagttttttcattcgtgtccgaaaaccccttccgacatccagtcaaacgtccgatgtgacacccgaaaattttcatttcaccatctaaataggccctattacatggcatatttgtaaattataaacgccctcatacgaaataatcgactttataggttttgatcaaggtagttcaattagaagtatatattaacgtgtaaaaatattggatttatagctattaaaaatataatttatgataaatcaatggtcaaaagttgatgagtaaatttcattttggtccaccttttgttatcaatatttcgctttggatcaccatttagccaatgtttttactttggaccggataaagttgtttttgttttattttagaccacccaacctacttctagagcatctgaacgatctcgattatgtcgattatgtcagttttctacttgtcaatgaactcctcagctatatatgagatcatttcttcagcatattataagtttaatatagatggataaaagaattaaggatggttcaaagtgccacaaaggtaaaagtatccgattcaaagtgaaaacattgtttttatggtggttaaaaacaaaacatcagtaataaaaaatgacccaaagtgaaatttactcctgaatttttctaaaaaaaaagaatatatcatacataaaatttttaaattagaatacatcataccgaaaatcaccaaataccggtagcatagtagt

SEQ ID NO: 12824 - DNA, 1501 bp, Oryza sativa
caagggtccatgtcggcctcaccagcaacgcgcgcgactgattcgctgaggtaggccgcccctttctagacccgtgcctctgtcggcggcggcgatgaggttggggaaacaacgagtcttcatcttcaccgcctccactgagatctccggcgtctccacgcgcgagcatggtgagggctgtgagtctgagactggcgacggccaacctcctactcccgacggcggcggaggcacctcttgcacgcaccatacctgacgagtgggcctagacatttgccacgtcagtgaaaaaaaatgtggagaaaagagagggagagagatggtgtttacgtggcatgctaacatgtggggcccacgctgactcagccgccacgtacactaaaaccggggtcaaaccatcgaaggacctcgggtgaccggtttcatatagctaaggaaccccgtatatctggttttgcggttcgatgacgttttcgtatctcggtgacaagatcaggacctccggtgcacctttccattagtttttcttttccttacatcggtacactgtgccacgccgccacctacctgtcgacgttgcagacttgccctatagtgccatccccacccgcgcggctcgtctcgtctcgtcttctcccgaacgaacaaagcacccgaaccactctcgtatcttccctgttccaccttccaccaccctctttatccaaacgccaccgctctgtcactctccttcctcccggcggaggcacggccagcctcctcccgctcccggcgaacaggtccggactccggaggcacggcgtgcgcggccgccttacctggctgcgcgcgcgcacagccgggtgatcaggtaaaggccaggggtagacgcggccggccatccatctgagttagaacggaatcgaaggtaaatcgttcttctctctctcagcgccacgtcatgagccggcttggtgtagagctcgtccggatttagttgattgttcgattcgtttccgttcaatcaaacccatccggtttcttccccattctattacttggacgcgtgcgaggtgcagtaataatagatagcaatttgtttccaaaagaattcgagggttcagctgaatctcatgcggtactttaggtccgcccctggagtttttgagggtgtttgttatgcgattttgctgtgtttagctttactctagattctagatgacttggtttatttaggagatggattgttgttttcaagggtttattccgcatttctggtaatcaataggcactagatacttattctaaatttccttttgaggaaagtgagattctcccctgcacaaggcggtactgcggtagtaacatagaaaatctctgtaacgttactgaaataatttgaattcctttttccatcacatcctttgggtatattatttgaatatttttattcctaacttgtttcatagttctgatttttttcctcagatggattcctgtactgcaaatctcatgtcacggc

SEQ ID NO: 12825 - DNA, 1501 bp, Oryza sativa
tctacatcttctcctgaagaactaagggcccatttgaatcataggaatgaaaaaacagaggaatatgaaaaacataggattctgacaggaatgcaagtataaaacagaagattgcaaaacacaggaaaaacataggaatgattgtttgatttagccacaggaaaaacacagtaatttgaggaaagataaagactcaaaggattctttccatgaggttctacatcatgttaaattttctccaaaacttttatgggaagagtcattccataggaatttcataggatccattcctttgattcaaaggactatataggaaaaattcctatagtaatgaaatcctctaaaattcctatgaatttcctttgaatgaaaggggccctaaataatcaaactacaacgtcttcttttgctcctatttgcatctccctatgctcctattcgcatcttctctgttctatcattttaactaacctcttcaatcttgcaatacggttcaactttcgtcttttgagatccctagtgtggcaatagcaatttactcctagtgcttttatatttttttttaaaaaaaaacatagtggattttagaaaccatgtcttctgacctttcctgaaaaaaatatattttggcataggggaaacaaaaataggagcagtttcctaatcttcatactgaaaaaagaggtggggcggtccttaaacttgtagggggtgtgtcatctagatccctaaactctcaaaatgatttatcatagtgtgtcatctagttcacaaatctccacaaccccttcaggatcctacgtggcgttaacatgacatactacccgaacatgacgtggcattattttaactaacaaatgggacctatttaaatttttttctttttcttttttttcttctcttttttccctttctttttctttcactgtaacccgtgcagaagaaagggaaaaaaaagaagaaaaagaagaaaacgaaaaaaagaagaaaaaagaaaagaaaataacacgtcatgtccatgtagcatatgccacattagcgccacgtaggatcctagaggggatgtgtcgatttgggacctaaatgatacactttgacaagttctaggacctggatatatattttgagagtttagggacctacatgacacaagcttacaagtttaaggatcaccaatgcactttactcttgaaaaaacaaatacaaatatatttgatggaaggggggtaaaaagcaaagggcttgcttagattgtagccaaaataaaccttaccaagttttggtaataccgaaattttgacagatagaaatatttagtgacattttttttaacttggaaaaaaaattggtatggttgaaaattgcatcgaagtgaacatgcccaaaattgcacactccacactgccgagcaaaatcgctaaacccagcctcgccgtcgccggcgacatgctccgcctctcatgctgccggccgacggccggcggcggcctcgccggcgcca

SEQ ID NO: 12826 - DNA, 1501 bp, Oryza sativa
aaaggctgtgtttagatttaggggtgaaaagttttagcgtgtcacatcggatatatggatacatatttgaagtattaaatatagactaataacaaaacaaattacagattccgccgataaactgtgagacgaacttattaagcctaattaatccgtcattagcaaatatttattgtagcaccacattgtcagatcatggagcaattaggattaaaatatttgtctcgcaatttacacgtgatctgtgtaattagtttttttcctatgtttaatacttcatgcatgtgtctaaacattcaatgtgacatgctaaaaatttttacccgggaatctaaacatgcccaaagctattgttcattgcacagacttttaatatgacacatgccatagtagtgcttattagctcctaaatcttttgtattttaagacaaataaagtcaatagtaagggtagtgtgtgtgtgtgtgtgtgttttatatgtgtggtatggaagttttccgacagtaccgataccatattccgaaaaactaataatatttttatcgacggttaccattttcaaattttatttttcccaatttctataagcgtggcattgaagttgacactaaatagttcaattcataaatataaaaattttccaatcatttttgccagtttccgaaaaataataaaataatgatatcatactaaccatttccgactaacgtaacttccaacaatatgcctgcggtgcagccatatataataccataaaatttacccttcactacaacatcatgacagcattaatttcttccaacaataccgcaaacttcacaaatataaaagcgaatcacgctattgtattaaagggaaaaccaaaaggaaagtaaatttcttctaatgtgtcggacagtatccatgcacatgatcctcagattacacactttcaggacccagctagctatatatgtccctgacttaccttgttccaaatcagtacgcctaaattgactagactaaactacaagtctactgtctacaactatgaacagctttgcaaagctccacttttacatggaagctcttacagttacagggaaaaaaagaatgcaagaactgaatcagatgaacaatctctacgtatgcaggagctgagtatatatatatgtcgaacttaattagatcttcatgtacatgttaattaacgtcccgcgcgcctgcagcgaacgagcaaaaccggtccgggaatccatccatggcggccgaccggcgcgcacataagctgccgctcgccggccggccgccggcgcggcgaggctagttacggcgtccagcattttccggatccggagccgcctggattgggaccttggtggcaatcattgcctcccggcggcgaccctccattgtcaaggacctgcaagatgagctcgccggcggcgccgacctggccctgcagccagctgctgctaccaaataagtcaccttccagcagcctcgccgccatgatcgcgtt

SEQ ID NO: 12827 - DNA, 1501 bp, Oryza sativa
tcgtcgtcgtcgtcggcgacggtgagggtggtggtggtggccgtgctgctgatgcagtgctgcaacgcgatcatggcggcgaggctgctggaaggtgacttatttggtagcagcagctggctgcagggccaggtcggcgccgccggcgagctcatcttgcaggtccttgacaatggagggtcgccgccgggaggcaatgattgccaccaaggtcccaatccaggcggctccggatccggaaaatgctggacgccgtaactagcctcgccgcgccggcggccggccggcgagcggcagcttatgtgcgcgccggtcggccgccatggatggattcccggaccggttttgctcgttcgctgcaggcgcgcgggacgttaattaacatgtacatgaagatctaattaagttcgacatatatatatactcagctcctgcatacgtagagattgttcatctgattcagttcttgcattctttttttccctgtaactgtaagagcttccatgtaaaagtggagctttgcaaagctgttcatagttgtagacagtagacttgtagtttagtctagtcaatttaggcgtactgatttggaacaaggtaagtcagggacatatatagctagctgggtcctgaaagtgtgtaatctgaggatcatgtgcatggatactgtccgacacattagaagaaatttactttccttttggttttccctttaatacaatagcgtgattcgcttttatatttgtgaagtttgcggtattgttggaagaaattaatgctgtcatgatgttgtagtgaagggtaaattttatggtattatatatggctgcaccgcaggcatattgttggaagttacgttagtcggaaatggttagtatgatatcattattttattatttttcggaaactggcaaaaatgattggaaaatttttatatttatgaattgaactatttagtgtcaacttcaatgccacgcttatagaaattgggaaaaataaaatttgaaaatggtaaccgtcgataaaaatattattagtttttcggaatatggtatcggtactgtcggaaaacttccataccacacatataaaacacacacacacacacacactacccttactattgactttatttgtcttaaaatacaaaagatttaggagctaataagcactactatggcatgtgtcatattaaaagtctgtgcaatgaacaatagctttgggcatgtttagattcccgggtaaaaatttttagcatgtcacattgaatgtttagacacatgcatgaagtattaaacataggaaaaaaactaattacacagatcacgtgtaaattgcgagacaaatattttaatcctaattgctccatgatctgacaatgtggtgctacaataaatatttgctaatgacggattaattaggcttaataagttcgtctcacagtttatcggcggaatctgtaatttgttttgttattagtctatatttaatacttcaaata

SEQ ID NO: 12828 - DNA, 1501 bp, Oryza sativa
tgggagtgggaggaacaggaaaccgacctcctcatcctcgaagacgaagacctctctctctcgctcgcctggcgccgccttcctccaccccactctctcctcctccgccgccgcatcctcaccaacccccaacagccctccctccctcctcgccaaaggtaaaaaaaaaacttagccggatctctcatctggagacttgctcatccttatctatcttttggggatttcttcatctcattctcatgcatggtgtaggccaaagtttattgcgatggatctgatgtttgcttacatcctttcctagtcaatttcctactctgcctaggagtatattagagcgagggagtctttttacaaaccaactctgaatctgaacaaaaaaaaacaatacagagacctgtctgtgccgataatatgaaaatctttgctttctacacaattactgcctttggtttttgggtaccactataaatccagtataaaaggagctctgagatatttatgattttagtgtactaacatcatcagtagctgaaacaggtgatgatgagtttctacgctctaatactaaggcccttcactctgaatatgatagcttattttttattttagggagatcaaatactctccctaaacagtaaacacccgaaattactagtctagccaaactccaaccatcaaacctagtttaaatctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggttttattaatagtctacgtttaatatttataattagtgtccaaacatccgatgtgatagggacttaaaagttttagtcgcatctaaacagggtcttagtcttgaggctacatcagcaaaccatatctatcttcagtttaaattcatatatcccatatagctctgtgccttggctaaaggtcaactggcatcagtgtggcaccacttcttcctgtttctgtaacattctcttcttcagtttctgcaacaaccggtgca

SEQ ID NO: 12829 - DNA, 1501 bp, Oryza sativa
tttttattatatggtaaaatttctttattgtgaaacattcaaagaacgtgtatcttctcgtagacacggtaaaaatatggtaattagctgttggactcccgagatattattttattattttcggtggaaccaaagagaccacgaacttagtgtcgaggatgtgtgagacacataccccgggcagcaaagctgctccatggtggccttctcatttgtctctatgcgcacacgacagaagaataccgagagggcggatgccggcgacggaggaacatggtttattaccggttgaccactaaattttgacctccattgttatcacggttttctataaatttcgatcggttttcgataaattttgaccaaatctattatttaacctttgaaattctaatcgaaacttaattccgagccgtgtcgaaacgtcgaaatttcatagaattcgaccggttttcgtcggaattgtgaacctgcggaggaaagcgcggcgaaaaattaagtattttttaaataggttaggttagattagattggtaaggataaagataaagataaagataaagagaaaagaaagggacacagcacagggccggaatgcggtttatgggcttacatggtgggccgggcagcccaacccattccgccccacctgcactgaactgaccggatcgagttgttcatccgcaccgcaccgcaccgaagcttctccctccctcccggcctcccttgccgccgccgccgccgccgccccgcgcccatcgcccgacgccgacgctcctccggccagatccaaccccctagctacggcgctccctttctgtccgtttgatgggcggcggcagaggcatgtagctagctagggtttcaacaatgaagtccatccaagactatcttgctcgctccaactccaagtccaaggtccctcctcctctccgcccctacacattctgaattctcgcgcctccctgtattcattctagttcgatacagctagtagaaaattcatcagctttgctcaattgctcaataagattataagaaaatttatgtttctccttccttttagactaggcgtaatatacatatatgatcagtcccttaactcttgaaaccgggtaaaaacatgtacctccaacctgtttaacaggggttttacccaaactggagatgggacctgcttgatcatcgtttgtcgtgtgggcccaccatttatcctcaatgacaagtggacctcacctcctatgctgctcaaaaccatgtcaaacggggacaagatttatcctgttttgagagtgtgagctatgagttgtatctagtttttcaattaagggatgactagaaaaaatgcccgtgcgttgcaacgggaaaagactattttaatcttattattattatatgttttaagtcaggtgaaattcactgtagaaattcgcttgaatatatgtattttacaaaaatcatgagctgtagttaggagtccaaccgtgtaagttagcatgcg

SEQ ID NO: 12830 - DNA, 1501 bp, Oryza sativa
atttaactaaattttgttcaaaattttggtatatcagtgacttccgatcaaatcggttaattcgaaaaagcaaaacctgatcccaacctttaaaacatactccctccgttataaaaagaatcaaatcctatctatgaattaatctggataacactacgtctaaatttgtagctaggaattgatttatttttgaaacgaatggtgtacatactatgtgttggtggcctgagataggtactccatatcaagcacgaacaaaacattacatcacgcatgaacctgaaccgatcgaaggttcttatttatatactactcctagcttgctttgctttgctaggattattcgattactaattgcaagcagcaaattaagactgcattaattgtaggtggatgattatggtcctcatatcatataggagtatatcaatgggtgcagtgagaaagcggcgcgccgcagaggcacttgttgtgctggaagcagtaggcatcgaagctgggcatgttgccgccggtgggcaccacgccgcagagcctgttgtagctgacgttgagcagctgcatgtccgtcatgttggccatctgcgccgggatgctgccgtagatggagttgtggctcacgtccaggaaattcagctcttccggcagctgcagctgcgacatgttgaagctcagcgcgttgcgcgacaggtacgcgctgacgagctccttcttccccgacccgaacagcatcgacgcgtcgccggtgagctggttgcgcgacaggtcgatctgcacgaagttgacggcgccgaactccgccgggatcctccccgtcaggttgttgtgggacatcgtcaggaacgcttgctgcccggccttgctcagcagcagccgcgggatgctcccggtgaggcggttgcggctgaggtcgatggagttcagcttcgggggcttggcgaggctcgccgggatggcgccggtgagcgagttgaaggagagatcgaggattccgaggtcggtgaacttgtcgccgatgaaggacgggatggggccggagacggcggtgtgggagatggtgagcaccctgaggccggagatgttggcgagcgcggcggggatggggcccgtgatgcctgggaccttgaagaaggtgatgtaccggaggcgggtgaggccggcgatggcgtcgccggggatggtgccggtgatgttgtcgtcgcgtgtgatggcgaggttgatgacgcggtcgtcggaggggaggtagtcgtcgccgcagtcgacgccgtaccagtcgcagcaggggaattcgggcgtccagtactcgaaggaggcgttgttgaaggccgccttcacggccagcagagcggcgctgtcgtcggcgtggcagctcggccccgacgccgccgcactagtgcagctcaacgccgccaccgccagcaggagcaggacgacggcgcgcgccatttccatccaatataatcttaatctttcctttccttgctgagttaatttatatcct

SEQ ID NO: 12831 - DNA, 1501 bp, Oryza sativa
aagaaactcgaagaaattgagttttggaatcggggcaattcatgtgcccatcacaccaaggtgagatcagtagagagaagaaaaaaaagagatagaacattgagcttttcgtcatctgtttatatgttcttgtgtgtcagttcattttgccatcaataatggtgagaaattctggtttgtattggaacacagccatggaatccatgagcattgaggagtacatcagcacgctgcaccgaaggcgtcgtccccgcggaattgcagcgaatgatgcaccggaggacgtcgtcggagatcaagctggcgatggcgggctacttcgacgccaacgacgaggcgtcggagatctgcaagcagctgctgacgaacatcaagaacgcgcagagaaactacctgtccacggacagcttcctggccaccatctccgacagcgtcgccgctaccgatggcaccgtggcgccgctcgccgccgtgcggagcaacccgttgtcccgttcagcgacgcggcgacacggagcagcttcgggcggatccacgacaggtactcgtccattctccacgccatcaagtcgagccacgggaaggtggcgaggaagctgaaggtggtgagggccatcaggaaggtctctcgggcatgcctcgtcatggcgtgcggcgccgcggcggctgcctccgacgccgtggccgcgcacctcctgttctttggcctcctcgtcggggtgcctggcccgctccttcccgccccactccggccgccgacgctccttccctgccccactccggccgccgccactcctccccgctgctccgccgccggcaccgctcggcccgctgctccggcaggagagagaagagggagagagagagaggatagagagagggggatagagaaaagggtagtgaggatgacaggtggggtccacgtgggcctcacaattgaaactgacatgtgggtcctataggttttattattattcggatcaaattgccacgtaagcgtcacgtcaatgccatgtcagatgaagaccgagtcaaattagccacgtaggcgccacctcagttaaaaccagggtcaaatttatttaaacggttttgtaagttggggaacctgtcgtatccggttttgcgatcaagggacgaaaatcagactgggtgacaaataaagggatccaaagtgaacttattccttcaaacaaagagtcaatattgagcctgggctgcacatatagctgccaacctcaacataggaaaagtctacatttcttccctcaagtataggccgagtttgattcgcctccctcaaccgtaataccaagtatagcacatccctcaagtatcaaaacaagatcaatttttctcatatagtggttttatcagtggtttcatctgacgtgtcgcgtactggtgtctacatggcatcacaattagaaaaacaattgtcatgtgacccatatataagtgccttcttcctccacctctcccatcctctcttcattgggca

SEQ ID NO: 12832 - DNA, 1154 bp, Oryza sativa
catcccgcggtacgcgttcacggggatggggtgcttcgcgctctcggtgcagcgagcactgctgctccacgccccacaggactgcgtcgcgtcggacgacgagccgttcctcgtgcctggactccccgacgtggtgcggctcttccgcccacagccgccagagccttgcctccgccgccgcgagccgctgtctctccgtcgcgagagaggagaggggagagagagttgaaagtgagggagatggggagagaggaggaagaagggggctgagaataacatgtgggccccactaaattttttattaatttgtatgtggcactgacatgtgggtcccacgaggtttattatttttctggatcaaattgccacgtaagcgacacgtcattgtcacgtcagatgaagaccaaatcaaattagccaagtaggcgccacgtcagccaaaatcactgtctaaatcgctaagggacctctactgcactggttttgacagttgatggacccgctgtatctggttttgcagttgaatgacgaaaatcggattcgtcgacaagttaagggaccttagataaacttattcctttttttaaagtaaattctggcccatttagcttgatggtatgacattcatcctcaaacttttgggctcacccattaaaaacgatttgggcccatccagacttatattaatagatgacgttgttgacttgcacggcgtttgatcgtttgtcataaatgttatttattttattattaaagaaacttgaaatatgacttatattttagtatatttatattattttttaatgagataaatgatctaacgttttcttaaaagatcactagatcatctattaaaaaacatacgtagtacaccgccactactacacactcatgtatattgtgcattagcagtcaggaattcaagatcaaagaagggcgatcttcttctcaaaaaggattttatataaaaatgaaaagaaaagaaagatgagacaatctggatcgatagctggatgcctgcaaactgaagccacgagtgttttttttttcaggtaaaatttcttctcccttttagggctcctttaaatcgtaggaatgaaaaaacagaggaataggaaaaacacattctgacaggaatataattgtaaaacaaa

SEQ ID NO: 12833 - DNA, 1501 bp, Oryza sativa
ttaaattattttaaagaaaaaaaatattaacattttcaacccaaaacaaatatattatgaaaatatattcaattattaatttaataaaactaattttatgttataaatattacttatatttatctacaaacttagttaaatttaaagtagtctgattttgaccaaagtcaaaacgacttataatctgaaaatggagggagttcaaagtatacttgtcattgggttataatgctatttttctgattaaattaagaaatataaggttatattgggtttagagtcacaattgtattttttttgtttaatgatatgattgaatattaataagtacccagctctaatggttgcagagttcagtttagtacattatcaaatctacaaatccgaactcttgaatatttgaaatttatatgtttgatcaactcatgtgtgcttctacttaataaatataacatcatggtttggagtaacaatttttttcttgatagataatccataaatttgaaattacagtatacaaagtcgaactccgcttaaattctttttttaatgatttagttactaaataactctaagtacttaacaagttgtaattagtttgttcatccttataatctaagtgaattgaatgaacaatgattcgtacagccactatcgataatattttcacattatatctagacgaggtatagatgacttataaaaatgttgtctaataatatattacaattaattatttaagttatatagataatatacatattgtatatatggtattccattaagctgtctactataccgtttggtaattaatacggtattcttctctcatctccattacttaaaaaattaaattctacatgacattctcttctctctctctctcttttttttcacgaacgcgtaaaaaaattacttcatccgtttcacgatgtaagactttctaccattgcccatattcatttagatgttaatgaatctagacatatgtatgtgtctagattcattaacatctatatgtatgtgggtaatgctagaaagtcttacattgtgaaacggagggagtacacgtcactatattagaaaaaatacagttttgttacacaacgcaactgaccagatcggtcgttgccggttacaaggaaggagtattctcttcttagactaagatgttataccattattcatgttctaattaagggctgtcgcataaaaaaatgctatacttattcactgtctcctgaaataatgtgaaatatttcatttgattatcatattagtatagaaaaagatttggtagatctatagatagatgatctcaccattatctaaaaaaaatagatagatgatctcatatttcgaaagttcaatggctcagctagtacaaaggaaactttcttccgtccttgtattccaacttcctcctactaactacggcgtattccaaaagccttggccaccattattgcgtggcacagcgaaaccacagacaccatttatc

SEQ ID NO: 12834 - DNA, 1501 bp, Oryza sativa
aatcctacccaaacgcattttcttcttcttttcattcatctcatccgattagatctcatccgattagagaaagtttaataatataggaccctaccagctccaaaatttaaaccatcatctaccgtcaatctaataactcactcatataatagttagctgtagaaatatattgtatcattaatgctccacccatctctctcaaatagtttattagagctcgtgctgtaactgactacaaatctgtagccggtttttttacaaatctgtaaccggtttttttatctctcttctcttgtctatcttccacacaagtacaaatttgataaggcagcttgtgtagccctcttttatccgactcagagcaggtacaatagcaagctattagccagctgtaaacatattttaatgagataaaggatgagagagaagagcagcgggctacaaatatgtagccagctgcagcacggactctaagacgtaatgtgtgtatgacaggtgggaccgagtattaatagtatagtaagcaactattgtatgaattaactattaaattggctagagatgaattggagctagtagtgggctatactattaaacttgctctcaactctacccgtgcagtcatctgcactccgctttgcgggtaggcacggctatctagctgtaacctgccgagaccttcgaacgattggttacagaaaagagaccgccttgggggaagggaagcatcaagcgtttctactgcaacttggggtgccaccacccacacgaacgcccctgatcccccgccgccgcacgttgcccgcggaccattcggtggtccctttctctccccttgcacgaacccgtcttgttctcaccgacgacgcgctggcatgtattttcaacgtcttcttctgtcgtgactcgtcagtgtaccagcttccatagacccttatctgatagagtacgtacgtacagtattcaggatgtgaatgttaatgtatgcaatgcacgcaggcagcaaaatactggagaactgtactactactaataaaactatcaagcattaaccaaacgaataatgaaggaaggaaaaggcaggatccgaagaatcagcaggaccatcccggttgctatagccagtgtgggggcagtggcagtggcaggagtaaatctatcggagtcctgccttcccagcaggagcagcagagtcgcggcgccagagcgacgctggctgcagcctgcatgtatgtcccgcgacggcagcagcggccttcccctcgctttccgcaaacgtggacgcgaacccgtcgtgaagcctcctcctcctcatccaatccacctcccccctctctttcccaatccccactgctgcttccgtccgcttccgattccaagtttccaactccctccattgctcgcctcgccgcgccgcgcgctacctaaaccccgcggcgaggctttagggtagatgcgagaggaggccgcgtggacggcggcgcgcatcatcagcgcgtga

SEQ ID NO: 12835 - DNA, 1501 bp, Oryza sativa
ccattgcacatttttaagactgaaaagataatttgtatttatttggctagtcagtcagtttgtagcatactaatgaacaggggccctccttgctttcgggattgatggaatgtgccattatcataggcatatgatcttgagcctcaattctttatcgacgatggtgatacatatccgaggatgtggggacctcattttaccattattgaaggggaccatggagtatataagcatgtttcttcaaccaagtgctattaacgaagcagttttggatccatttgacccatggtttgagcacaagttgtcaccacttacgtatccttcaggaatcaggagtagttgcaacttttttttgctctcaaggtacgtacttacagcatcagtgtgtaataatcaagttttgtctggcgacctttcggtaaccatctagagccaagtcatgggaaactggagttgggactgattcaactgagcttcgtgtggttcagaggctggcacgttactggcacttcctagttgcaatcgaatcaaatatcgacactcgtcctatactcctagttgctgcaatcaatcagagcttgacactcgtcctagttgcgatcgaataaaaagcttcacagtggcaggaactccaatcgacacgatgggcactacaaactgagctggaaacttttcgtttcatctagagaagtagagagagccaccacttgttcagtcctcctgttgtgcgtgtgcctgccgagcgccatcaaactgcaaattgctagtagtagtgcggaaaggctgattcgcgatcgatcgacaggaccaactggttgcgatcagttccatctttcttcacctggtttctttttttttcaccacattacttttctattttagtaaatttatgcatataaagtttatacacctcaagtttacacatctaaagtgtagagagcaaaaatttataagtcaaaagtttatatatccgattcaaatttgaatttgaattcaaatattttttatatatagtatttctatacatctaaagtttataaacctaaagtttatatacccgtttcaaatttaaatttgaattatatctgatttaattttgaatttgaattcaaatgttttctaatatatagtatttctatacatctaaagtttatacacctaaagtttatagatccaaagtttataagtcaaaagtttacatacctgattcaaatttaaatttaaattcaaatatttatatataatatttctttacataaatttttctaacttttgttttttcaaaataattttgtggtgtactatagtagggaagagaagaaggtgttaggaaatgataggcaaacaaaagataaagaataatagattaatcacagaagacacgagattttaacgtggaaaaccctcccaaagtaggagagaaaaaccacggacgctagccagcaaaatatcttcactatatctggggtgaggttacaacgccgcacggcggcttacaaga

SEQ ID NO: 12836 - DNA, 1501 bp, Oryza sativa
tccgccactgcaaaacacacaggaaaacaagctattagtccaattacggcgacaacacagcacagctcaagtctgggacgaggaggcaggggagcaagggagcgcttacggcggcggatggaggtgaggggggtggagacctcggggcgggaggcgaggtggaggtccccgccgaagagcacgagaacgagccggaacccgacggccgccgcggccatcgaccagaagttccggatcgccatcgccgccgccgctgccgcaactccgatctgcgcacagccaccgcttcgtcgtcacggctgtaaccggagccgcggcctggcgattgggccttctacgccaagtcgtcatggatgtcgcctttgcgtaattgagttgggcttcagcagccagcaccggttggatggcccaaatcatctgcaattcgggagtacctatacatctttcgaaagatttttataatcgtatcatacagatttttaatctttgtattaaaatctgatagatataataaaaagcaaaaaacaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattctttagtgttaaggcccacattagaaaactttggaagcccgacctggaaaaataccagcacaatgttttagagtggttttcaccaacaggcacaaaggttgaaacgggaaaatatgtggtgcaaaccatatatagtggaaacttagaaactaccgttggatcgagaaacgacgtcagagtttcgtccacgtcaccatgagttaaaatttaactcgcagattcactcatgagttaaaatttcactgggagttaaaatttaactcatggtgacgtggacgaatctcgaacatccatttctcgatccaacgatagttttcaagtttccactatatatatggtttgcactacatattttcccaggttgaaactgtgatcccaagttccaacttccaagcaaagtacacgtgtagttccatattgtattactacattctcataaaatatatactagtaatctaaaatcggattagatataacataatactataatctgaacatgtagaatatggataggaagcacatatcctaattggctagtagtatggatttagacagacaacacatattatatattatagtagactagtattacgggtctagacataagtttattatctatatccatagtacgtttaatccggtttgctaaaatcttctacttcaataataacccatatatgtaaacagatactttttttttaagataacatttgtgtcccaaaaaaaggaagcaca

SEQ ID NO: 12837 - DNA, 1501 bp, Oryza sativa
ctattcgttaatttgtctatcatatcaccacactctttgcacgttggattgctgagcaactacttgaccattactagatgatcgacgaagttagatttggtttttcatctcttattttgcaccactaattaggtcacttagcttgttcgatttggtcagatatgtatctgtcgctggcatgtaggattttaaataagattatattttaggtcacatgatggagcaggcgtggacgttgtcgtcgtggaagaaggcgagggcgtggtcgtcgacgatgtgggtgaaggcgtggttggggtaggagccgatcaccggggcgttgtagccgtggacgtagtacttgtgcgtcgccatgtaggtgtcgtcctccaggtactggatcgcgaacgggtagtactcgccgtcgtacggccacggccagaactccgccgccctccccgtccgccgcgccgcccggagcacctcccgccggtccacgtaccccgtcaccgtcaccttctgcgtgtccatgtcgatctccaccgtgctcacgcctgcacgcacgcacgcattttacacacgaaacacacacgtactggagtatactttacacacacgaaacagtactggcaccttcgagccgggacatggccttcctcacgcgcttctcgcagccctcgcagtccatgtggacgttcatctccacgatcttaggcacacatacacaaacagcactcagaaatgcatatggaaaatgtatagtactccatctccttctgacggtgcatttacatgttttactcacagacaaggcgtctgacgacgtgacgctcctctgcgtcctccagaaccgcagcattttttcttccttccagccggctgcgtgtgcgcgtggatatggatgtgcacgatatatcggagaagatcgcggagactaactaggcgtataaatactagcgctagcggacggatgccgtggtaagttgacatcaaaacacatgccgtgctcacgagcatgttgcaggggggatgctaatgctgaaggacggtttttgcttttggcatcatattcgggatcgatgcaggaactgatcggctgtgtgacatgttgggggaagagctagccatccatccaggcagccattctatcaccgagacacggatgctgcaggttcaggatgatgatgtgttattcacaaatcaagaatgaagaatctagccagtagccagggataatgttcggctggataatgtccagtagtggaggagattttggttcgtgagtggtcgtttcctgtcgctactcgcttaccattgtcttgctgcggtatagaacatatagtgggcctgattttgaatggacatacagattacacggcccagtttactcagtttctgctagcaattgcgcagacggcccaacctaactgactggaactttggactattgactgggcttaatttttgggaataagttcaccagaggtcccccaacttaaccacgagatttttttagtccttt

SEQ ID NO: 12838 - DNA, 1501 bp, Oryza sativa
cataggctgaatcttatttctaagaatccaagattaacagcataatgcacatgaaactaacacacacagaacaaaacttaaagcaaatagcagtagataaatgcttacaaacctctcgacttttggggcaatatcagtgacaaaaccaggaggcccgacaaagtctaggagataaacatctttgatttcatcaaatggaagagcatcactcctacagagagggtaacagtaagaataatgctatagtaaagagaaacacttgagcatcactgtatctgctgtgcagaggctcatatcatgacaaaatcatcaaacagctttgttcaattttgacctcccattcatcattttcataattcatgaaatattgaaatccgggaaaaaaatgtatatttcacctaggcctgactataccaaacgtcactacagaatagaaaccccaaagcataatctttcccctccaaaaagggacttgtcagaatgccaactagatgcaattttctcccactaaaatacaaagggaaagcttaataagcgcaaagcaatgccaaagtgaacattgagcagctccacagatgttggtcggtctaaacgaactgaaactacagttagacattgtaaaggaagagttgtactcgcttgcagcttcctgccgatttcacatctcttcaaacgaacctatggaggagaagaacattggaagcagaaactagtagttcgaaggcccaaaggtcgatctcttaagttacagaagatttacctgatggggtcgtagacggtgttggggaagaagcagacggggagcgcggcggcggagaagtagaggtgcgcggcgagcgccgcgaacgcgccgtccgggcacgggtagtggtacagcacggccgagaccctccgcgcggacggcgcgaaagccatagcctatcgctatagcacccacctggagatggcgacggcgacggcgacgacggcggcggcggcgaaacgagaggcggcgggtttattcgccggacggtggtggtgggccggtgacttgacgctacgggcctcgtgactgatcaggagaccgagctaaaaccggcggcccggcccagcccacgttcctcgcctggccacagaaccattgccacgtcaccgatccgctccactcgcaacgacgagcttccccaccatccgattcaatccaacggcaatcctccccccacccacggatccatccccgcgcctcccaccacgtcatcaatccacggaaacacaccccaacccatcgcgcccgtccaccaccaatccaacgtcccaaacccacccaccaaaagcgcaaatctatccccaaaaattctcccgcccaaacacaaactcaaaatccccccaaaattctataaaaccacccccaaatccaaatccatctcaccaagagccacagcgatttcagatctccccaagtagtagacttctctcttcttccatctcggattcgtctcggtctcgtctcggtctccggcga

SEQ ID NO: 12839 - DNA, 1091 bp, Oryza sativa
taggaatttaaaattaactaaaattcgaaataaacataataaaattaaaaagtagagtttagagtccgtataataatacaatttacaaataactaaaattcaaaattaaaaaaacatgggaagaagagtctaaagtcaatataggaatacaatttagaagtaactaaaattcgaaattaaaaattaaagaatgttgaaagatgaatttagagtccacatagaaatacaattagaaataataaaaattcaggattaaaaataaaaaaatattggaagaacagcctagagtctacatagaaatacggataacgaaaattcggaattaaaagtaatattgaaagagtagtctagagtccatatagaaatataatttacaaataactaaaatttgatattaaaaactattaataactaacacgtatataaaatacaatacgtatattacacattagtagtttcgtaaagttagtacaatatttaaaattatgttatcattttaatatatttgaataatacattgagaaaatatatatgctattatatgagagaaaatataatgatgctagccacttaatttgcgcaggccaccatgctagtttaaaattaaatgtgtagcatatatatgtaagttaggcatttaagagctatttggttactgcccgaaatttgtcacacaccaaactttaggcttgccatatttttttaggttagcatttggttggatataccacaattaagatacaccacattttgttagcatactgtcctacatgccatattctcatttggaaaaagttcgaattaccccctaaaccattgtggtgatcgatagtacgaattaccttcctcaattcaaaaaccagatattttttaccctcaattttttataacgaacgaattacctccctaacagactctaaaatggttttgatcatacgtggcgcacatgtgatagtccagtcagtataaaaaatacaaaaagagtagggcccacatgtggtgatcgagagaagataccaaactgataattgggcccaccattttttattttttttcatgttgactggactaccatgtgtgcgccacgtagg

SEQ ID NO: 12840 - DNA, 1501 bp, Oryza sativa
agagaaagggaggagaaagaagggaaagagagggagatggatgatatgttgggccacatgttcagtgggtcccatatattttttttgtgtgagtgataaataggtcccatatatatgtttttaattctaatgccacctaattgccacgtcaatgtcacgtgggatgaagaccaggtcaacactgccacgtaggcaccacgtcagcgaaatcgtctttcaaaaccgccgagggagtcaaattgcatcggttttaataattgaagggtcaaaatatccggtattatggtttagggatatgaatcagatttaaccattagttaagggagttaaagtgaacttattccccatcaaaatcaataaaatgttgaaccatactggcacagtccagcaaagtttcgtatccagataataacatctcaaaaataaaattcttttttgagcggtcaaaaaaaaatctagtatatgccaaccagctacaatactcctatatcatttgactgaggaagtggattcttggtgatgtggtcaagcattccccttagagcatcaccaacagtctatctattccattcccaatcctaattttttaggattttggttaaaaaaaatttggggcaacagattcccaaaagagctccggacgttttggagttcccatctccagttttctaggtgcatgtatttgagggcgagagaatgactctcaattctctttcccacgcgtttctcctctccttccccacgcgtgggcggcgtcaaggcaggtcgcgcgtgggagattgcgatctcctgcgcacgggaaaggaaaaacaaaactagaatttctattggaaatttaacataagaacccacttttcgtttttggaataaatttaggctatcttttgaagggaggggttttttcatcacctattttcagttcagaatacccaaaaattaatttttagagatagattattggtggactattggtgatgctatttaggcttgtagagttgtaggcaatgaaaggcactctgttgtgttgcaggtgcagaagatccggagctgagtctcgctttccctcacctttactcctttaggccaaaattaagggctgagcttaattagcgtgatccacaatctggcattcgattattgggctgccgcgcgagcccccaccagccgtgtcgtctgttgactactgagatggctctccccccttaatttacgtgtctttccctccacttcacacgttgctatccacggcggattccaaacgtgaaccgctctcaaaccggtttgatgacttgatgtcgtcgtttcattggtcaagaaactgctctgcaacgtctaattaaattcgcacagcgagtcagtgacagtgtgacacagacgttctctgcttccacctctagtacgtttctactctacccgccgctccgcggccgcgcgagtccaccgttccgctccacgcgcgcgcgagccctcgattcgtcacgcacacgcgcccgcgaataac

SEQ ID NO: 12841 - DNA, 1501 bp, Oryza sativa
agagaaattgcttactcaaaagtcaaaagataatagccaaaaatatcttatgtagcatatgaaagttgatttacattaaaaataacaacaaaagcagtgtaagaatgccaattattttttttaaaaaaataatagccaaaacatatattttttaaaaaaataaatatgcaacttatttattaactttcatgttgtgtaagaaggccaaataaaaaatttcatattttttaaaacttttaatgagatagatcgattgttaaccttgaatgactacaaggatatttcagtttttttaagcctagtccaatgacgtgttgtaaaacaattgataaagtcgccggcatattatagaaagagacaatattagtggtaaattgttaaactagaataaactcattgatataaattagattctcttttatacatggtatccatttagatctagttatgtaatatattaaaagatcaagaggtaatgtgtagattcagtcgccataattgaagtttttttttaaaggagtataaataataataagcagttgcaatgtggttcaagtctgtactgtaaaggaatcttgcgttctgcgtgtttgtctagttcgtccagagttcgtccagattgcttcattctgtaattctctaattctgtatgccatgctcttcagacgctctgtaagagcgactgataatactagtgaagtttgaatatgtatgcttcggaatgatatacatttctgtttacgttggacgcaatgagttttgataatgcggatcatgcagaagataaccgttttccctgtacaggacgagaactttgcggagcagccgaatttctaatcagtacgttgcgtcgttgcattgtacagttttcagtttcgtatatgagagacttataaagcatttccctgtacaggacgagaattttgcggagcagccgaatttctaatcagtacgttgcattgtacacttcagtttcgtatatgagagacttataaaacatagcctaccccctttcgtttttacccaagtaaatactacaaaaggaagagccccaagccaggcagtgttggggcgccaactgaaaatagagcccatcgacacaatcgctacgaattgacaccaccaccgtctcacactcactgccgttgggagagatggaaaagagaggaaggagagagaggagagtccttaatatgtggagccaccatctcgttgctgttgggagagatggcgaggagcggaagagtccctaacaggtgggatccacctactgattcaacgagttaactgtggttaacctgccactttaccaggtaccgcttcccaaaccgaaaggaggaaaaaaaaggacatgtgcaagcacccaccgtgagttaccacgggatgacagctaggatgaaggccctctgttcacagtgcaagcatcgagtcggacccacagtgcacgactttaccaaatcaatccccaaactcctccctcatcacgcactctccggctcct

SEQ ID NO: 12842 - DNA, 1501 bp, Oryza sativa
tttgggcaaaaggtgaacagcgtttggacatgctgacttgaacatataatcctatctagcaagcagtacgtgcattgcatgtcacaatattagatattccattatggtacttaccaagtacaatatgatcatatgaaacatgttttacttaaggcacctcacaatagagcattatttatttctcttaagaatcaaagaaatcgagcacaaccagtgccttcttgtcttttgttgctcaagtctttgaccttttcttgccagggaatgtattttgttgacatcaggttttatgggttacttgcacaatacatcaataagcctaaaagattctggaaatgttaggagcatagatcaaacagggaaacaccacaaggacgattggcccttagtgggagaagtgaagttagactggggagatttacattgggaggaattagattggtgggagaagtgaagttagactgggaagatttacattggaaggaattagattggttacttcttcattaaatccatagagtgtatggcttggtgtctataaccaggatctaacaaacatattttctaaaagacaaaaggaaacagcgaagctaatctaatcaaatcctgccttgctaattttgccataggaaaaaaaatcttagttaatggctgctaatcacatcagttgctccagcctccttggccacgggtccattttggctcccacaaccatgataggaaagtaactgtaatgtttggatgaagaattcatacgttcagaataggacgatgcaggagccaggataggtatgcgttgcatgaatggctaatccctgcaattttgactggatcaactgacgaaggacagatgttaccttttatgtgtctagccaacaacggagattgtctagcatgatgtttggcggcaaaacaaggggtaaacccaaatttgaaagtggtgcatcaaattgtattatagatgtaacaagtggcgcaaaatggaaacagacaaataatgtatgtgggttcttgtgtccagacctcaacctgatgatgcatcatgtgacgccagatcacgccaataagcagaaaaggcggcatgacgaagttaactgacagatctgcatgagagaaaattcatgattaaacggttaagatagtttaaggccataagggcattgctcataggatggtaatttcatcaacaataaacacgtgtatagcagaggaaatgatgacacataactcattgcaatcctgcaaatacagaaaaaaaaagtgagaaaaacttaaggcaaccccttcaaaatctatcaaatttatatgcttaatgcaaacagaaatctagcttatcaaaggggggaatcacgaatgcttaccagaatagccttttgataaaattacacagaatgcattccatgaagaactatagtgaacttgtagatttagaacataaaagttatttgcaataatttgcataacagtagtcctccaaaaccattatgcttcagacgttaat

SEQ ID NO: 12843 - DNA, 1501 bp, Oryza sativa
tccgcagccgctgcgggtcgagcggcgcgacggccgggaagaagtccgacacgttcggcaccccgacgacgatggtgaactccgagatcaagtcccttaagtcccccaccgacgactcagctcgggcgtcgccgaaatccgcgaggtcggcggagaagatggtgctggagagcaggttcagggaagccgtgaacgcggcgcggccgacgtcgacggccgcgccgtcgcgcgccaggcgcgcgacgtgggacacgagctggcgcaccttgtcccggcggaggcgctggtgcgcgtcgaggctgcgcggcgcgaagagctccgcggcgcacaccctgcggagcgcgcgccacagggcgctgctgggcgggagcatgcccatggagaagccgtcgtgcccgcacgcgcgggcggcgtccggcacggagcgcgcggagaaggcggcgtcgtggcgctggaggatgtcgcgggcggcgcccggggaggaggcgacgacggtggtgacggtgccgaggcggagcgtcatgagcgggccatagcgccccgcgaggcgcgcgagggagcggtgcggctgggagccgaggtcgaggatgttgccgatgagcggctgcgggcggggacccggcggcaggttgcggcgggcgtcgacgaagagacggaggaggtacagggaggagagaaggagaataacgcacggcgtacacaagaggaggagctccatgattgaccgtacaaaacgtgtgcagggtcggaacgatactcgtatgctagggtggatactcctgctaatctgctagtatatctactcccatatagagtgtgtactggaagagatggcaagacacgccaaagatgtgcaacgtgtttgattttgagccaacgagagagggttttctgatatagtcatttaattggaatcgtaccattatcattttacacatataaccattcgtcttattaaaaaaatttacaattattatttattttatttgtgacttactttattatccaaagtactttaagcacaacttttcattttttatatttgcacaaatttttttaataagacgagtaatcaaatagcgcaaccaaaaagtcaaaatcccttgtattatgggacggagggagtatgtcagtacttacctcttagatgaatttacaaaatgtttgggaccaaattgtcattttctctttccttcatccttctttccctttgtcggtacttaccttcaaggccgccgcctccgtctactcccgcttctgtaaaactatattgtataccttcgtgtggtgtctgttaggttggataagatagagtttgttaggatgttgttagtctcatctatccaactgaacagatcacgtgtaatatggatgtaaaccacggtgatggttgttatcaccatatattaacaaaggtgcggcctctaacgaggttcaacgcttctgcacctctgattttcacatggtatcagagcccttccatccaccaaatcgcatctaa

SEQ ID NO: 12844 - DNA, 1501 bp, Oryza sativa
cgctattgccaactcacaatctaaaacagtgttcgggaggtggagcacatgaaaacttggtggtttattaatggttaattaactaagtattagctataaataatttaaaaaagaattaatataattttttaaaccactttcgtatagaaattttttgtaaaattacaacattcaataatttaaaaagcgtgcatacggataacgagacatatgagttggaaaagtaaagaaaaaaactcggcctaatataccggtataccgtaaaccgtgaccgtagcgtttgccggtcgaactgccggccatcctccgtcgtgcggtagtcgagcagcacgtccaggaagtcgttcttgggcggctcacccgcgtcgcgctcccgcatgcgccgctcgatctgctcgtcgaactcagcgaacagtcgcgtgaacaccctcgacagccacctccgcagccgctgcgggtcgaacgccgcgaccgccgggaagtagtccaccacgttcgggacaccgacggtgcccgcgaactctgcgaccgtgtccgctaactcccccgccgatccggcgcgtccctcgtcgaggtcggcgaggtcggccgagaacagcgtgcaggagagcatgttcagcaaggtcgtgaacacgacgcggcggacgtcgacggccgcgccctcgcgcgccatcctcgcgacgtgcgacacgagccggcgcgccttctcgcggcggaggcgctgctgcgcgtcgaggcggcgcggcgcgaagagctccgcggagcacaccttgcggagggcgcgccactgggggctgctgggagggagccagggcatggcaaacctgtcgtgcccgcacgcccggacgatgtccggaacagggcgcgtcgagaaggcggcgtcgtggcgctggaggatgtctcgggcggcgtccggtgaggacgcgacgatggtggtgacggcgccgaggcggagcgtcatgagcgggccgtggcgctccgcgaggcgtgccagggagcggtgtggcttggcaccgagctcgaggaggttgccgacgagcggcagcgggcggggacccggcggcaggttgcggcgagcgtcagagaagagccggagaaggtacagggaggagacgaggagaataacacacggcgcatacaggagcaggagctccatgattgaccgtacaaatgtgtgcttactgcttagttagccgcaaaacggtgcggcggactggcattgtatattgagataaggttgggggcgaggaaaatgagaatgatagttatgatatgattaattaagttttaattattaaaaacttaaaaaatatatttatcttatattttaagcaatttttatataagaagtaaaaagcattcgtaggaaatataagataaatactaaatcaatcttaatagagaaaaacaaaggtttgagtagtgacggttttctcttgccatggttagtccttgtactgttctttatctttacgggccaagcttctccattatactttcc

SEQ ID NO: 12845 - DNA, 1501 bp, Oryza sativa
catgcagggaaagtaacatgtgtgtattctatatttctaggggattacttgttcagtctgaaactgtgaaccgcatgagggaagtttccttcaaagcgaagaatgtatatatgggaaggcttagttagaagcagcgtgatccaaccagggtttgctttggttggacgaattggtcttcagacacttcaacgcaagctttagtattttttttttctcttttggttttgtattaagcccctgcctcgtgtgctgttctgatgcacgctttctttgtaccaaaaaaaatggagacaaatgacttattcctgaagtttttgtgaaagcttttgccgtgtcttgcctgttccattgtttttcttttcttttgctgtgtttgtgctagtgtattgcctaccttcttctttttattaattttctttcttttgcattagtgccttgactaccttcctcttttctttcctttttcttttgttatcggttaccacagtgtcttgcctgtttggtgcaagccgagaggcaaaaccacctcggttaataaagtcttaagagaaagggactaccatggtcaccgtgtgtacgggccaaccggccaagaaaacataaaagtctatgagaaaggacgatgtacatatacccctattaatgtgtatagtagatttctttcagaacatttaatccgtttgcagatagtgcaatttttattgttttgatatcccccattagatgaatatcttaaaacacatattctataacaattgaagaaaaaaaaggaaatacatttcttttttcaggaatagatagatattcaagaacaaataaaaaaagaaatacatttttcaggaatagatagacatttatgtaccagagggataaccaaactattccctctaaaaaagttagtttttactctgtcatttttctttaaaaaaatagctttgctcatttttaccctgcttcaaagaaaaaaaaacaattatagcatgcttgtactgtgaggagcagaggccaacgccgtcggtttgctgaatcagcaaaagccgaccaccgaccccacgttccgcacgcacgaaacgaaagtacgaaacccgcgccaacacaacccaaccaatcgtttaccgccacgtgcacgccaccccccaaccaaaacaaaaaccaaatttaaaaaatactacaatataaatactagtataataatttcttctcccataaagcttcgaccgaatccggctcgcctcctattaatccctctctctcctctccttttttcgatttgagaaaaaaaaaatttgctcgccttctccttccctcgcggcgaagacaccggagccaccactcgccgcccgcctatttcacgccgccgcgccgcgcagaccgacctcgtcctccaccccacccatctccgacgccgcggaccccggcggccgctcctcctttgctccattcatcgccatgacgcgccacgccggcgcccgccgccggggcggcgccggcgtcgtcagcc

SEQ ID NO: 12846 - DNA, 1501 bp, Oryza sativa
agaattaaaaactatacgtgggacccattagtcattcacacaaaacaaatttgggccccacatgtggatctgagtggtttttgtttcttgttgatggaacctgttcttggatttggggatctgagtgccttttgatgatggaaagcaaaagaaaagagaagaaaagaaaagaaaaaaaaatcttgcattgggttttgatctctcggtttattgaatccttcgtcgcaacccaagagaggaatccaagctgctgcattggcggcggcggcgaggaaatcgggagcaatggcggagaagacggcggccgacggcgagctgtactactgtgcccatactgcaacagcggtttcgtcgagaagatcgagtctgcccgcggcgccgccatcgccatcgccgccggtggcagcccggaatccggtggcggcggcgcgatctcctccatctgggcatgcatcatcgacggcatggttggcaacggcaacgaagatccatcaaccacgtacagccaacggtagaagatcgaaggatgtgctgcggatgggcgtggcggtggcggagaggcagctgtccgacaacgacctgcttgatgagctcctttcgacggcgaacgcagcgagctgcgacctggtggtccaggcgtcggcgacggcgctgccatcctctcccgcatcagctccagcccaccgccgccgccagccgaagctaggtcgtgcagccctagctttcctgccgccgcgcgccaccggccgaagggaagaaggggagagagagagaagggagaggaggaagaaggatgactgacatatgggccccacatatcagtgggccccacatttctttttgtctgaatgactaataggtcccacgcatatttttaaattctaatgacacgtaagtgccatgtcaacgccacgtgtaacgaagactcggtcaatatcgttatgtaggcgccacgtaagcgaaaccgctctccaaatcaccgagggagtcaaattgttccggttttaagagtttagagtcgaggtatccgattttgtggtttaggcttatggactaaatttcaatcaactttgagagtgaccaagtgaacttattcctagatgaaaacaccatatcatttgtcacggtcaccgagccggatcaaccggtggaccgaccggaccggcacggaaacagctactgtacctgaccaccgtcacgtgacaccacgcccggcctcaccaccctatccaattccccgtacatatccccagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 12847 - DNA, 1501 bp, Oryza sativa
ctgtgctccagatcagcaactttgtcgtgccatcgggcgtccttacgaggccacaaccgctgctcccgaccgccgtcgctgccgctccccaaccgccaccgccgccaccgttcccctccgcctcgtccccaccgccaccgccaccgttcctgagagagagagataagggagagagggggaggaagaagggagagggaggatgacatgtgggtcccacaatactttttttatgaatgacatatgggtcccacatatttgttttatttttgtttttatcctaatgccatgtatctacatcagagattagcctagacaaacccaatccggtacctacggaggccggcaagagagatctagtgctatctctgatctcatcgagttcatattcgaggagaaaggctacctcgtcgtcgagtacgagttagtgttcatgccgccaagtcgacgatggctagataggttatcccaatcgtctcaattgttgtattctgtgattttctatatcaattccatataaacaggatgtagggttattgcctgtcagataaggggcctgaacctatataaaagtccttgtcttcatatcttttacctcaatcttgcatatacccttgtcggtaatatgggcccgggggtacccacactaagagagaagggtcctttcctctagccacgtggccgcgtagcttgtcccccccatcgggggggggggggggggggtcgggcgcacgggtaatgagcagccaagaggcgcccatagctgcataggggcctcggggtatcctgtcgcgcccctcgggcctgaggggctgcgtcgccccgaggccctcactcggctgccacgttgctgctgagtgggcagagaaagaggcgctgccaggcgcattgatgggcgacgccccaaccaccaccgccgcatttaatgtggcatggctagtcgtgcgacgttcgattgattgatgtgcgtcaatcgcccttgaccaggctgagactagtcgcaggcggatgagacgggtggcagcgcacccatgctagggctatcaacgagccgagctcgagcgagctcgtctgcctaggctcgagctcgatataagctcgagccgagcctataaaatgttcgagctttttgacaggctcggctcaagctcgatccagctcgagcttgatttttaagtaacacaatatatatttcaaagataatcttataattaatttctagttcatcgtattaatagaagaggaaaaaagaacaaaataaatatatgatgtcaatataagacatacaaataacatatttgatctcctaatttattaaataacaacaaaaatcatatattactagactcgttagaagctcgagctcggctcgacaaagctcgcgagcttagggataggctcgggctcggctcgtctggagctcgagccgaactcgaatcgagcctaggacgagccgagctcgagtagttcgcgagcctcaagcttttttgacaaccctaaccca

SEQ ID NO: 12848 - DNA, 1499 bp, Oryza sativa
ggcaggcggccgcgcacgcggcggccggcggatggggagcgacggccagtaggcggaggcggtggaggtggcggccctcctagcggcgggcatggtggtcgtcggcgtcggcgtgccccgcgcccgctcctcccaatgggatcctctcctcctcgtcggcgtcgtcatccccctcgtccccgccggatcccgccgcggcgcggtggccggcgtcctccttctcctccgccgccgcatcgagggcgtgcccctcttctccctcccagccacctctgcccgggtcggcacgcacgcctccagcactttcaactccttctggccatcgtcgtcggtgcgtgaaatttcgacaatttgtacctgtttttctttcttttgttcagtttcttgtttcgagatgatgaactggtttcactgagatgatgcttggtttgatctctggtgatgcagtgctttcggtgttgagcattgctggatcagtcgccattgtttacctcatgtacagatgtgtcaagaagaatggcctcccggccgtcaatatcaacaccaacacgagcttcgcgccggggacggcccggcggcgatgtacacggtggtgccggactcccagatacgcaacgccaccatcgagaggtttcttaaagagatcgccggcgagaagcccatccggttcacggcgcagcagttggccggattcacgaacaactacttggctcggctcggcgccggcggtttcggcaccgtgtacaagggcatgctcccgaacggtcacatggtcggccgctgcgcgctcggccgcctgccgccaccgccgctccgcgcctccgctccattccgcttcaccggccgccgcgcgctcgcacgccgcctccgccggccgccgctcagccccgctcgtcgcccggccgtctgctccctacctgtcggttggcctgcgatagaagagtggcagagagagagagaggggaggaagggaaagaagagaggaaagggaagttgatgtggcatgctgacatgtggggcccacgtgggtcccacgcccacgtaggctaaaaccgggttaaaatcaccgaaggacctgatatggccggttttgtatagttaagggacgccgaatatctggttttatggttcgaggatgtttctgtatcccgatgacaagttgagggaccttcggtgtactttttcccaccatttactgccaaggctgggtgcggaataagtacatatgaggtcccttaactttgtcaatgaatccgattttcgtccttcaaccagaaaaccagatacaacgggtttctcaactatcaaaaccagtgcagatgaggcccctcggcggttttgagggtggttttggctgacgtggcgcctacgtggcaaatttgacttagtcttcttttgatgtggcattgacgtggcgccatacgtggcaatttgatccggaaaaataataaacttcatgggacccacatgtcagtctcacacataaatcaataaaagaa

SEQ ID NO: 12849 - DNA, 1501 bp, Oryza sativa
agggcaaattcgaaaggaagggggatgtgcgggagctcaccggagcggaggcggaagcggcaggacggcggcacccacctcgcgggagggatggatggaaatcggcgcggcggggctagcgaggagacctccggagagtgaaggtcgagaagacgaccgagccgagtatgcggcggaggcagccggacgccggcgacgctgctcgccgtcgcaggtgatggggatcggcgaggccggatggatggatcgacggcgcagaaaggcctccagtcgtcgtcaaaggggcccatttgtcaggcagcggcctcgccattttgctttttcttttttttcccctaccactccctccttaaaaaaatactttagctcgaggggttgttcggattatagccaaaacaaatcttattaaattttagcaatgctaattttaataagttgataatactaacaaatttttggtatttctaatgtatttaccaaattttggtaaaaaaaaaaggaactaaatgtaggtacatctatagcaacttagttaaaaattagtatggttagaaatgacatcaaactgaataaccccttgaatctagactccataacaaaaaaacaacttacttaaagtgagttttttttttggacggagggagtatttcaaatcggtttctatttagaagttacaaccgagtaactcaatggttttgggtacttaaacaattgaatttattctgacatttgcttcaaaaaagttacaaccaattatcataaaagtgagtagcggattgaaatatgatgaattataaatttgagaaaaccacattacattttttagcacatataaaactggatttttgatatatggccttttgtagaatacttgtggtaaaattgtaaaaaaagaatgtgtccttagctctgtggttcatgaggtggcaatctccgacaaactccaccgtgaactctcaccttaaacgtatcaaaactttcgtgagatggtgttgccagtctaaagttgttgatacgcaacaattatgctacatcaaggaggtgcatctataatcaatgccttgaaaatgtatgctactgctgaactccgttaccaaatattgtcattcatcccaacatttgtagaggtgaattcaacttgcagacctgaactaaatatggcccaaaaaatcagatcagtatatcgtgataaattatctgaatattggagtacgtttcacaattatcattcagctttttagcttttacatctgcaaatgacagcaggaaggaagtttatagtatatggcaaattaataatgtggcaaacaacgcgtaattggttgttaaatttgttcatgaatcataacgcattaattctcagtgtctctcaatacatattttcgttcattcagaaaacgcatgtcgatcgtcaggtgcacagattgctgatcattagagtcagtataggacaaattaaggatttgatatatcacaattgacagtaattaatttgcttgct

SEQ ID NO: 12850 - DNA, 1501 bp, Oryza sativa
ggtgcaccccacatgggctccacttgggccggggtcccaaacgaagttacaagcccattggcccaatataggtgacacaacaccttgtttcttcaattgcggccgactgagatggaattcggagatgaggctggattcattggaaagaggactccaagagttttccatcaagtactcacgggctgaaaacggaggtcgtatacagattaggcggccgttcgaaaccagcagtgtagcaggtggccgaatcggattccagcacttgtaggacttgatcatgatatcttcttgttcatccatgatgtgaggaacggttgtatccattgtagccatggtcacatcaagttattaattgcttagacacggtgtctaggtagttaatttctggtgtttgctccgcatcccacagtaggtgtgaggtaggcgtagaggtggtgacagcactcaatatcactgaagtcatccctgtccgggtgcacagtagagcgatatctgggagcagcgagttggccagtgcccgaagtaccacattaggattaaagtttagctttctgtagacatagtttcttaccggtaaaacctctctatccttttgcctatctgtagcttcgtgtccttggatgaactagtgaagagctgacacacacgtttcctgtggaaatcgataccttagaatactcccgggtgaagtgctacattggtattttccgtgagcttgcagattctatctgtgaggttaagaaataccaacaatgactagactttttatgggctttctacaaccagggccccattggtcatttgcgggtggaaattgatccctcaccccgcataacttatgggctctgccccgttcaatccatggatgcactatccctggccccgtaagggcgggttgtgggcgctcgaaatttatactgtccagtgcaatttgtgaccgccacataattttggatgagtcggatccatacatgcataaatagccacacacacctcaatgtgcccatggtcacaaattgacaccaatcgatataaaatacacaatgccgaataatgagcaaagcagatattgttcagactcaacatgccaaatgtgttacacatctctcaggagcctacacgtggaagcagatggtgagaggggccgaagtcggctcaggcgaccttgtggttcggccgaacttctagcccacctcccggccactccttcggctgggagaggctgtctggtgggccctcaatatgctgtaccatggttgtgctcaattttaggtggttttgattgacatgtggggtctccattccgtgtaaacacgtccgattgtacggaggtgtattttgtcacatggtgggtggttttcatccatatttcacctgcatacaaatattcactaagacttgtggaaatagttagtagcaaacactacctctaagtttggtattccattttatattcttctatttgctattatgtaggaatcgatggtcgaattggtactta

SEQ ID NO: 12851 - DNA, 1501 bp, Oryza sativa
gatggttgtagcttggctatagcagctagtggagaggctcgtgtggaggctctctgagaacgagcgccaacaaaagtgatagtttgttgcgtgcgatgccataggactgcattggagcagccactagaggaccaattatgccgttcttattgaatgtacctttccatatgttgggcttgatcaagaagatcttgcaaaagtgttgaataaacatctccaaaaagtcagaaatttcatcattgagaccatgcaaaaatcttgtcattttcgactcatcttctttaatgtgagcacggatcaagagcaactccatttccttgtaatactcatccactgtacgagtcccttgacacaacaattgtagcctattgttgacgatccttaagtaccaattcgaccatcgattcctacataatagcaaatagaagaatataaaatggaataccaaacttagaggtagtgtttgctactaactatttccacaagtcttagtgaatatttgtatgcaggtgaaatatggatgaaaaccacccaccatgtgacaaaatacacctccgtacaatcggacgtgtttacacggaatggagaccccacatgtcaatcaaaaccacctaaaattgagcacaaccatggtacagcatattgagggcccaccagacagcctctcccagccgaaggagtggccgggaggtgggctagaagttcggccgaaccacaaggtcgcctgagccgacttcggcccctctcaccatctgcttccacgtgtaggctcctgagagatgtgtaacacatttggcatgttgagtctgaacaatatctgctttgctcattattcggcattgtgtattttatatcgattggtgtcaatttgtgaccatgggcacattgaggtgtgtgtggctatttatgcatgtatggatccgactcatccaaaattatgtggcggtcacaaattgcactggacagtataaatttcgagcgcccacaacccgcccttacggggccagggatagtgcatccatggattgaacggggcagagcccataagttatgcggggtgagggatcaatttccacccgcaaatgaccaatggggccctggttgtagaaagcccataaaaagtctagtcattgttggtatttcttaacctcacagatagaatctgcaagctcacggaaaataccaatgtagcacttcacccgggagtattctaaggtatcgatttccacaggaaacgtgtgtgtcagctcttcactagttcatccaaggacacgaagctacagataggcaaaaggatagagaggttttaccggtaagaaactatgtctacagaaagctaaactttaatcctaatgtggtacttcgggcactggccaactcgctgctcccagatatcgctctactgtgcacccggacagggatgacttcagtgatattgagtgctgtcaccacctctacgcctacctcacacctactgtgggatgcggagcaaacaccagaa

SEQ ID NO: 12852 - DNA, 1501 bp, Oryza sativa
tactccgtccgtgtgtgtggattacagcgctagctcctgtcgcataatttattacagcacatgcttactgtacttctcgtcgtgccacggtaattactgctccactaactactatacataccgttactactactcacttcttcctaaaaaaacaaaccctggtttccatgcccagagtttgaccatccgtcttatttaaaataattaaaaaaaaattaaaaatacaagtcacgcataaaatattaatcatgttttatcatctaacaataatgaaaatacgaattataaaaaacctcatataagacggacagtcaaagttggacacgaaaacctagggtttattttttttttggacgggggagtatgcaaaagagagtttttgacaaatagtgtgacgtgtcgaaatgctcatttgcacgatcgatatatctgccgttctattcttcttccgctgctgttggagagacgcaggcaggctcagctccagatatattctcttaccttgtttacgcatgcctagtagtagtaatacttacaaactggctagtaaaacctgttctgaatatgctgatgcttacttccttcgtctaaaaaacaaatttaatataatcggtattaaaacagatacttcatatgttcataaaaaaagtcaaatcccgactctaaatcgggatatacatatgtttagattgatatataagattgtttattttttattttggaacggggtggagaagaaaggagagcaaaacggttactagtaattgtggagtttatgtgttttaagtagaaaaagaaacggtttgtttcattgtatgggccatgaatcagattggttacttggctcgatctgcagatgtcactaatgcaagatcaaagcttgatgagtaaacagcagtcttttcaagttaagtatagtggtagtaggctagtagcaaaagacgacgaccgtgtgagtgttaagaaaatgtgcgtaggtgacctccaaatcaacacatgcatgttagcacgtaggtggcgtttgtcttttatcaactacagctcgtgataattatactgctactgatagtctgataactgtgtaacaaagcatccgtgactgactgatgataaatttgataatacgcgtcgttagtttcgcaacacatctggcgccacacaattttcaattgctcaccatgattccttaatccccttcacctcgtcgatgcttacatgtgttaacaaatggtgattcgatttagttaaggatgcacatcaatcgtactgtacagattggggttgctcagtttgttaggtttggttaatttttctttttaacctgtcgccatggatggatgaattcatggatttcattgagagcagctggagaagaaagaagaagagtgacgtgatccattcattcgttcgttcaccttgactgaccactgcaacttcgtctcctctccccttaaattccccttcactctcctcactccatccagctcaccaccagcagcag

SEQ ID NO: 12853 - DNA, 1501 bp, Oryza sativa
atcatcaaaatgttatttaagcatgacataaatatttttatattttcaaaaaaaattttaaataaaataaatgatcaaacgttggacaaaaagtcaatagcgtcgtaaattaaaatacggagggagcaggtactcctcgttcagtttgcgagtagatagatcagtgacagcgtgcacaggtgcgtacgtgatgcgtggatgcctcgtcgccgtggccatgtccatgtgctcgcggtcgcggaggaaaatatgccacgtccgtttctgcgttgctgggctgcaggttggcaggcggcggcacgaacgaacgaacgtgcggcgcaccactcgcgcacaccaccccccgcacgtcgcagaagcagatgctgatatgcggatgcccaccggagcagggggggctttttgtggtggttgcgttgcagccgtgcagcccgtgcgatttgggtttggggcgtgcaatcatcatgatgcggcatttagaacggatcagtggatgagggtacggtgatgggagtgcggcggtggttgccgtggcactgccaatgcccaaaagctcgttcattcattttctctaaaccccgatcattatccgcttgtactatcattactgattcaagagcaacagtatggtcctgtttgcaggttctctccgaattagaaactctcccaactaatacagtgtttattccagattctaagaaactatagttgtagaatctaaaaaaataaactaagccataagctataagccataagctagaaaacccagctttttctagatttttataaactggctactaacaaactgtttctcaactgtttgtcagaatattaaactctcctaacagactctatctatatatgttaccatatgctctagcaccaggcagccactatcactgatatgctaatggttagtagtagtaggttttctctcgataatgatgccaatggagttggtagcggcatcagattagtaaattttaccgcggtcacgtgagatgccatgcacgatgaatcgaatccattcccagccagctgacgaggtgtctccgtgtgtgaatcggatggtagaaaaagctttgcaccaccctccaccaccgctagattcgctcacatcgccgccattactgttgccctctccttcccggcgcggccactccgtccgccgccgccgggggcgaacccgaacgcctctccaccgtccgatccgccagccggatcagatccaacacctaccaacctaccttggcaccttctccctctcgtctccttcctcctcacctcgcccactacacctccacctccggagctcacaacacaaatcgatttctcccaaaccccccctaaactccccaccgaatctccaatgcaggtcctgctgctgccgctgctcgtcgcggcggccgtcggcctcgcgcgcgccgccgccaccgacgaccccttcctctccggcggtaagctcactcggatcagtgggaatggtttgctgaaattgagc

SEQ ID NO: 12854 - DNA, 1501 bp, Oryza sativa
atcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgtaccttaatttctatctccatctttgtttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgatctttaataatatactttaaccattaatttattacgtgttatgtttccgacgaatatgaaattagcttaatataaaaatatttaaaatataaatctagtaatataatatgtatatatatggttagtataattattaatcaaaaacttaattaggacgccgtataggacggagggaatacttccttccgtgttgttcttatatacgtgttctaaaagttgacgagcgtgttcatttcacgcagggcgccgtcacgaatgcaaacgcatcatcatcggcggccgccttgccggccaagaggaagaagaaccccgccgcagcagcgtccgccgtctccgccgcgacgagtagcaagaagcccaaggccgccgacctgacctgcgccgtctgcggcatcacgtcgaccggcgagaaggctatgcaggaccatctcaacgggaagagccacaagaagaaggcggccgcgctcgcgctgtctgcaccgccgccgccgccgccggcggaacccgagcccgagcccgagcaggacgaggaggatgcggcgtcgatgatcccgccggcttcggacggcggcggcggcggtggcggcggcttcagtccgacgaagctgagcatgctgacgagcgccggagtcgtgtacgaggtgatgcagatggacggctacctcctctgcgagggctgcaatgtcaggacggccgaccgcgtcaccatgatgtgccacctcgacggcggcaagcacgtctccaagg

SEQ ID NO: 12855 - DNA, 1501 bp, Oryza sativa
aaaaaaatccagaaaagtccagtggatcaatccatgcgatgatttttatttttgagaggaccctggtgatttctagaagaaacataagtgagtgtattactacttgcaggctggttggatgcagatttggttgacagagttcaccggtatggccataaaaaggaaaagacaacaaaatatatggcccggtctaaaatataaataatgtggttagaaatatgggcgctaacgatagattcgtgatttgtatcacatttgagatatatttttttccaagtgttcaaaaaatcatgtattatataatttagttcagtagacaattcaattataattttacacaaacaaaggagccttaaacagtttggatgaaaaatagtggaatttgaaggattccataataatatgatttacttcatgttttattaaaaactagcggattgttctgtaaattgcatgatgctaaattttaaaagtagaactatattcaatataaattctatttttaaaataaaattgtattttctaatcaaaagatttttaaaatatgattggatctcatatacaactgctagttttttgttttgaatctaatggtccaaatcttttttatttcttagtgactaatgtggaaatttctaccatctagagcgaaaatgataacctttttcgagccatcttagcaatacaaatatatatgttgtaaaaatatatttttaatttttttatatatttttttacatgtgttctataaaatgtatacgggttagatgcttatcgcgccataaggcgcgtcaattttctagcataaaggcgcccggtcgccgagccctcacgatatcgatactcacgctcacgaacacgagacgcaaaagcaaagaaaagacgagacgagcaagaagagaatagaacatgtacagtgacacatctgcattggaagcgttccaacttccaaccccaatgcccacgagcactcgccacgtacatactccctacttccctaaatgtttaatgccgttgatttttttaaacaaatttaaccgtttatcttatttaaatttttttttgaaatatgtaaatctatatatatacataaaagtatatttaacaataaatcaaatgattggaatagaattaataattacttaaattttttgaataagactaacggtcaaacattttttaaaaagtcaatggcgtcaaatattttggatggagggagtacatctctatctccggatctcatctcactccgctagctttagcaatcctagcaaattagcaatagcgataccgatagctcccggtcaaatccttcgtagggcaggcttcctttattgcactcctgctcccgcgaaagcctcgcctcgccttttctccctaccaagccaccacgccacccaaaccgcgatttctgatcgatcgatcgttagctcgatccaagaacccatcttttctttgatccccaatcctcttttgccgaggattaattgggagaagatga

SEQ ID NO: 12856 - DNA, 1501 bp, Oryza sativa
ttggagcaacatgacaaccagcattaagttatcagctgacttattctttcaactggaactcggagaggcaatgaaagaggttgaaataattgatgctgtagatattttagttaattggatttatcgattgccttcttagttctaaattatgttaaaattacagaaggtagggatatactatggtctggagcttctcggatcattatattagaatctggcatcagtgatagaatgtttaggacacccccgagcatcgggtatgtacttaaggagatgttgtgaaatttagttagttagcctgacagaagcatgtgtatcattgtataaaacccgccgtcttattttccttttgatttttgataggtaataaatatccttaacatgtgtacatgtttatgaacattgctttagtaaatgaaagatcagttcagatcatttttggtcaagctattgttcttactggaagacagttgtcacatactcacatgccgagaagtgccatttcttttgtcatttgtggtccactatatgtttgtcttcatacatagatttatggacacatatactgtttctgttaccgatggggggtatttactttcattatttaggaagtggttggggtcctaattattcttctatgcctgtggtaagcctgtgtttcccatgtcggcttgcgtcgagtgctattcggctatgcaagttgacaggcagctgggcaatattttctcttctcctgcttcattgtttcccccgtttttttttaagttcagagcttctccttgaatatgtacttacagtagtcttacaagcatctaaaaaccgattctttttggaacgaaaaagtacgtgggagaaagtgtttcccacacatataataagaaatgaaactacaggcaggggcttttgccctagaataaactaatgtgggggtggtctccatgggtgtttccgttatccttgtttccagtcatcctacctagatggaaatgttttcgtaagaaaattgctttgagcagttgttgttttggcagatagcagatgctctccacttggacaatttgctgctgtgtgcacgtacagtgcacaaaatggatggagaaacattattttcagggagcaggggagagagtttatagttgctatgatcgatatattgcttatccctcaacgtcctgtaccggatgtgtgatgacttgtatgcatgaccagtgaaggagcaaaggtaacacgtgtatatcttctacttgtccttcagttagcttgcactgcatgctaagtgaaaacttctaatattcaagtgccaacatgccacttagaaaatgtatgagtgacaactatacatcaactaataacagctgtagtgctagcatcatcactaggcaagtagtagtgaaaaattgtctgccatcagatctacaagaagataggcatctaacgcatgcaatggcttgaaattaaacaactgctgcacttgcaatataactatgcattccatatacca

SEQ ID NO: 12857 - DNA, 1501 bp, Oryza sativa
cgttgggccttctccgtggcggcgaggatctcctccgtcttcgccgcgcgcctcgtcttgagcccaggggcaaatggctcggtatggcgaggtgtggccctctgcccctaccccctacccccttctcgtactcctccggacagagcatggcggcaggcagaagtagcaagtcggcaggttggagcagccaaggggcgccggtcgccggtcgccggggtcctgggagcagctgcggggtgcggtctgtagcacagtagcagccgccaagcggcaaccgtcaaggcggcaagggcaggtggaggcgcagaggggcgccgccgccgggatccagtcccgggtgcagagctgcggcatccgtgccacaacgtacaaggaggagcgcggcgcggtcaccgcattccagagcaggatgatgccgccgccgtggccgacgagggagaaggcggagttcggggatgtcgacgacgtgtgcggcgtatccgccggccagccgctcgtggatgacatgtggggcccacgtgggtcccaccattttttattattttgtgtggaactgacatgtgggtcccatagggttttattattttccggatcgaattgtcacgtaagcgccatgtcagatgaagaccgagtcaaaatagccacgtaagtgccatatcagccaaaaccaccgagggacctcatctgcactagtttcgattgatgaggaatccattgtgtctggtttttttggttgagggacaaaaatcggattcattgacaagttaagggacctaagatgaacttattccttttgtgaccgattttgggctgatgttgtgtgggctttttggtagcctctaagccgtttcatgacttcattcacctcatctccaagatcatcttcggcccggcattcacctttctcaacttatcatttctcgtttttagtaaactagtttcccaagttttcccaaattgctaaacggtggtatgttttttaaaaaaattatagaaaagttattttgaaatgtcatatttatgtatttttaagtttatttaagctaatgcttaattaatcgtgcacgaatagaccgttccgttttacatataggagacagagttctcaaccttcacctctgaacatagcttttttcaaaacctttagattttccaaaccatctaaattcttgtctatattttaggaatatgtagttatgcaattctagaaaaataaacgataagttagaagttgggacttgggaagcctagtttatctaaattcttatcagtcgtttgtcagagtgagcagctgattctacgaatatgtagttatacatttttttaaaaaaaatgaacggtaagtcagaaagcggaaaccagcttttctaaatttacatcagacgtttctcagagttaagcagaagctccaataaacaggacctaagtttcgagaactgtagagccatttgggttttagagcggcaaatcaggtgagttattactggatgtcttggctttg

SEQ ID NO: 12858 - DNA, 1417 bp, Oryza sativa
ccccccccccaccccaagcgcacttaccctccgtgcaggccactggcaccgtggcgcggtgttcgccggaggcggtgaggggtagggaggaggtagagaaggggaaggggatggggaaggggaagcggatattgccactggtacgggtctgctgcgggggccatcaataagatccgggtaccttgccatgtacagcatgtacaacatgtagggcacccccttcccctacgttggggtgacgtgagggcgctgtctcgagctcaatgaccgctagatctgggtaccttgccatgctccccttccctttccatgtcacgtcacctatccgtttgatgacgagaggttctgtttttggttgaatttgtgatttagcatgtgcaacagtttatttttctttttaaaaaaatgtgattaagcttgtacagaaagtttagcatgtacagaagtttgttttttttttcgatttgtaatctggggcaacggggagtgactcaaagcatcggattcgaccgaatcgagcctcttctcttttttttttttgcgtcgtgtgtgcctcaatttttttttttttttttgcatcgtgtgcacctcaaaggttatagttgcaccaatgacctaggatcatcagtgccttctccgtgctgccggctggaaaatccggtccctagctaatgtggaatttccaattgacacccgtcaaactttctgtcgtagaatatgctggcgaggcactctgaagcggaattagaagcttgaattctagaagcatgctaaaaaattcaaaagaacatctatagtttcataatttcacaataactaacagaattattgcaacacgatatttttacataaattcaagattccatagtcttgggattctgtagttttaacaattttagtttagaatttgttccatggatacaatggcggagccacatgggcagctgcccgggcttcaacgcacacagcagtagattaggacttgatttatgtgattatttaccatccagccacatacaacagtaggaagtacttaattaccgtacttaagcaaaccagcaaagcaaatgcttaaaaaatcacaatcacgttcatagtaaatgttttttgaagtagtatgaaattgtgtacatttgttatctatttttagctttgcggagtttcaagaaaattcttcgatccaccactgcgtggatacttgcaataaaaccataaccaacgtttagagcaatctaaaacttataaacttatagtgagaaaaaaaaatacaacaaatttaaagtagaataatattattcttaaagaagacacatagatatacatctcacatatttaagatatataataaaaagtttgagaaacatatgcctgcttatgtggacgggcttttcttctcttcctagtttatcaaactagg

SEQ ID NO: 12859 - DNA, 1501 bp, Oryza sativa
tatttatattgttttattgaactgtataatagtacaccagtatcgactgtactagaacactatattccaagtaggtgtgggtattcggtctgaccgaaaatttcagtctcggtatttggtctttatgttagttcgtctttaaaaagtgaagaccgaatttcaacacaaaaatatcagtcctgaccgaaattcagtaacattttcatatatgcaaagaaataattgaaattttcaacacaaaaatcacaaaaaaaatcgcaaacacgtatgagaagactcttattaggttacatgcctgaataagtagagatgtgaaaattagagtttaatcctattgaacttagtggattataggttgtattttgacaatttttttaaatttggccttttcagttaaccaatgagactaaccggatttaccatacaaaattcagtcttttattacttaggactaaattggtctcggtctttcagttcagtctttttctactaacccctaattccaagagccaaacctcagtctttttggtttgttttttttttctcacccctaattccaagagccaaaccgggatggcctcccgaatggaattgacaaacttggatcagacggcggaagcttagcaaaaatttacaaatgcttgaaataagcataacaaataggcaaattttgctacaggacatcgcaactttgtggttttgactgtaggacaccgcacgaagtcacttttgggaaagaatactctcaaaagttgaatatttgctggtggacatcgcacccattaaaataatattttttggttgaggagacagaaatcacgtgaaagtaatgaatgcccttgggccacatgtcggatccctcctcctcgattctgagctcacgcgacaagtccaaccaccgtggcgatggatttctccggcggcgccggcgcgacgttgctggagatgtaccagaacgcgtggctgctgctgctgctggtctgccggtgccacccggacgcgtgccccaccctcgtcgctacccccagtatggcagaggccttccgagcccacctcattgcggatggctgttgacacgggttttggctcgtgtcctaaatataaatataatttgttaaattataaactaatatattatcttaaatatagtgcgtacaaaatatatataataataaataagaattttattgggagacagatggtgaagtaatttaaataaatagcggccacgaaataaatggccatgaaataaaatataattcacttatattggacaaaaataatttttggcttaaaataggaatgcatatacgcgttccacataaatatagcgtgaacaaatatttttcatgcgcttttcgtcggaccggcgaacgctaatacttagctttctcgtcgtatccgcatacgaaatttggcctaaaacatatggccatgaagtgggattttctcactacctcgaaatagtcacaccccgaatattttcagaaaaggcgtactc

SEQ ID NO: 12860 - DNA, 1501 bp, Oryza sativa
  unsure (1)..(1501): unsure at all n locations
tcctcagtgtgattactccattgtaccttgtacatacgccacactttgctcctagtcctcttttctgctttacccaatatccggatcgggtgttctggatacgtgagatcattgctaatgtgaatctcttccagcggagcttgttcttctggcactcgtaagcatttctttaattgggacacatggaagactgggtgcacatcagcgatattctctggtagctgtaactgatatgcgacttctcctcttctagccgtgatttgaaagggtcccacatatcttggtgctagttttcccttaatcttaaacctttttgttcccctcatcggagaaacctttaaataaacgtaatctccttccttaaattctaggtttcttcttcgggtgtcggcataactcttttgtcgtgattgtgctacctttaaacggtcacggatcaagcgaaccttttcttcggcctcattgataatgtcaggtccaaataccgcccgttcacctgtcttagaccacatcagcggcgtccggcatcgtcgaccaaacaatgcttcattgggggacatcttcaggcttgcttgaaagctgttgttgtaggagaactcggcgtagggcaaacacctctcccagtctttgctaaaatccaacgcacaagctctcagcatgtcctccaggacctggttggttctctccgtctggccatctgtctgtggatgataagctgtgctaaaagcaagataacttcctagggcttcatgtacttttcccagaaatgcgaggtaaactgtgtgcctcgatcggatataatcctcttaggtataccatgaagacacactatcctggtcatgtacaactcggcgagtttagcactgctatagtttgtcttgacggggatgaatcttgccgtcnnnnnnnnnnnnnnnnnnnnnnnnnaaatggaatcatatcctgttgcggtcttgggcaatccaacaataaaatccatacttatctcatcccatttccactcgggaatcctaaggggttgcagcaagcctgccggtcgctgatgctcagccttcaccttttggcacacgtcacagagtgctacgtattccgccacatctctcttcatgttgggccaccagtatccttccttcagatcttggtacatcttcgtacttccgggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgctgctggggagtgggtatatatacccccaaccaccaaaactagccgttggaaccgaaatccccaactttgtgctctgccagtcagactgccgttgtgaggctggtcagaccggactactttgtaacggctacggctagaaaa

SEQ ID NO: 12861 - DNA, 583 bp, Oryza sativa
cgcccggaaaatctatccaaaattccgaacgcttacatgtgtgttaaaccctcgtccagaatcaactgaggcacacaataacaaattgataatagagtacaaataaataactatttaatattcgcaaataataaattattacagaggtagatagttcctctcaaagaataacattctacgcagcggaaaataaaactataacaaactacggaacagctatggcgactccactccacaggcatcctaaccagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataatatagctcatttgcagaaacagcatttaacgaatatttaagagaatagtaaaacagttgtaataattaatcaatattaaataaacaccatacaacacacccatgttgcataggcccaaccacatttgaacaaccaaccccagttgaacaaattaaacctccaaaccaggaattatccattccaaaccagg

SEQ ID NO: 12862 - DNA, 355 bp, Oryza sativa
gccgccgtcgccgctccccactgcgtcttcccccaccgccacagccgccgccgccgctccccaccgctgccgctgcctctccccaccgccgtcgtcccgagaagagagaggccggagggagagagaggaggagggatgatgacatgtgggtcccacaatttttttttcgaatgacatatgggtcccacatattttttttatttttattctaatgccacgtgagcgtcacgtaggacaaagacttggttaagaccgccacgtagacgccacgtcagccaaaaccaccgagaaatattgtttgcatggttttaatagttggaggagtcgatatactcggttttatggttggaggata

SEQ ID NO: 12863 - DNA, 1501 bp, Oryza sativa
gtcgccgtagctctcttgcagcgatcgcagcatggcgcctggcttctcgccggcgtccatcccggggatcttggcgagctccaagttcctgagcgcggtcaccgtgctcacccactcctctggctgcctcctgcacctcatggcgccgccgatggcggtgagcacaagcggcaagccgccgcacctcccggcgacctccttcgccaagtccggtatcctcgggtcagcgttgatcgtctcgtcgcgggcgatctctctgaacagacgccatgaatggtcactgtccaagcattgcatgtcaatccttcgcgacgagctcatcctgccgcagactccccttgttcgggtggtcatggcgaccttctgcctccggcgatcgtcgtgcacgaggtgcgggacgccgatgtccaccaagtcgacaggcttggttacgccgtcgagcagcagcaagaagctcgagtccctgaggacttcaaagatcggacgcgcacggtggtccggcgcgccgccgtccgggagcgcgcacaggccgagccggtgagccatggcgtcctgcatcttgcccacggcggcgcagtcgcccggcgcgtcgagccatatgacgtagtcgaactcgtgcctcctgtcggggtcctggacgaacacgttgttgatgcgtcgcagcagcgtgctcttgccgacgccggccatgccgcagatggccacgacaccggcgtcgcggtcgtcgaggcacgccagggcctcctcgaggtagccctccatgccgaccaccgtggacggcacgaccatggcgccggacgacggccggggcgccccggcggcgaggctcctcaccctgtcgcactccccgagcagcgcggcgagacggtggcgctcgtggcacgcgcgccggctaatggcgtagctcgcgaacaggttgagcgagaaggcgccgccgccgccgcaggagcaacaccggcgctggtactctcgccggagcttggccacccgcttctcggcgccgtccacccgcgacagccagtccgtgacctcctccggccgccgccgctgcggcagcctccccatggaggcctcgaggtcggcccgtatcgacgtcagccgtgtgagcgcgtcggtgacgtcctcgacgttcgtgccgacgctgctggcgaggtcgatgtcggcgagcaggcggccggcgatgctgcggctcacggcgccgacgacctgcggcaccagctccgccatggcttagcttattttggtctagttgctccagtccagcgaccaactactgaccatgcaagctaaactttcagcaagtttaaacacttcggtaacggaattcaactgaaattgattgctctttttccagcttgtcacttgccaggctaacttctctgctttttttccttttttttctttttttgggtgaaatttagatgccaatgcttgcagcttgcatgaagcccgccgaggtggacttgaggacaacggagactttggatatagcagattagca

SEQ ID NO: 12864 - DNA, 1183 bp, Oryza sativa
aggagctggtctgctggtgcttcggccgctcccgaccgccgccgccgctcccgactgcctcgtccccaccaccatcgctgctactcccgaccgccccgcggccgctccccactgccaccgttgccgctccccaccgccgccgccgccaccgtccccactgacaccaccaccgccgctgctccctaccgtcgtcgtcccgagaagagagaggccggagggagagagagagggggaggaagaagagaaggagagggaggatgacatgtgggtcccacaatgcctttttttccttgcgaatgacatatgggtcccatatatttgttttatttttatttttattttattctaatgccacgtaagcgtcacgtacgacaaagacttggtcaagactaccacgtaggcgccacgtcagccaaaacaatctccaaaatcattgagagatattgtttgtaccggttttaatagttgaaggagtcgatatagctggttttatagttagtggatatgaatcgtactcgggtgatagtcgagggaatcgaagtatactttttccttttcggcgctggcactgtactgggcctccagctaggttgcgtcgagtggtccaggtgttaaggccttaagcccaaaaactgatggaggcccacaattaacaaagtgatgacgtgacggtacacagactcattatctttccattttgttggcaaaatgaaaatgcgttacattgttcagtagcagtacattgaggattcaatgatgaagatttttccgttcaaaaaaaatgatgaagattttggtaacggcaaattcaaagatgtttttgttttataaagagtatataaaagagttgcagccaattaccataaacaacttttgaatactacctccggtctaaagtataaggcagtgtttggctaatgggataataaagtaatttcctacccacaaaaatacatctttaaatcctaaccattcattctccttcttctatttaatcaaaacccttcatcaatttctcaatcccaatcccaccattcatttcccattatccaaacatacctaaaggattttgccaataggttgagatcaagtatatgtatacaaccaaacatgagaaatataaaacattgcccaagaatacatcggatgaatggaggatctacaatatacatctccaatgagt

SEQ ID NO: 12865 - DNA, 1501 bp, Oryza sativa
cggcgcactcaatgtcgccggccttgtcgtcgacgaccttgccgccggccatgacggtcttgtacgagtatctggtggcgacgaccacgtagaagacgaggttggcgatgccgatgcatgcgagaagccagtagaagaggtccagcctgctgttgttcaggtccttgccgaaccagccggcggcgcggccgccgtgcgaggtgacgcggacgagcggcgtgagtgggctgccctcggggaccctgtaccggtagtggcgccagccggcgaggaagacggcgagggagacggccacgacggcggcagcgccccagccgaccttctcctggaggtagacgatgatggtgacgccgagcaggacgccggcgcagagccctcctcctttcccgcctcctcctccgcgcctccgctcgcaagccgcctcgccggccgccacgcgctcgcaagccggccgccgctcagccccgcaaagaggagaggaaaaagaagagaaaaaaaaaagaaagggaaagagagagggtgacgtggagaactgatttgtgggtcctccgctgactcagccgtcacgtagactaaaaccggggtcaaaaccaccaaaggacctcgggttaccggttttgtatagttaagggaccccgtatatctgttttacagtttgaggacgttttttatcccgatgacaagttgagggacctttggtgtactttttccaaccgtaatattcgcacgggctttaactccgtttaggccacggcccaaaactatccccggatgggtgcgactgcaacctatttcagcagcaactccggtgtccggtgttcgatgccggttgccctagccgccgccgccgccgtcgccgtcctctctctcctgtttcctcgttcgtaggatcgatgatctagtggctttgcggacaggtagttcgtatttttatcgtcctttcctgggcgtgttttaaattcatcttttgctgctggttttcacttttcagaatatgcatcgatgctctctgcgggttctcaagaaaatacaggagaaaagaagcattgatcttcttctgtgatcgaagtgatagaaatcaatggaatatcccttgttttcttggtttctgagggtaaatttccttgtttttccaaggataaaccgattcgacataagttaattaccaagtcggtttttcaatttcagtatgaatccaattcgagcatatacaagtaagtgccctaattcgaatcaggctctgaggctggtgaaattccctttataaataagctcgacaataacactgatctcatatttgcataccatccgagtggaaaagccccattgtcagtagtcatgcagtccaatagcatccaaagctatgtaagtctctttccctctctctgttagtaatttttgttagtagtttttccagtgtaaataaacctaataccatcctttatatgtttagtatttcttgtaaaattaagagaacattttaaacttcagtttaaatgat

SEQ ID NO: 12866 - DNA, 334 bp, Oryza sativa
tagacgttgtgactgtgaggcggtttggtgggaccgaccgaacggaataagttcaccggaggtccctcaaattgacaccgagattttttaaggtcactaaactagaataccggcagtattgactcagtttttgcccggttttgctgacgtgtcgcgctgtgggacccactggtcagtccgccgttggggagttaatagacggggttaaaggctctgtcctcgccgtttccaggcgttggcgcgacattttcctcttctcgagctgaaaccctagcttagggcggcggaagcggcggtggcggcgggggcgacaagaggaggtgaggctaggtga

SEQ ID NO: 12867 - DNA, 1501 bp, Oryza sativa
tatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtccccccatgacgaagactatggaacaaggacggcgagaggcgagggatcgcacgggtactctgccaagccagaggcctcttgggcgaaggatgcagggcgaagagtatatgccgaagggagacgacttcgccaaagcaagctcgcccccgcgagggccgaagaagcctttcaggcccatcaagtctaggggctattgagctgacgatcgcccgacggcccatcaggggcctgtgaacctcaattaccctatgtacccatgtaaatgtccctttcataagggtaaccatgtaaattcccctgtataaccaaaactctagtagtaagaacctgtaataggagctataaatagtctcatagggccatgtaatggggggatcccgaagaaaaattctctaattaatacactttacttctgtcgcgactgagaaaaatgcattttcccgaacgctagtgtattaatccccgtcccaggaaaagtcggggtacaccacacaaacatgatacaaaagacacatctttattatatcgataatatttacattattacaaaggcacttaaggcctgacaatcaaaaataaacagcagcggactagcgggactatggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacaaagtgttattaatcaaggccgtaaaccctcacgaacctgccttaattcaaggcctacgatgattcagaccgaactggcaacccgaccctgggtcccagctcatcccaagccaacccaggccaaccattccacattttagtagttaagcaggttttaagaattaaaacactaacttgggtacattgctaggcttgcccataaccgagggcgcggctattcgaatagattatactctgatcagaggtgtacatctttacccacaagacacatcatcctcacgtgtaaccacgtgccacataccaccacggcatacggacggaagacgtcacatagttcccaacccatcctagccataaacaaaagtaccgacccagccccatctacagccggaacctccgggacaggcaggcaggattgagctcctagcagcaggacaccagccctgtgccatgacatctcgactaccgggccgcagctcgtgta

SEQ ID NO: 12868 - DNA, 1501 bp, Oryza sativa
tatggtaatctgcctctcgcattttggatagttttgatggatatcattgttggtggtatggcatgaggcccttcgaccaaaatctgctgaaagctatacgaagagtggggattcaagcccgagacgtcaaagttagtcggggcgaagtccccccatgacgaagactatggaacaaggacggcgagaggcgagggatcgcacgggtactctgccaagccagaggcctcttgggcgaaggatgcagggcgaagagtatatgccgaagggagacgacttcgccaaagcaagctcgcccccgcgagggccgaagaagcctttcaggcccatcaagtctaggggctattgagctgacgatcgcccgacggcccatcaggggcctgtgaacctcaattaccctatgtacccatgtaaatgtccctttcataagggtaaccatgtaaattcccctgtataaccaaaactctagtagtaagaacctgtaataggagctataaatagtctcatagggccatgtaatggggggatcccgaagaaaaattctctaattaatacactttacttctgtcgcgactgagaaaaatgcattttcccgaacgctagtgtattaatccccgtcccaggaaaagtcggggtacaccacacaaacatgatacaaaagacacatctttattatatcgataatatttacattattacaaaggcacttaaggcctgacaatcaaaaataaacagcagcggactagcgggactatggctctatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtgcaaggggtaataatataggggttaagttttgcagtaaacagcatttaaaagtcacttagttgcccaaagccattttataaagatgatcctagagctacaaagtgttattaatcaaggccgtaaacccccacgaacctgccttaattcaaggcctacgatgattcagaccgaactggcaacccgaccctgggtcccagctcatcccaagccaacccaggccaaccattccacattttagtagttaagcaggttttaagaattaaaacactaacttgggtacattgctaggcttgcccataaccgagggcgcggctattcgaatagattatactctgatcagaggtgtacatctttacccacaagacacatcatcctcacgtgtaaccacgtgccacataccaccacggcatacggacggaagacgtcacatagttcccaacccatcctagccataaacaaaagtaccgacccagccccatctacagccggaacctccgggacaggcaggcaggattgagctcctagcagcaggacaccagccctgtgccatgacatctcgactaccgggccgcagctcgtgta

SEQ ID NO: 12869 - DNA, 1067 bp, Oryza sativa
atatatatatatatatatatatatatatatatatatatatatatatatatatatatatatatatatatatatatatatagtgaaatcatatagtactttgcaacttaactaaatttatagttggttagggaaatcaatactttgcaaattaacttattatgtcaaaaccttcttaaaagcttacctagactaatagaccatatacaaaagttcttaaacaggatcaaaagttgcgcaagcgcgactacgtggctagtgttgttctttagaaatcccaagtaacctttcgagttatttttgcgaggtgaattgacatatcaaattgcacatatctttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatattttcaactcaacacaaatttattatgaaaatatattctattattgatttaatgaaactaatttggtattataaatattactatatttgtgcataaacttagtcagatttaaagtagtttaactttgaccaaaatcaaaacgtcttataacgtaaaacaaagggagtatataatactctttcttcattttttggaagaatgttgtggcctattctgtttgttattaattattcagtggttcaacaattgttaaatactatacaggctataccgtctttagattaaagttgatgcatctatatgaattgcctaccaattgtttttcatacattttagaggaattgccagatatatgaaccttttgctagcttcctataagtggaatattcaataatcaaactcagataaaacctacagtgaacatgacatagcaacacaatatttattgcataaattatgccaagttactcttaacatcttgttaggtagcaattgggttaacatatctctgcactactggtatttgcatggctttccttggaaga

SEQ ID NO: 12870 - DNA, 281 bp, Oryza sativa
ccgtcatactccccgcctccgccgcccatccccttccttcccccgccgccgatccgccgccgccgccgcgtcccctcctctcgatgggattgggttgggttggtgggtgggtttgggctcgaggcggaggcggatcgcggaggcggaggcggaggcggagctcgcgatcgtttaacgacggtaacttggaccgatcgcgctgtcccccattgattacgtcggcttttttcctttttttttttctttcttttctttctttctctctactgatactactgtga

SEQ ID NO: 12871 - DNA, 1501 bp, Oryza sativa
taggcagctgcgcagtgggcacagagcgaactattctttcgccttttactaaagaataccgtgtgctcgctgcaaatagcagcattgcaagcatacttgtgtagtattaagcatgctcaaataaatttgaaacaaattcaaggccatgtttgtttcattaattattagcatgttgagtccggcctcatcctcatgtgcttgcttgttaatcttcaatcgaagtactggttcagtagttatggattgtgtcctttcatcctcccttcagtttgtgagcatatagcaggaaaaaacttatgttcaaaataaaaaggaagaaaggaaaaacagaggggaattaaaggaataggattattggtttgtcatgcaaacattcagagggaaacgttgacaaagaaataaaaagaacagtgtgacctatgtatatgaactagtatatgggttgtttcagccaataggttccatttgtcagaatagagtttttttgctgatcggcgagttgcttgaggtcctgccggagcaaacaagtcgacagttcaataaataatggtttcgtcagtgttggtttgtgagtcttcagcaaaacaagtattcagttagagaaaagaaagtctatgtcaataaggctggaattgatagttctgaagtcctgatcatagccgaattcatttgttggaacaggaattttgatataaataatactataatacaaaaaagaaaagtttgataaacctcgtttgttatatctagtctttttgtctgtcaaggtatagaaaatgtttgatttttgttctgaaggggaggatctctaatatattcagtcagtggtcagtgccaactctgataaataattgatgccattacttggagaaaaccttgtgaggattgtaagaaaccgagggaaaagaacattaaaactaaccagtcaaaataactgtgctgacaacaatcttcacttgatgacttcagtcatgtttttttactaattttattgaaggagaacaaccttttctttggggatccaatggtgtttttccacggtagtttctcacatgtgcttggttttagtcacccgcataacatctaaatcagtgtaacttttaggtgtgtcttctgtcatatagacttgcaaaaaacttcttaagaaaaaggcctgcttttattcatagcagtactaagagagtgctcttcatcctggctatgtaattgggaaccttttgaaattgtagcaaccctttgtccctctgtctaactgaaatagaggtccatgtccctgcaaatatgcattactgtacagcaatctggaaattagcacaggctgaaactggacagttcccaattgaagcccgtgctttatttgatatatttgcctacctatttatcatatatcttagttaatctaagtcgattatttaaatttacttatatcggtcagatcttttctagggttttgccagtatcggctaaattgttttgtcgatctagattagctattgtatct

SEQ ID NO: 12872 - DNA, 1501 bp, Oryza sativa
tgccatttttatcttggccttattcgtcagacatgccaaaatactgatgttaaacagttaatcttattgggcctttcagcgtaagtactcacctttagctccttttacatttattttagcatttggtgtagcactcataataatcttcagagatataatgatgattcatagattcataagctgagtttcaataattaattgttggaaaggttagtacatattggtagttcacgttggcttgtttgaaagatgtttcactgaaaatgtcattagttttcatcatcaagtatactcacgctcaccttactgatctgtcgatgtttactgcagataaaggatatgaggttcatttttcatgtaaaccaggatgctgtaacgcaattcgtcacacgcaccccgaagccggagcactagatcctaactggttttgttcagcaaccccttatgagaagctcaatgccacattgtcactggtaactagtggagatcattgagtgagcagcgctcacagggtgggctcgttgtgctgctctactccttttcaagtaggatgtgataccaccatggaagctcatctcgctccgtgtgcctagattgtaaatgtgtaacatgtagtgtcaagtagtctctcttctgctcggttcatgaagcatgaatccttcatgtccagtagctaagctagcacatttggtctgcagcctcagcctgcagcaacaaaagcttctccgtagtatttattcattctttcctgtcatgtaaattgtagatggctgccgaccagtggggttggaaatgtaaaaaagtgtggtggttctatcatctatgctactacagcaagaggatgcaccttggcaagaaaccattgggttctttagcctttttgggtctccatttccttgtgtcctcgaagcatatacccgtgcaagtctggaatcaacttggctttacacatctgcagagttcagatgctggcacaccacaatccaccccttgtctgagtcagtggttggtcatcgttgtccgctttgtttggacacgtggacggtcaagattgaacgaaacctaaaaaggcacgcgataggatgaaaacggtctattttttattttataaattaactatttattgtcgatttcaatatgcaaatagaaaacagaaaactaaattttataaatgactaaatagaaatgctaaaaactattacttttttactttttattttttacaaaaatgattgtcggaaattttcatatcattttcatccttcgttactgacacgtggcctagttttgcaagattaatctggaccgttgatagtaaaattgggcgtgagattttctgtggctaagaggagtaggtgactccacaagactacaaagagtcgtctctcctccctcatcacaagtcaaaaaccaacaagaagagttgttgcttgcgctcacgcgaagcgaagaggagcaaggcgagaaaagagagagagagagagagagaaccaaaccaagc

SEQ ID NO: 12873 - DNA, 1501 bp, Oryza sativa
aatccatgcatacacacaacatgcaaggtaaatttaacagatctgaccatcacacgtacaggagtacagtagtagacagcatgcatggagtatgcgtagatctaggggtgggaagggaagggaaagagggtcaggggtgagctcacatcgtagtggaagaggttgttgtcggcgacattgacgaggaagtggttcgcgcggatcatcaccttcttcccggccgctccgaaccccggccgcgcagggtgggcgagccccttcttcgacaccggtgccagatccttgtccgactccaccgacgcctcgccagccggcgcggccgcggccgacgccaccgccgcgggtggcgccagcgcggtctccgacacgaacagcttctgctcgaactccttggccagagccgtagcggacggcgccgtggaggacgacgagggagccggcgcggccgccgccggctggtacggagccggagccgacgagtgcgacggcggaggcgcccggatggtgacgggcgtgctgcgcgcgtagccaccgatcaccggaacccccggggagggcgcacggtacacgcccccgggctggtacgcgccctggtggtgcgccgccggcatcggcgcgccgtagacgacggccggcggccccggccgcgggtactgcggctgaggaggccccggccgcggcgtcatccccggcggcggccacacgaagcccgaggcgggacggtacggcggggctccacccccaccaccaccgccaccacggccagggacgtcgccgcggccggagtagggcggccgctgctcgccgccgcggccacctcggcctccgccgcggtaggccatggcagagagagaggtggaggaaggcaacgagatggaggtgagggtttgggaaggggtggggagtgggtgagtgatgttgcggccttgcgggaatggaaggggagggggattttataggcggagggtgatcgacgaggagaaaccctagctagacgcggtgggagggagaagggggtggtgatcttaccgcgcggtgactgtatgcttgtccgtacggaagagtgattaattaggcggccggttaatcaaacttgctacccaagacaaattatgtgtcattatagaaagtgaatttatgtccggtttttttttgtgttttttgaaggaaaattatatgtcattaagttcatcgatcggggtgaactaattaatctgagtttgttttgttattaatttgggtgttaagatattgtatagaaccaagctatgaacgtgaagttatacatatgtatagtcaagtgtacgagtgtagcaattcataatgtttaaagttaaactgcaaatggcaaaaaaggccgtacgtctagtgtagtatcccatttgacaccatccttccgttttgttttctcgtaattaatattgaagttatatatgtttggtgtggtttttgtgatatacattgtccaaaatttgacaaattaaatactatacagatcaat

SEQ ID NO: 12874 - DNA, 1501 bp, Oryza sativa
caattcaccgttaagaatatcgttttttagataaaaaaaacatacatcaagctttactacatgtctaacataatctagtccttcaaatattggggatctcagcttgtgaacacaaaatagtactgcacacagaaacgctaagaacaaaacgtcaactcagctaagtctaagcaaataaataaaacaccaaactaacttgatcaaccaacactactaaacagaaacgggcaaaccagatcggtgtcatccatgtcttctttgtcaaatcttccttttgcttgaaacttgtgcaacttagcaaatatagagagctggtggttcaatgtaggagggtaagagctgcacctgcaccaccttatttaggttgtgtttagttcaagttaaaattaaaagtttggttgcaattggaaagatgcgacggaaaagttaaaagtttatgtgtgtagaaaagttttgatgtgatggaaaagttgaaagtttgaagaaatattttggaactaaacacggcgttagccaacaattaccgtggttcaatgcacatattttgtattctatctatttccagaatttgaggatcgatggatgatattgaaagtttagaggaatctgtttatacgcatgctaaaaaaaagtggcaactactacgattgatgattcaccagagatagagaacagggcaagcaaaaaaagaggagcgaggatgcatgaaaacttttaaaaaaaagtgtgacaatatatatagaacaatgtttttttaaactttacacacgtgctacatcataaggttttaatataatacatatatttgcaattaatattttgctgttatcaacccggataactttcctatgttccaattatgtttttataactctgtttcccattatagctacaaagacatatcacagcttcacaacacatatactattttctagagcattgaccatagcaaaagaaaattttgtggatgtgagcatcagtcataaataacgaacaagtggctaaaaatgaaatactgtatctgtccttttcaaaattgtcattagggtgcccatcaattagtttgattaattacaaggcagctataacggtgtaacctaccgatgatttccatcacaacaaagagaaaaataataccagacgtagaggtcatataatcaacttgaaagttgaaaaacaatagtccaaaatgccagctaatatcaatcgcttaacagcaaagaaaacaggtggcggccaggggcctatacttaactagaaaggaaacaaagggccttttttgaaaattccaccaaccaaatttgatttcttttcccatttccacccccatcatttcccctcccactacccaaagcgaaaccgacctttcccccttcttctcccctctcctacctcgccgagatctagccctagggttcgccaacttcaccggcggcgaggagcacgtcaccggcggcgagcacaggcggagggcgaggggagagagagagggaggaggaca

SEQ ID NO: 12875 - DNA, 1501 bp, Oryza sativa
aggccacataaatacataatataagcaataacatgagtcactaacatgtaggcccattaaatatatggtccatatcggcagctcaaaattagaggttcgcactgtagaaaatctgttcacggacacgtgtcgaaagttagaggattgtaccgtagaaaatccgtttacggacacgtgtcaagtgtcgaccacaacatatgtacagtcatcgtgccattggtagcaacgctagcagcagtcctatgaacacgacatggaccggtagcaaaccgagcaaacggtgtagtactacatatatgtcgttctccctgccaaaagcaacacgtagtcacattgctgcagttgccctaatgccgcgatcagatgcaatgcaaaccagcccccgaaaaaaaaagttacaaaccaaagtatatcccagataggagtacgtcgcaagctgaatggacatttacatttctgggtaacatagaatacagatagcttaatcatcatgttcgttcgatgtcgctggaccctgttactgaaagcggcctcttccaaaaaaaaaaaaaaagaactttcgatcgaagcgtgcagcttcaattgctcattttgctcgacgagaagagaaaaaaaatggagattggaacgatgtattatgagtatccgcgaccacgagcgctgcgacatgcttcgaaatggcccctttgacatcgcgtgtgcaggagccttttacgtgcagatggggttcaccaagtgtgtagtaattaatttcggtactgaattccgaatccataaggaagaatttaaagaaactaaccctcacaaggaacagcaatatagtattcagatagattttccagcaaggagccagcagcagctcgtcaattacaggctaaattatggctttattatgctgcatctttaactaattaccaagtgcctctctgtacttttgctcttcgtcatcgtctaataatgaccaacaggagcagaaaaaaggagagaaatatcccatgctctgtagatgatgcatatataaacctgagagataataataaaggagtagttcttcttttgctcacagccactcgccttcactgcaggtgatgctatcggctatatcccactgtcacggttgcaaaaactttcctgcgacgaaaacacgaccttttccggtttaaagatgcgaattttctcgctcagattggtgataatttaactttctcgtcgcaaaacgagattgttaatttgcgcgtgcagtagcatcagtttgagctgatttggccgtaattgcagccgaattttgggcatatttgtatcacatattttaggacatacatgtttgtgtgtgcagttcagttgctgctgtttgggcgatggatttgagatgctaaaaatgggtttaagttcgggagaaacacgacgaagtgagggtgcccaggtagaaaagctagggtggtttggaacgcggtcaacctcatgtttagtgctgtcctcgctagcagccaattcatatccc

SEQ ID NO: 12876 - DNA, 1501 bp, Oryza sativa
ccaacatggcaacatgtaagtactgaagctgccgtctaattaattaatttccctcgagtgattgagcatcatcaactcatctatgtcatggtgctacatcacgttgactagctagctatccaagagattggcacttttaccacttatcaaactatcagaatctctttcttctatatctgatactccccccgtgccataatataaaaaattttaaggggatgtgcacatcctattattatgaatttgaactggggttcatcacatcttttcaaaatctcttatattatagaacgaaataagtactatcttgttctgatttttttttctatgacatattctgatttttattttgttctatccatggtaaaatatgggcattctgctattttttttaaagtatctcaccagctgtgagactgtttcacactgtcactgacaaaccggtcccaccgtctagaagagcagaagctccagcggcaaactgccagaactgtagagatcaacaacagcacgccatatatggtcagcagagatcgctttccatcgccattgtggatggtcgtcggtacactcccaagtcaaagtcgcaacaacaattaaagaattaatcacaccatcatctcgactgaaaaaaaaaagatggacactaatattctgcaacatacgcggcctctatgatgccgcatggagccaaccgtttactatacaaacaagcagtcccctttcatgaaaactatagcgattgcgatttgcagagagaccattttctcatctattttcaaacactcttgctttcaaaatttcgttttggaacttttgataccgtccaactcccattaggcgttgcgtttgtatctcatcatccttatctgagaaaaagtagtcaccgtgtcagagtgaaaaaaaaaagactaaataagccaaaaaaaaaactttcattttttttaacggatcttcacctcacgctaatacggttggttgctactgcatcaccatctacagatgtaaaccatcttcatagtgcatccaaaatatcgaatatagttgaaaggttatccatgtcagagtaaaaccaaacttgaggcaaacgagtcaaaaaagaatttaaaatttcgcgcacgtttggatctccacatagcgctagcaccgtttggatgcatatccagaatttccggaatgcatatccaacatagtgggaggtggctggagccacatttaagcagctcaagacaatatttccccctttttttcccgttgaaaaaagaaaaaaaaaacactttcccccctctttttttcccctcctccgtgttgccaacttgccatccacccgttgctcgccgcagccgcccgcgcgctctataaaaacgcgcgcgcgcgccgcgctctcgccaccggacaagccaagcgcgcggcgcgtccacacacatttgcatagccacagccaagaagcgacgcgatggtgacggcggagtcgggcgtcgccggcggcggccgtggcgcg

SEQ ID NO: 12877 - DNA, 1501 bp, Oryza sativa
tatttatgtaattagttttgtaagtagtctatatttaatactctaaattagtgtctaaagacagggactaaagttaagtcactggatctaaacaccacctaactgatgaaacattggcttctgcctctgctcaagatgggcttaattatgctgtaattaattaccttggcaaaggccggtttgaccattaaaatggatgagacggatgaagcgatggatgaatgccggccacagcctgggctagtgacggtgatgtctaaacatgaggtggagctttttttggctgctgctgaatcactccatcatatgcaaacgtttgtttctttgcatcatgcataagctttgaattttgatgagaaccaggagagatgctcacggcatattagcatcacttgttgtttctttgcgtttcaattcttggcttgatccccatatctacggcgcatatgacgtgcagttcttaccatctgaaaactgaaagctatgttaacttaaccccattggatcccgagaaaattgcaatttgggactgcaaacatagggacactccgagtggatgataattgggcccatctgtgtttatgaaatgtgggtccagtgtcattatagcaaaagttaatgtttgcagtgttataattgcaaatcccccgaatcggatccagaggggaaatattgcagttcagaagagtacagaatgacaacattgactgattgacactagaaatacatagatttggtcatttaggagttcacaagagtacagaaaacggtcatatatatgcttcaaattttataaacctcctggctcctgattctcataccatatgctaaacttcatataatgctgtctctcgtccaaatttgattttgcaaactatagggtagatgattgcagaaaaccactccatcaaggttcagttacttcaaatttactagccctattagctaaagaaaacctgaaacaaaaacatactactccaatttaagcatgttggagaagcccaagaataagcctattttgcctccgtctcctcttgtccctggacgaatcacatcactcaagccctcaaccacaacttcaataacaggtgaatttgacttcttcagtggttttggaagcggtttctgttgacgtggtaagttaacttggttaaaatgtgctgacgtggtagactggtcatcaaagtaattaaaaatagaagtgggtcccacatgtaagtgataaggataaaaataaaaataaggtgtgagccacttgtcaaccccacttctctctctcggcgaaatgcagcacccaaaattacggcccatatagatgggtcggtttgtgtcttcccaaataagcccacatacaggccctgtatacctggatgggcctacattgaagcccatctaaacgaggcatcgggccggaatcttaccggttttgggcccttatgaatattggcgtgtcgcgacgccccacgactcatcggcggcttccctcccatcgccgacatgc

SEQ ID NO: 12878 - DNA, 1501 bp, Oryza sativa
gcctacgctcgaaaggtttatgcgtacaggggcatggtcgcgacgtgcatgaaggtgtgaatggtctactctaggttggcgtttacatagtatcactctagtgtaaaatggttaatccagatgtgataattgttttagggaaaagcctaatccgttatgtgtatgtggacctgtcgaatgggctagcaataaagctgcgaagctacgaaggtttcgcacgtagggaaattagtggtttaattcacgaggtgtgtaaaaacgaaatgagtattactaccaatcccctaatctcttatcctactcgacgcgtagaccatgtagatggattcaagttgttcgtggaacatgtctcgagggtacaagtgccatggggcacgcgctgcagtcactcatgggccgtgaggctcatatataaattagtttcgtgagatccagcatttaataaattttgaaagtgtgtttgttttgtgttaaaaatactataattttttataaacttgatcaaacttactaaagtttgactaggaaaaaaaatcaaaacgagttataatatgaaatggagggaatactaatattctaaattgcatacaaagatgaggtaagtccatcttatttgcttgattttatttgtcgtcacaaacatctccgttggtacgctagattattttttttcagtgcattgtcaacaacatacgactgccgaagaatgaggacctttaaaggctttaacgcaactcgcaaagcactgtacgcttggcgttcaaggcatacatgatggtttacgcacacgatggattgcgcacataaacaagcacatcgaacatatgagtagaatcgatgtgcttacgtccgcaatccgagggtggtggtgaaccgaggacaagaccttgacaaaattataaattatatatcacattttcaatattttggataataataaggggctaacaataaaaccgatgctgcgtttggctcataatagtggaatcagaaaggactattatataaaacagttattgccaaaatgggcttcgtaatggactgacgttgggatttactcctatcgttattcagtacacggttgagaggattacctgctaaatgtaggtgggcctggcccaccgtaaaaatttttctttctcacagcgtaaagaggagtgctagcgatcttatgtggctatgtactttgtattttgtatttgtagaccaacgtaaataggatgtaaccacgatcgcttgcttttagctaggatcttctacatcagatcatctgtaccactatttacgtacgtgtgccgatgcaatggctttctttaaacgtgatctacagtagcggcgcaatatagagagtaaaccataagaactagcacgtaattcaagtttccactcgcttcttagttttccggtgactggaatgccattccataacgtgcatgtcacttcatggagagtctgcaggcaatttatcgatattttagttgtgacgtaaccaatgtggaat

SEQ ID NO: 12879 - DNA, 1313 bp, Oryza sativa
gatactgcatccggccccaccgcccgtactccggcgggatctcaccggagaagaagttgccgccgaggtgcaggtggcggagcagcggcatctgcaccacctccatggggagcgggctggtgaggttgttgttgtagaggtcgagcacccggagcccccggaggcgcgcgagcgccgccgggaaggagccattgaacgcgttgttggagaggttgaggtaggtgaggaactggagccgccccaacgacgccgggatggggccggagaaggcattggcgccgacggacagccgcatgagcccgcggagcccggtcagctccgccggcagcgcgccggagaggttgagcccggacacgtcgaggccaaccaccgcgccgcgggagctgcacgtcacgcccgcccacgcgcagtgtgccgcggcggcggcggtggtgttcgtcctggtcccgttgccgccccacgacgccagcgcgccggtcgggtccgacatggcggccttcgccgccagcagcgcgtcggcgtcggcgtcggcgtccgccgccgcggcggcgacgccgacgaggaggaggagaaggcggagatgcattggggtttcttggcttcttggattggaagagaggagaggggagagctcacgctcgcggcgaggagaggagaggagagtggagacaagagagtgagagggagtgaggggaggagggaaggggaaaggtgggggtattttgcaagtttgctatggttttgagaacactacacacaaggccacaagggggattgtgtgtgatattggggtcataaaaaagatgtgatatttttcttgttttcttttggggtggggtgatgtgtggggtgtggttcttctttttgggggattgggttggttttataatgttatcttgggtcttggatggatagatatggccatatggcagtttgacaactttgacccatgattattctttgttttgttttctttatcataaatttagtatgtttttttattgaattaacctcatatttaggctgagtttcagatgttgtttggcttctacaaatactctattaccgtgatcatgttttttaaattgttaaatggtatattttttaaaaaataacttttatatgaaagtttatttagaaaattaaatgaactatttttaattactaagactcaattaatcatgtactagtgacttatctcgttttatgtatcgtcatttagctaactcagtttgggtttatttatctgttgttcgatggagcgagtataaattaatggtagaaaattttgtatacataaaaaatggtatgtg

SEQ ID NO: 12880 - DNA, 1501 bp, Oryza sativa
aattgtaaatttgaatatgattgaattctatgtgttttaaatatttctgtttgaattattttggtgctaaactaggtataaatatagtgtatacaaaatagaagagaatgagaaatgtggcctgagaaatgggggttgttgctgaagtacaagtcaacttttggatcctcggacagcctccattagatcttttaagggctttacaatttacaatataagttattgctggagatgcttggcagcatcatagtttctcccaccttcgtcggaaagtagattccgccaaatgcatggtttatttgatttgccattataccaaaatgttgcagtgctaaaatctaggtaattttaagtactgctatttttttaaaccggtgtatattatcggcacatcttaatagcaaattaaacaataacaaaatactctttaaagtgctaacaattcaacacggcacattttggattcaaacgagaatgcttgcatgggcataatcacttaacgtgtatttggtctggtgacaagatgagatgggttaggctcatccctctttttttttttttttaaggatatgttttcatcagtacacgtttggtagataactttctctttaaagaaatgagagaatgtggcccaatgagagagagtggattagattagttatgtcgatttttaagtacaaaactgaacccgatctagagagtattcccttttagggatcaatgtatcccacctatccccgaatcaaatacactgaagaataagttcacccttattgatcatcccattatgtccctttcaacttaaaaatatgtttatagttggaattagggtagtatgatttaaaggtgaaaaaaatgtattcaacgtagctttgaaaaggtaaagaaaagtgtattcggacttgttcttgtcaaacactttatattagtcaattgccgttgcattgtattttgaaaacagttatactcctaccttaggaattactactaggagttaggtcctaacttcaataactcctatggagattttagcgcacacaaaaagagaaaactcattaacatatgattaattaactattaactattataaacttgaagatcaaatttatttaatttttcttaagaaaacattttttatatattaaaaaattcgtatattttaaatatttaaaaatcgtgctaacagaaaacgagtacaggttagagtttgaagttgaagaaaaaaacaatgacagtggttgaaatttcctacttcctctgtcctaaaatattgctacatgacccacaaattcgttgttttacgatggtagcaacattttgggaccgatgtagtatctgtgatttcaactcaacggcccaacaattgaagcccacaaaccgcaaagcccacgaagaccaccagcaaaaataaagaagaaaccggaggtcagtttcctatctaatctcgatctctccacccgtttcccccaaaaccagcggcgccaccacccaccttccccca

SEQ ID NO: 12881 - DNA, 1003 bp, Oryza sativa
aatgattttactacgtgtttcagcattaaggctatgtgcattgcatgatacagaagatgctagaagtgcatctcataattgacaacataaatgataagtttctaaaatttgatttcacaaagaacccgtccaaaagacaaagggaaggagcgtatacaatgaacggaatcagtgcaatccctttcagaatacaaaacaaaagtaaacaaacaagcgaaagatcacaaattgaaagaaaaaaaaataagctcaccttcttcacatcatgggccagctgccttgagctgaacttgtccaagctatcatgggaccgcttagcacaccggaaagcatgcagctgcataaatggcgacatgtctgcagccatcaccttcacaccaagcacagagacgacctccttcatgttgatctccacctccggcatcgacttcctcccgggcacgatatcgatgatctccctgacctccttcatgttgatctccacctccggcattgacttcctcccgggcgcgatatcgatgatctccctctgtcccaggccaggaagatgaactctggacttctcaaggcagatgtcgccatccttctgaatggctgtaggaaatgttggagctggaggcttggcttcagaggcaacaggatgctttgtctccttcacagttctcctccatcttccaccgaatagccactgctctgcctttgtcttcctgctgctaccatggtgggctgccattgctacccaatgatctctcctccaatgaagcaatggtgactgcggatgttagctctgaatctgaatgtgtagctagtatctctcctctcccaaagatgattagttctgaatcagtatgggtcttcctaaagccatctatatagcagagttggagaatggcacaagcaaccagaatctctatagtctatagtccaacaccaattaactaaactgatggattatgagtttggattctctgcaatgagcgggtgaggcaaaggacaatttcct

SEQ ID NO: 12882 - DNA, 1501 bp, Oryza sativa
tcagaatttgctcctggagttagattgagaagtttgaaccttgccaaataggcctttatcttacgcctttctcaaaataatggcatatctcagtcaacaaaccataagttaagagaaaactgactggatgaatcaatccgtgcgtaaaacccattgttatgtaggctaatgggttagcgttcgcagcccgtgaacgcttttcgacaacccaacagcatattagcctcctccccatatcttcctctctctctatcttatcttctttctctcgctctcaacagctttgtccatccgtaaacacgacgacgcgagaagtcttggacgagcagcctccctccagcaagcttcaccaccaagtcaataattgtctccaccatcacccccaccgtgaaaccgctcggtctcactggcaccgaaaggcatcaacatgctagcgtgtcccagtgtccctgccccgtcagcctcctccctccatttctcctcacttgtcccatgccaccaatattggcccactgtcacctcctaaccccgtggcaccgacgacgccactgccacctcaccacccacccacaaccctcctagaccatccctccccacttccctccacagcgccaccctccttcccaaccccatccccgaaccttaaccctaaccctaacttggccttttttttaagggaatgctagtcgactagttctattgatcggagaacatagttacttcactaaccaaagtgcttagaataaaccctaacctggcccttatcattgtgcgttggagcacgttttccagatacctaattcgccatatctttcctatagaaggaacatccaggattccggggaaaacgtccataaaactaatcggacggccaggataatctgttacatcgctaaccaaagtgcttagaataaaccctaacctggcccttatcattatgcgtcggagcgcgtttgtcagatacctaattcgccatgtctctcctttagaaggaacatccagaattacagggaagacgtccataactaatcggacggccaggataatctccacatctctcaaccgcggcagagcaaagctaccctaatgggcttttgggcccagccgaggaagcggcccaatcaacacacacgcacgcccccaaacccccacccttctaccttcttccacctccacctcctcctcctcctcctttgcccttttccacttcctcctcccccactcccccccctcctccacacaagcacggagacctcccgcctcggcggaggaggagcagcagccgccgcaggcgctcgcggtcggggtcggggaggagggagaatctcgcgctgtctcccgattcattccggggggttgtgtggttttgagttcttggaccgggaaaagggggcgttcttggattgatcagtggaggaggtgggaggaggggggttggggagagagaggagaggaggcggcggggatggggagctgcggcgcgggagcggcggacagcgag

SEQ ID NO: 12883 - DNA, 1501 bp, Oryza sativa
actacccctcctctaccctctcccgtctcgtcgagtattgttggtatttcttaacgacattactagaaatatattttccagcaatggcgcagaaatacttctggtatattatggttacagagttcatccccaatcgcacggatataccattgtagcatttcacccgagagtattccaaggatatcgtatttattttatcccgtgggaagatcatgtatagagaactcaactaataatttatatattacttgtgataaccatattctaagcagtggttaagataatccaagggtagagtgacacacaagcatttaactactcatcctcataatatatcatctaagctaaatcgaaagaaaagagaaaggaaatctattcatatacttctagtatacatagtatatatacattctagttaactgatatactagctaataccctctattcgatgccctcctggtacttcgagaagccacccctgactgccgagttccttacgacagcccgtcatgaccatataaccggggctaaatacggaggaatatcctccccaggaaattaacttaggattatatataggcgcggaggaatacacgtagtgagctgtcaccatcagcagcccacctctcattcgcaatatataaccccaaataatgatatcccgtaatctagacactacgtctaaactaccagatactaccctaatatcatcgtcacgacatagagcaattgcataagcaaacattatacccgcaccaaagcatctgctagataagctagccgtatattcagtataacatgaacataatgtaaaataggtgaaagtatttcaataccataaatgtatatagaagagtattctaataaaagtacaaagcttacaaaagaggagaaaagctactacagccatacccgaactcttccgaaggcttccggactcctgactcctattctaattctattccactagctagatactactaaactaaacttgagagaaatgagagagctattgcttaaggtgtgtgttgaagtgaagagagtgagctccttatatagaggtagttatgatggttgtggaaggggaattatccgaagtgccctccaaccattattgggatgcaatcctggacgtccatgccaaaacctggattcaacggcgccaggattgggttcggccgaacctggggctggcccaatccagcccaatttcggctggtggcctcctctattgctctattccgtagacttgtgaattttggcccaattcatcgtgtcaattctgagttcttggcctattcacacacaagtcaagtctggttctcgatttcgtccgattgatttatcgtctgagttgatgtcgattctcctctactttatgatcattctctgcaaaaggttagtaaacctaatactagtggaatattattattctaacatacttatgcattgcaagcatcactagttctctcctattttagtaatattgacggttgaaact

SEQ ID NO: 12884 - DNA, 1501 bp, Oryza sativa
ccgggatggttccgtctcccccatcttgcggagccgcttcttcttgcgctccccctcgggctgcgacgtcggcgcgcccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcacgaccccctcctggggcagatggttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttgaactacgatcttgaagtcctcgggagcccagtcccatctggctccctggtgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccgacgcccgccagctggagacctgcgccgggggctggcttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggtgaaggcaagaggaacaatggcgaaaggaaggaagcaaatccttttctcgatgcttttatacccttgccatcgctgggcctggctcctcgtttctcgcgcccactacctcgctccctcatatctcgctatctcgctccctcgtttcccgtgcccacgcttccactaatcccattcgcccgcttacggcgcatgaagtggatatgcgg

SEQ ID NO: 12885 - DNA, 1501 bp, Oryza sativa
ctgctttcctattggtgcttagtattcatcagcaccatccaaccacagtacttgttcagctgcaacttgcaactcacggacaaaacaattatttgaggtggttttcttcccctgtttcttcactctcacagagctagactaattaattaccctttttttttctcatgatggaagtgtattgaccattgagacaagagatatgtcatggttggtccctatggagctcaagatgatgctaacactttcctgatcttggtcttgaacagcatcacgatgatcttatccatggagaagtagaggaaacagcctctcgcatgcgtcacgaaagagccgtagcttgtgccgacgatgcaatgccatgtaggtccataaactttatcaaactcctgttggatatcaaggacaagatgttagaagccaagccagattacattttccttcaaaaacaagtattaaaaagtgaagcagcaacactatttaggttctaatatatcagataatgattttactacgtgtttcagcattaaggctatgtgcattgcatgatacagaagatgctagaagtgcatctcataattgacaacataaatgataagtttctaaaatttgatttcacaaagaacccgtccaaaagacaaagggaaggagcgtatacaatgaacggaatcagtgcaatccctttcagaatacaaaacaaaagtaaacaaacaagcgaaagatcacaaattgaaagaaaaaaaaataagctcaccttcttcacatcatgggccagctgccttgagctgaacttgtccaagctatcatgggaccgcttagcacaccggaaagcatgcagctgcataaatggcgacatgtctgcagccatcaccttcacaccaagcacagagacgacctccttcatgttgatctccacctccggcatcgacttcctcccgggcacgatatcgatgatctccctgacctccttcatgttgatctccacctccggcattgacttcctcccgggcgcgatatcgatgatctccctctgtcccaggccaggaagatgaactctggacttctcaaggcagatgtcgccatccttctgaatggctgtaggaaatgttggagctggaggcttggcttcagaggcaacaggatgctttgtctccttcacagttctcctccatcttccaccgaatagccactgctctgcctttgtcttcctgctgctaccatggtgggctgccattgctacccaatgatctctcctccaatgaagcaatggtgactgcggatgttagctctgaatctgaatgtgtagctagtatctctcctctcccaaagatgattagttctgaatcagtatgggtcttcctaaagccatctatatagcagagttggagaatggcacaagcaaccagaatctctatagtctatagtccaacaccaattaactaaactgatggattatgagtttggattctctgcaatgagcgggtgaggcaaaggacaatttcct

SEQ ID NO: 12886 - DNA, 1241 bp, Oryza sativa
tttgtgctcagccccctccacatataccttcgcacataacttgccttgactagagcatttcaacccaaatcccccaaaatatccctaaatcggctagggtttcaacggtgaggttagcggaaagaggccgagaggtagcggctgtggcggcctcggcggtgcgataagtggcaggaggaagcgcagtgcagcggggttagcggtggcacgtttatgcaacatgttgtgatgtggagggggctgagagcaaaagtgttgcctacgtggcaatgccacgttggcggtcaaacgcagtcaaaggatgtttggaccggggtggtacattaaaccaaattcacggacctaaacatgcaattttcaagttcacggacctaaatgacaccaccacacaagtttagagaccggccatgtatttcactctattatttatttgataggttctcaaaacatttgatgagcacctggcactgaatagacagacactttgtattgtgaaggctgatgaatgagttcataactcgtggggtaaatcggatcatggatccaatgaaaaacaaaatttgaagaatattctggattaaggaaactggttgcattatcagttgacaatataaaatgatagtgatatattctattatatacatcaaatagtggaaacaggctcccaacattattttgataagaaagctggcctaattacagtagatatcataatatgacaagaatgatacattctattatgtatttcagaggcaaacccttttacttttaagtcctaaatatcaaaagctaccatagagtgcagaccggcagatattaaattgtcaagtgaaaaaagtagaaaatatttaggattcaaaaagcaatccaaaattgaatcccaagccaagtactacaatccagtccttgtattacgggcttgaagttctagaactgcccagtgcagcatgatctgcacaacataaaaaaagctcccagaatattttgaacgatgcagcacgaagtttacaacacgccaggtgtggaagacagagagaaataagatgtcctcgctttcatgaggtgagaacatgttcttgtgtgcattttacatatttgtcctcggaaactatgcagagttatgctttgagcagaggagtgatcatgtgctgtgtaaacactatagtgtatggaactaaccatagattactcggatataccattagctaaaggctaaaacacacaaaaaaactgcaaagagg

SEQ ID NO: 12887 - DNA, 1501 bp, Oryza sativa
ctcaaccaagatgaaccagcaccaccgtccaagtaggcctcgttggcatggcttctttgatctctcctcttatgtccctgtggtattcccagtgctttttaacaattgtggctgcgtcaatatgttgatgaactatggaaataccaacaggagcagaagtgtgggggatcaggaggcttggccggccttagcctttatatttatgcaatggaattaaaaactagcaataaattcagtactatgtgtgtgccaatcccaaaataaaattatgtactacagttgagcacctaaactctgcttaattggaagatggtatatcttctctattaattacatttcggacatgctatatggtattccattttgctcgttcagttgaagtcgttttttacttcttttgctattgctaagtttttctttcgaggactattgctaattttttttttagctagctatgtgctaaagcgtttgctcttgagaattacagtagtccaatcctaccaaattatcactgcttgtcttactagtgttggcaatcttcagagataaacccagcgctgatcatcttcaagtttcagagtcctgtgttgtcacttacggcttgtttggtaacttgagggaaggggattgagagtttccacgagggaatgagattaagatgggaatttgatttttcatcctagactcttgtttggaagaggtggtggaaattgatatggagtttagttggagattaggtcattaatgaaaacggatggctgagatttatttaggcgaagtaaaggaggaattccctcccaattaccaccccctacccaggtattgaaaaggagggagttcattcctcaattcctcatccccagcccactaaaattcccatgtctcccaactaaacaaaagagttaataacttcatccctctaaactcccaatccctcctaaaaactcccccaaccaaaacgggccatgcgcgtctgttgtcgttccaattttttcgtcgtgtcagtttggagtctgttatcttcgtgctagttcacgccgggagtttgttgcgtctttgtagcgttgtacatgcaccacaatcgctcgtgtgggatggcatgaagtcgaagtgctcgatcgtgtgcgcgcgatcgttggccacttggcctctcggccacttcttcattcagtaacaaataaaaggagagaaaatcggtaagcagcatgcaagtttgctgcataaaacttcatcgtgagttggtaattcctctctcgcgtgtgtttgttttcgccttgggaattctccgctccaggtcgccggcatcaagggacgctggcaagatttgggatcagagccatgacggcccgacgccgaccatctagaggagctctcctcgacggcagcgtccgtatctctcgctctcctccacgccatggtcgccgcctcgctgacggtgatcagcagatggtggtccagcgcattttgaaggaagtgagtggccgactcaatgatgtgacca

SEQ ID NO: 12888 - DNA, 1501 bp, Oryza sativa
aagttggaagtttatgtctataggggagttttgatatgatagaaaaatttgaagtttgaagaaatattttaaaactaaacacggcgtaaatagtgttgctatcggtgcgagtaaagacgctgcagatagcgactgacaggcaaatcaatgaattggccatttttcatgcatcaccatctcataattttatttcgtgtgatccaatccacttatcactcactgatctatgtgcaatgaactaagtccagaaaatatctgggtagctgcactttggtttgtttgatttgtacctaacttctaattcatccattggaacaattataatgtttttaagcagcgataactgtgcgatagacttatggttacatgactccaacttatagaatctaaatcctactccctctgtcctattaaaaacgaatctagaaccggatgtaacatacatatgtccagattcataataataactaggatgtgtcacatccggtactagattagttttaatgtaacggagggagttggacgacatactcacatattagttcattttcaatgaaaatttagtgggaccaagtaattgttgttagttactccctccctcccaaaaaaaccaaactactccctccgtcccaaaaaaagacaaaccctggtttccgtgtccaacgtttgaccgtccgtcttatttgaaaaaattatgaaaaaaaattaaaaagacaagtcacacataaaatattaatcatatttttatcatctaacaacaatgaaaatacgaattataaaaaaaatttatataagacggacagttaaagttggacacggaaacctagggtttgtcttttttttgggacggagggagtagtactgaatgtgatatatttgtccagattcgttgtactataatatgtcacatccagttttagattcatttttttgtgggacatagtgagtatgtctctttatgcttgtgttatggacgcactagcttgtgtatatgtgcgttccaagtaatcgaagaaaacaattttgaatacttttgattcctcttaattggaatctcaccaatttttaagtaccatcataaaatgacacttccgctctaaagttatgacggcattatattttaagcattggcccaaaatacaccaaatgactaaccatgtgcactgaaaaaggtgtcatattaacattataatgctgtgaaatatctcctgaggcacttagccccattactcatttttaaataaaataattcaaatctttaagctgatgttgaaatagtttggctatgtttggcttttttggagactcaaggtgtgattggttagggatggtaaaactttacatagtaaaaacattattgcatattttagattttgttttcaaaaagaaaatagttcatattgcatcagggaaatttggcaaccaatgaaaacaaccaattccttcaaaacaggctagagtatcgcgtctatagctttgagattttgtattttattcaata

SEQ ID NO: 12889 - DNA, 1501 bp, Oryza sativa
ccagtacgccgtcgtgttcagcaactgccaggacggcgtggaggtcaccgtcgacgtgtacaccgagatgtacaacgtgcgggacggcatctccgacgggcccagggactacctacccgtgggcctgcggccgctgccgaccatctacacggtcgtgtcggaggtgtacttcgcgttcctggcgctgtgggcgtgcgtgtgcgtgcggcaccgcgcgacggtggagcggatccacgccgtcatgggcgcgctgctgctgttcaaggcgctcaagatggcgtgcgcggcggaggactcgtggtacgtggagcgcaccggcacgccgcacggctgggacgtggcgttctacgtcttcggcttcttcaagggcgtcctgctcttcaccgtcatcatcctcatcggcaccggctggtccatcctcaagccctacctccaggtgatcaccattgatcttaattactctctctcgccattaacgaacctagaattccaggctatagaattttccatttttacagaattattgcgaattactcgttccaggagagggagaagaacatgcttatgatcgtgatcccgctgcaagtggtcgagaacctgttgctggtggtgatcggggagacggggccgacggggcaggactgggtcgtgtggaaccaggtgttcctgctggtggacgtcatctgctgctgcgccgtgttcttcccgatcatctggtcgatccgcagcatgcgcgaggcatccaagaccgatggcaaggcggcgctcaacctccagaagctcacgctgttcaagcgcttctacctcgtcgtcgtcggctacctctacttcacccggatcatcgcgtcggcgttcctcgccttgctcagctacaagtaccagtggggcgtcaacgtggccatcgaggccgccagcctcgccttctacctgttcgttttctacaacttccagccggtggcgaagaacccgtacttgtacattggcgacacggtggaggacgcggcggtcgagcgtgagatggacgacgaaggtcgattttgagcgccctcgtggatcgtccatatgatttttccccccaagttttatgcgtttcattagttggctagctgcgttaattgtgtacgactatatgtttcgtgctcgatcggagcgtcaggctcgcggattggcgtgtgcctgaaacggtgatgatgtgacgactggtgtgtctctcccttttgtacaagaaggcatgctcaacggatcgggaaattagcaacaaaattgcataatagagtgtacagcaatggacattatggactgttgttttatatcatgatctattattgattcctcggctatatatgtataattcatgcaccacaaaatatatattgacccaaaaaaaaactgaactctattatattctagtaacgtagaaactggtctcgctcactaccacatgacgggcggattgcatattcacgcacgttaactggcacccccaggctgcgtcctcccc

SEQ ID NO: 12890 - DNA, 1501 bp, Oryza sativa
agtagatatcgaaccaaccccaatgccggcacaggaaccaaatccacgcagcagagtggaaaccagaaacaagacaagaaccactggaaacagcggttgtaaaacaatcgggagcttggagtggtctacgaaccgaggaggattcgctagccaccctgagaaggaaccgcccgggaggcctcctggagagcaaaggcgccgccgccttaaccctccccggcgccggcgccggcgagaaggaggcggtgggcggagccaaggaagcggctgccatggcgagggggggatagtggaggagatagccgaaacgggtgggctccaattaaaacagtgtagtggatatttgctcccatcctggccgttggatctccgccgagatgtggatttactcctcgtcctagatgggcctgtatgggcccgtactgggccgagtgggccgtcgtattccgagcccacaacgaactgcaccttcttctccgcaagctcgggctctgtgtcgttcgttcgttcacggctcccgcgcttcgccgcgagagatggcgcgctcggcgcagttcgtggccgccgccgctctccctgcgctgctcccgacgccgtgcggtcgtacgtcgtcgagccgcgcgtcctccgacgagcgctgggacatccagaagaagccgtggctgcaggcggacgcgctccacggcgaggaggaccgcaacgccgccatgaccatgaggctgacgacgaacaaggagatcagcaagccacggcacgcggtgttcgccggaccgtccttcgtcgcgccggagccgtgcatgcttcctctcccaaagttcttgatggctcgctagcatgcaaccgatcagacgcaagcaatggaggaaagctagctcccgagctgagcagggttcatgtctgtagataaatcattaggacttaatagggttcttgtgcagttgtgctcaatcacattgtcaagtcctttatccctaattctgtatatgttcgaaaagagtcttcaggttgtaatgcagttcagcagtagcatctcagttgcatggacagtaggtttttgtttactacttctgcaactgcaggaatgtcactatttctgtaagcagtttgatgtaagttcacctactgatttgtttcttatttactgaaaagaagtcaaaaatagtttctgatcaattgagatgctacagttgagaaagaaatgtaaaatggtatgttgaatgaagcactgactccgattcacaattctactgtacaaccataaaatggggggaactcttttaagcactggggtgaagtcaaaaatagtttcttatcaattgagatgctatacttgagaaagaaatgtaaaatggtatgttgaatgaagcactgactccgattcacaattctactgtacaacaataaaatggggggggggaactcttttaagcactggggtgaacgtccttccgtttttttcatgtcaactatggctgtgcaaaattttcaaaaaaaaaatggc

SEQ ID NO: 12891 - DNA, 1501 bp, Oryza sativa
tattggcatccaattacatgcagcgtttttcccgattacaccgaagactgcacatataccaccatattcacaagtgtggccctcaacttacattcaaattagagaatgagaccaatgccatatccttggccccataaattcctatcgacaacacactggggtagtcgggtgtgtaatattcgtggacactaggattagatgcacattttattcgactggtaaatcacatatttcaccgcaagaatatgattgcttaacaatatagttttttttctactaataaagaaaccattcttatcgttcttaatggttcaaaagatatcttatcattcttttggaagccattaagtatgtggttccaatagtaacatattgatattactgacacacaaaaacattttttttcatatactatgatggtttttaaacccttatatgataaccctttgtatagttacatgttagtgtgcaccgaactacacgtactagttgtgtgtttacatgaaaaaaacttcgtcggggtggaaataaagaaaccctaagatatcttatagtatttgttggttgcttgatattttcaaacgctatatatcacttttgaatgatccatatactactctaaggttcgaatatatagccaggaagtaatcataacccaacaagtctctctagttctaaaaataaatacaagtattgtctctcaggcctacctcacaagcatccaccacctcatcgccctctaatggcctctcaaaaaatatgacactagatgactctcctatagagaaatacttttatctcttaaggaaatatcctttcatttttacatgacatctaaacagttacaaaaaaatataataagataattaaattattcatatgcgatatatatcatttcataaacatgcatgattattcatttgacctataaaatctgaaaaagaaagaacaaatatgacatgaatcaacgaggggaaatcgcacatcaaagtatgaaaaaaagaatgaagtgcataaacttgtgtgggtgggtcatttaggttattaggtccctgaacttgtcataggtgtaatataggtccaaacaagttctaacccgctccatgcgctgacatggcattgctatggtggcacctacgtgtcaattaatggaatccacatatcaagcatatataaaaaataaaattaaaaaccatattttctcctcttaagtagatagaaaaaagatttaaaaaaatctaaggtagagaggatagaatatgtttttttccctatatgactgacacataggtccgactaacacgtaggcactgccgtggcattgccatatcagcgcatggaacaagttaaagcttatttggaactatatatataacacctaagataagtttaggatcaaaaatgcatcttaagagacctagatgacacacccgtatggccgcataagttttagaaaccgctcgagcagttctctctatgaaaaactatctcctcctctcac

SEQ ID NO: 12892 - DNA, 1501 bp, Oryza sativa
aggaatagagatatcggatccgagcagcgggcgggtaatggctggatgaatgagctcccgcatgtcaacaagatctgggaggagagtgagcaccgacacggaccttcggggagcgcgagcagcgggcgggcgtcgcagtcgcagtcgcacgcgggacacgcccccgtggagcggccgagcgcctcgctggcgtgccagtagagctgcgggccgacgatgtaggcggcgaggccgagccccagcagcgccaccaccgcggtcaccagagccgggctggggccccacgacgaggaggaggaggttgagccgcccgccatcgccgacgccgcgcgcgcgcgcgaggatggctgctgctggtatacagttgggtgtctcggcggaggggaggcggcggcgcggggaggttaaaggagtaggagtgtggggggagtggagatggaccggacgcggtcggtggaggtgggatgggagtgtggaagtggagagtgcagacgggcccgaacacgatatgagatgggatgggatcgtgggatggtggtgggttcggcggcagccggcctggacgaacgcagttgtgagttgtgtttgaccaagtcagccaaacaggtaacagggtccaaggtttaagcaaaaagcacaccgaattccgcggaaaatgagtggttttttatgctctcaagtctcaatgtcttggttaccctcaacctattcgggactataacataagtataagttatgatttgtttgcgcaaggatggctaagaaattcttcctccggattaataatatttatcgttttggataagagtacgatcttaaaaaaaaaagtaactttaacaactatttcctattataatatacatagaaatatcaacaaatatatagttttcttgaagtatttttttagaaattatttatagtcaactattttaaagtttgactttacccttattcgaaacggctgatattatcagctcggagggagtagttggtcacaagtgtgacatgttagctctaaattcgagattgtgatgtatgagtcccaagggtaagaaagtgtggtatgatacagttgtggtagcgaaataaacacatgcctgagaaaatgtagcatgactaaaatgtgacgtagtaaaatgaagcaatcaaccagacaccctctaatcgtgcacgtgcaatagacgtatccgcataacacatcacacgagacataaatccatttaaaatttattgtgctttttcacaatataaatcacacatgaaaaggaaatttttataaaagaacgataacaacaagcagtcaaagtgagatatgttgtaactgcagcttcatggtgagatcataagctcaaagtgttgttgtgactaggggatgcaactggtatggatacttttcgtctgtttagacttttttcgattcaaatttttttatcggaaacaaaaacgaatataataataacactatcggccggtcggaatcagaaaacactctatgtgggac

SEQ ID NO: 12893 - DNA, 1501 bp, Oryza sativa
gagaaggtggcggcaaagcttgtggcgcgggaagccggtggtggggcggcggagatgaggaaggggggtgagctgggaggtggcagcgaatcggaggccgccacgtggacaaggagatcagacgtcgcaagcgaacggctgaaattctacggctttttttgttttcttctcttttccgcggtacaaactgtgtagtgtagtgtagtacgcgatggcaacggcgcggcgcgtacgtcgtcagtacggcggcgcgccggcgtgtagtacgtgtacttccgccgccggtggtgcgccgccgcccgccggcaatgcggccacgtacggcatttgctgggctgagccagtatttctaggcctcattcgggaggaataagttcactttaggtccctctatttgttggttagtctgataaaattacttacgtggcaattttatcagaaaaaataataaaaatcatgggacccatatatcagctacacaaaaaataattaaaaaaaagtgtggcccatgtgatctcacatgtcagcctccctcttatctctgtctccctttctcttccctttcatctgcgctcctaccatgccgtcactcacatccaccatcgatattgacttcgcccagcgtactgccaccttttgtctactgcgcctaccacgccgttgtccactacctctgtgtcatccccaatgcgcccgggttgtcgtatttccgtgccagccctttggtggctacgagctaggccctagcgaagctggttgtttctgttgccgtctggtgagagaggggaaagagagaggaggagagggggaggtgatgaagaagatgatatcagaacaacatatgggtcccatctactgactcaactagtcaaccgcggtcaatatatcacgttaaaaaccacacaaaagtttatttgtacaatatttagagatgggggatgttatatactccctcattccctaaatgtttgacaccgttggcttttttaaacatgtttgaccgtttattttattcaaaaacttttgtgatatgtgtaaaactatatgtatacataaaagtatatttaacaataaatcaaatgatagaaaaagaattaacaattacttaaatttttttgaataaaacgaacggtcaaacatttttaaaaaagttaacggcgtcaaacattttgggatggaggtaaagtagacttatttcatgctacggtgatttaatcttgagcgaggtaaagtagacttatttcaccaaattcaaatcgtttcgaaatttgcgactccgatgaaatattcgaaagcgaagccacgtggtttgaccggcgtcgcgaagcccagccacgccacgccacagtctttccagaagagctcacagctcacccagtctcgcagagtcgcagtgtcctcctctctacgtgccgacgcatgcacgccgccacgtcgcgcgccatggccacccctgctctccgacctgaacctacccgtttcgtcggcgagcacgcgcgcc

SEQ ID NO: 12894 - DNA, 1501 bp, Oryza sativa
gagtgagacctgtgtggccttgaggacggcgcccctggcgaggaagagggtcatgtggctggtgaggttgaagctgccggtgagccacgttccggccggcacgagcagcgtggtgccgccgcggcggcgctggtgctggatgcggtacactgccttgtggaacgcccacgtgttcaccgtccggccgtcgcccacgccgccgaactcggcgatggacaccgtctccggccgtggcctcgccggcaccgcaccggcgcacgtcgtcgcctccgccgcgtcacattgcaccaacaacaccaccagtagcacggtgaccgcgaagccatgcccatgcaacgcggccatcaaagaaaaaatgagaggaaattgtttgcggctaaactaaagagagagaggccaagcagagagctccaagaagagcttttttctaccggtgtttgtgtgatccctataggagaaaggtggccaaatcctgagcttaacaatgctgagagtgagggttgaagagaggaaggcaaagcaaagctatagcttgctcccaagtgcaagaatccaagggtggtgtgaggagagccaagcagatgagtccagaggatgggatggggtggctcagctttggagcaaacctgtgactcgctagctcacttactctcttgtgagtgtgagtgtgagtgaagagaagaaagaaaatggagaatgtcttgtgaaagagagccagttttggtctccagtgaaagcagtgaagcttttattcagatcttgcatgctcatatataatggctgctccatttcgcaattttcaactcaggtgtgtcagaatggtaaaaataaaaatcaaaatttctcccatgctgttagtaaggtaatctccttccttttatttgaaagctaggcaggtgttctaccgagatgaaatgcaaagggaatttcttgcttaattaacatgacagtcatgcggttgatctaccaccagatttggcgtagaggcaggggcccttcatttgctgcttttttatcatcttcttttttcttgcgtttcattgcatctaatgctttctcatcgtggtacataattaaagccattgggatcgtgagcaaaggtagaagaaacatgctttatcagcatggcatggaccaaattaaaagatctctacatgcactccagctggtattatgttttgaacgtatatacatgggcaaaatatggacttctgccatgtagattgtagaatttaaattcagtcaggtgtaagatgactgagttgttatacattgtacatacgtactaatactccctccgttttttaatagatgacgccgttgattttttctcacatgtttgaccattggtcttattcaaaaaatttatgtaattataatttattttgttatgagttgttttatcactcatagtactttaagtgtgatttatatcttatacattttcataaaatttttgaataagacgaatggtcaaacatgtgagaaaaagttaacggcg

SEQ ID NO: 12895 - DNA, 1501 bp, Oryza sativa
ctgatagaaagaaagaggcaactggctgccgatggctagcattccaatgcaaagactgactgaacatttgtttctccgtggattattcaaagatgtttttgccatgtttgagtttgaatccaaccgcgccggccggtgtgcatgcataaatgcgctgtccaatgttttgctagctgcactgcaagtgggtgtgcatgtgctcgccgatcgatcgcataattctggccgctgcttgcagttgcattggctcgattggccaatcatttggcagcctaaccaactgcaacttgttagctaggcatttctaagttatgcttaatactactccatgttttatgatcaaatttatgcttaatacttcatgcattatgaccataaaatataggattttctgaaatttactttaataataatattcagaggcatgcatttcgttcaaagtactccctccatccaaaaaaaagaagacaaatcctgggtttccgtgtccaacatttgactgttcgtcttatatgaacttttttttaaattagtattttcattgttgttagatgataaaacatgattaatactttatgcgtgacttgtctttttaatttttttcataattttttcaaataaaacggacggtcaaaagttggacacggaaacccatggtttgtcttttttgggatggagggagtagtattcaagggtattgtaactttcagactgaattgttcagtattcacaaagttggttaaagaggatggatcaaggcaagaacagagataggagtagattgcgggcctgtttggtacagctccaacttctaaattagctctaggagttgggtctggagtggagttatagagctgcctaaacccaactccacaactctagtttattttgtgagagaacttcacccagctctactctcagttttggtggagctaaaactgtttggctgagcttcagctccagaaaggatgaagctggagcttgagctgccaaacaggccctgcttcttcttcataaatcggtcagctctcatttcaatattttgtcaaagaatgggaaagtttaagaggagattgtcagtgccaggaggtataatttatactgttgttgcacatggacacaacacgccggccactggtgtttgataatggatagattcaacagacacgagtctcgatatactactaatttcgtcgcaagattattataaaccgatatccacatgtttgtgtactgtagccttactccgtcgaccatggagcttagctagctgtggatgctttaaactgccatcttgatctggcctcacatcttgacgctaactgaagaagtagcagagacgactcacaactgccaactgctaccttattattagtagctatacatagtatgagggttcactaaaccgattagatctcaatatatgaaaaccgatcgatattagtcggtttttatatgacgtttatcgaaagttatcgggttttacctttttggtcggttt

SEQ ID NO: 12896 - DNA, 1501 bp, Oryza sativa
acggtctctccatcgacaccatcaattctggtgtcatagaagtcctccatggaggatctttttccaggagagctcgcataaccatagctaaatttaccatttgcactgtcatgataacacaagaagaacaacaatatcaggtaataataacagaaacgaattctctgtcaatggctatatacagatattcgaaactaacactcccaatccaaaatgaaaaatcacccatctaataaataaaaacccccatcgtttggcttttttcataataagccaaaacggcttattaggaaataaaaataaatttgtaggtaaaacttttatatatgcgttctgggtgatttaaaaaccaatgttgttaaagaaactacgttgaaaatatctcaaaatcaatcttaaaattaagtttaaaaattttaaatttggcttattcgttggctgttcggcccccaacttgcttaaaacggatcaaacgaaaacgaaatcagaaagagagatgaagcgaaacggaatacctgaacccgccgccactgccaggcgagccagcggcctctccggcgagccccatcaagcgcacctcgccgtcgtcctcctcctcctccgctccctgcgagagacaggagcagcacgggaacagcgacaacaaggcgagaaccaccaacgagccgaggaggagcacctcacgcatgcacgcgaacgacggaggaggaagaagaagaggatggcgatcgatccggggaacgcggagctcgctcgtgtcccccctccccccctataatggaggaccggacgcgcgcgcgcgccgggcgtcacgtggcgccacgccgtgcgcgccacgcccgcgcccatggttggttttggtcttgtggttctcctcctcctcctcctgctgctgctgagcacggacgaacacctcgtcgtgggagacgaggaaatgggaggtgacctccacgtggcgcgagggcgacccgaccggagctcgcgcggggcgacacgtcgtcgccgtggacgacggtttggcgccttctttcgcggtacacgtcatggtggcgagatgcatcgaacaaactccgtactattcaactgtttgatgctttccaccgtccagatgttgcaaattaagtgcttcatatgctctttattttttagaaatttaataatttagcaattgtttttgttaatttacttgaacggatactaatgaagatgatactacgtaagatcatctaaatgcataaaagtgaattaggatatcagataatcgagacctaatttaaaagtacaaaatagggtcggatcaaatacttccaacgtgttgaaacatctggaaacgtgttgaaagttcacgaatcgaacccaacgcgttcgtactcgccaccgactcagaagtcggaaattaaactactccttgtatagaaaaatcgaaaggcttttcagattcaatcatcaaaccaaacctgttcgatcgacttcgccccggttcgaagttcgcccgccatgg

SEQ ID NO: 12897 - DNA, 1501 bp, Oryza sativa
ccgcttcatctcctccacggcggcgtccccctgcgcctccaccgcgtccaccgtctcgcgcagctgccgccggttcagcccggcgaggtacgccgtgacggcggcgctgggtggcgcgccgttgacgagcgacgccgcgtgcgtggcgtcctcgacgcccactggctagtccgtctcgcccccgccgccgccgcagcccaggtcggcgaggtcgacgcggagcgcgcggccgcggagggcgcggcggtcgaggttgcggcacgcgctgcgggcggtctcgtcgtcgaggtactcgacgaacgcgaagcccctccgccggttgccggcgtcctcgtcgacggcgaggcggagcgactcgacggggccgatctcctcgcacgcgtcgcggagctccgcctcggtggcccggtacgagacgttgccgacgaacaccacgctgctgcaccggcacgacacggcggccatggcgggcgaacttcgaaccggggcgaagtcgatcgaacaggtttggtttgatgattgaatctgaaaagcctttcgatttttctatacaaggagtagtttaatttccgacttctgagtcggtggcgagtacgaacgcgttgggttcgattcgtgaactttcaacacgtttccagatgtttcaacacgttggaagtatttgatccgaccctattttgtacttttaaattaggtctcgattatctgatatcctaattcacttttatgcatttagatgatcttacgtagtatcatcttcattagtatccgttcaagtaaattaacaaaaacaattgctaaattattaaatttctaaaaaataaagagcatatgaagcacttaatttgcaacatctggacggtggaaagcatcaaacagttgaatagtacggagtttgttcgatgcatctcgccaccatgacgtgtaccgcgaaagaaggcgccaaaccgtcgtccacggcgacgacgtgtcgccccgcgcgagctccggtcgggtcgccctcgcgccacgtggaggtcacctcccatttcctcgtctcccacgacgaggtgttcgtccgtgctcagcagcagcaggaggaggaggaggagaaccacaagaccaaaaccaaccatgggcgcgggcgtggcgcgcacggcgtggcgccacgtgacgcccggcgcgcgcgcgcgtccggtcctccattatagggggggaggggggacacgagcgagctccgcgttccccggatcgatcgccatcctcttcttcttcctcctccgtcgttcgcgtgcatgcgtgaggtgctcctcctcggctcgttggtggttctcgccttgttgtcgctgttcccgtgctgctcctgtctctcgcagggagcggaggaggaggaggacgacggcgaggtgcgcttgatggggctcgccggagaggccgctggctcgcctggcagtggcggcgggttcaggtattccgtttcgcttcatctctctttctgatttcgttttcgtttgatccgttt

SEQ ID NO: 12898 - DNA, 1501 bp, Oryza sativa
gatactgtaattagttttttttattagtactcgaacaccccatacgataccctatataatacccgatgtgacacgccaaaactttataatcctagatttaaacacccctcagttgcaatgcgttgtgttcactgtatcagatctacctagctagctgcaaattctcctttgggcttttggctaagtaaccaattaagtccaagtttatggcagagctgctctaccgactaccgatcgatggatcggcaatattgcagtagaagccacaaatgcgcaccgccggagtcgtcgaccccgagtccccgatgcgtgcatgggcgcgtcggtcggggacacgggaattattgtgcgcgtctgcgtcgtacgtgccccttggaacagcaatgatttgaatcgttcaatgagggcatgataaaccataaaccatgcacggcccatgccgtttgcgtcgagggcccaccctgcttcctcgccacagcacgtacagtacccgtttgcgtcggtctgctgctggctcgttggctggcaccagtatgcatgctgctgaaatggacaaagcggacagctgttgtttgcgaggatatgtggcatgatgatcatttctgcttctccgtatttctactggagaggcatgggcgaatttgaatgttgtggtgtggtggcactatggcagtacatagaataatgcttatgcttgcttgcttgtctctgagtagtggatgccgaggtgttcttcagtgctgccactgtggaagtatttatttggattttattggatgcagttgctgaatgtttgcttatgccatggccagctagatttcttgtgaagtttctggaaccaggtgtattgtatagtacgagatctccagcaaaagaagcagtatatgccatgtgggttccatcgtggcacgtcgtgtgacagacaagtcttgcatgctatgcgtggtaaaggacttgacttgggagtcttgcattttcggatggtcgtacggacaacgggggtcttcgactcttacaccccattagaccattcccaacccaaaacactagatagtttctataaactccacatcatcaagaaattagtactagacactactcttttaatacaagcattactattccatacttaaatttaatgctccttatcacacatgatgtcttggatattgtgtagacatgatttccttctctttcctcatttattcacttgccacatcatttttcatcctaggtggcaccttatttaatgctatggacatcattctaattattgggttgggaatagccttagagcatcaggagatcctctatcggataccctgtccgagatacagtgcacgggagtgaaaaacggggccccagtggatacgccatctagcccttcaaaaatagatgatgcgccaaaacggagagaggaagcccaaatatagcgtttctctctcctcacgctatatcacagtggccgcagctcccacccctatcaggagttttggatcga

SEQ ID NO: 12899 - DNA, 1501 bp, Oryza sativa
aattaatccataattagcctaagtgatgctacagtaaacattatctaattatagattaattaggcttaaaaaatttgtctcacaaattagctttcatttatctaattagttttataagtagtctatatttaatactctaaattagtgtctaaatacagagactaaagttaagtccctggatccaaacaccacctgatcgatcgagagcagctgagctgagctagcccaaacgcagccggccaggtgtacttaattcgtggggttgtacacacgcatatcgaagggatcgatggcaatgcgactccatgggctggctatatcgtggccggcgatgtgtttaggagtgtagggtgtgtttgctcttgcttgctcgtagttcatttctctaatccaggtcgagtttgatccaacaaaggatatatacatgtagttgtttgtatagaagatgatggatgtatagaaaactttgtttggctggtggtatgtatgaactctaagggcgttttcattcgctagagattgagagaagatttatgttgtttttcgtgcgcacgaatttcaaactcctaaaaatgtattgtttgcaaaaaaaaatctatagaaaagttacttttagaaaaatcatattaatctaatattcaggtttaaaataattagtactacctccgtttcgtattataagttagaacgttgcatcggctaattaagattggtaaagcagtatcggctggagtacatcagttgcaagctagattacggaggtagctgacggaagatggacaatggtcagaagtcgatttctagtcagacttggttggggaaagtttgtcatattgtgtcaaggagaggctgagttcgaggagaatatggcaaggtgatttatctattaattaggtggagtcagttatttttctttttttgtatagttcgactgtgcttgtaatttttgctttatccttaagggaagtttgagttgtgttggtaaggatttttctcgatgagttcttgtctttgagttgggctgcatcaattaagttcgatctctgacaagagatgagttccgtctgtagttgcttgtatcggcagggctagggtttccatcggttaagttcgacactctaaaccagtcgatacaagtgctaatttatcatatacgctatttaatctaagttaaatagtgttatttatccttatcggttgattcgcgttgaataagccgatatcgtttagattgctctttgttagattgtttagtgtatctatcacctaaaaaacaatctgttgacagaaaacacgaggcctgggagatttgcttaactccagtgcaggtccaaaacttgccttcggatgtatgagcgtgccagttgatttgatcctgcaatcaacaagaaataaagacaaaagaaccgtagttaaacctataaatgatagctgatcggttaggtaccgatgacatatcatttatatctgagccaatgtcatctgtgcattgatcgacaat

SEQ ID NO: 12900 - DNA, 1501 bp, Oryza sativa
ttttgggtggatgtgatatatcctagacaacgaatttggatagaccgggacggagggagtagtatttacaccccctaaatctttaaaaaattaatccaagtatacaaaataaaccaagtatatgtggtcacctatttcacttacacgttaaacttattagataaaaggatttctgttgatttgataaacctatacaaccttcccaccgtctcatttctttattgggtaatttggaaccatgccattataattttgcaaagtttgagatatgccatcggtatctcaatgacatgtaggatccacatgagtcaatgacattgacatgtgggtcaggatggtatatctcaaattttataaaattataatggcatggttccaatttttcctttatttatccaccgtagcttaggctgctttcggcaatagcagattgatgctttctaatctaataaataatgtgtgttttttgcaaaaaggtttttatatagcattttttaaacaatcatattaatccatattttaagttcaatatgattaatacttaattaattatgtgcgctcatggatcacattgttttacctaactggtcaattttctccttttatctcctctcaagcatataacacaattaacatttaaagtcaaactagtaaaatacccaaaaccctctcaaccatccacgaggagacataaatagcacactccaaaccgcaataccttaggaagggaatgtttggtagagattgaactcctaaatttaggttgaagagttgggactagagtggagttgtggagcagcataaacccagcttcacctctctagatcattttgtgagagagctccacccaactcctccctcatttcaggtagagctaaggacctgtttagcacatagctggagctcagctaaacagtttcagctccacctaaaatggaagcggagctgagtggagcactcgcataaaataaactagagagatgtgaaggtggatttagacaactccacaacttcactacagacctaatttctgaagctaaagttagaagttagagctctattaaacagaccctaaaacacagttggactaagaaacgcttgaagaaaggaaaaaaactgcaatatcttatttctcttgtcaccttcaccaattttctttccccgttggtttgccacctcgccaaaaaaaaaaaaaaaaaaaaaaaaaacagaaccctctcacgtgtggatccaccgttggattggaatggaaccccctcgcgactccgccagccgttacctcgtcctcgacacgccatccttttcctcccccacgtacaaaaccccccctctccccctcgcgctgccacgtatcgctctccctcctctctctctctctctctctctctctctctctcttcgccgcgcggcggaggcgttcgtcgcgagctgtcggcttccctcctcgcgcccgcggcggctgtggccatggaggtccccatctccggcggcggcggagggg

SEQ ID NO: 12901 - DNA, 1501 bp, Oryza sativa
caatcgtaagtgacaattctaaaatgtccatacatgtgtgaaatatttgttttcttttttatatggtatataagggtagaatgttcatttcattcataccgctgcatgcgaggatgacttgacatgctcacgtggcactttttgtgggtccaaggattatattaacccaaataattaatttgtggcacttttttgggtccaagcactatattaactcaaatgattaatttggaggacttgtttggacgatttaaaacatcaaggactaaactgagcccgaagtgaaacttcagggagcatattagctattcacccaatttaaaataaggaatattagaagtagagtatagaatccatatagaaatacaattaagaaaaaagtagaaatttagaattaaaaaataaggaatattagaagtagagtatagagtccatataggaattcaaaactaactaaaatttggaataaatataataaaattaaaagtagagtttagagtatgtataaaaatacaatttacaaataactaaaattcgaaattcgaaattaagaataacatgggaagaagagtttaaggtcaatataggaatacaaatatagaaatacaatttagaagtaactgaaattcgaaattaaaattaaagaatattgaaagataagtttagagtccacatataaatgcaattagtaataataacaattcaaaaataaaaataaataatattgaaagaagagcaaacagtctatatagaaatacaatttacagaaaattcagaattaaaaaaaagaagtattaaaagacaagtctagagtacatataggagtatatataatttacaaataactaaaatttgacattaaaaataattaataactaacacgtatataaaatataatatgaaaatttagaaataaaaataaataatattagaagaagagcatagagtctatatagaaatacaatttacagaaaattcggaattaaaaaaaattaaaagacaagtctagagtacatataggaatatatataatttacaaataactaaaatttgatattaaaaataattaataactaacacgtatataaaatataatatgaatattacacattagtagttttgtaaagttattgcaaaatttaaaattatgttttcattttaatatatttgaataatataatgagaaaacatatatgctattatatgagagaaaatataatgatgctagccgcgcaatctgcgcgggccaccatgctagtttaatcttacggtagcatttccaattcccctatccgttttgtctccgtctataagaagcctcattagccagctgaagtagatcatcgtcggtgcacataacatctcaaaaagtgcagataaaggtcgagacagtctgcttcttcaagccttcaacaatggcgcataagctcctctgctttgcggcactcatttccatggcggctttggtacgtgttctacattttctgagtctcgcttatga

SEQ ID NO: 12902 - DNA, 1501 bp, Oryza sativa
cggtgatttcgatccggcggcctgcgtacgtgcgcgtatgcaaaaacctggccagatcaactcacaggtcacagcagcgagacgaccagaaaagaaaatgcacgtaccaagaccaccatggaaacgagcgaggcgaaggcgaagcacaagaacttgtcagcagccattgtcaaaggcttgaagaactccctctatttggaatttttggattggatgcgcgctgctgtgagctaagctgaagaggttgatatataggcagtgccagatctaacagtgacttgttagattttcttatagagagaacagttcgtgcaggtgtatgccactctatattgaatgcatcttccaacattttttatgcttggattaggtgacaacaagttgaacgagacaattagcgatgtgagatgcgaaagattattccagaacagatcacaagcaggcctgtgacaatcatgtgacgcacaaggagagagtatgggaagtaaagtcaaacaaacgagtacatgatgagcatttttagacggatttaggacttgacgagtggtctaaaaacctgataaatcaggtacgtttattcaagaaaaacataaaacatttttttgccacctactacattattagtgcgcacattaccagcagccctggcttattatcacaactcaacactttgacagaacaagcacataaactagaggacgtgctcagtgctcagctcagctctcctcctcggcggcggcggtggccgtgctgatcttgccgcagacgctccgctcggcgtagagctggtacggcggcgcgtcggtggcgagccactgctggacgtcgaacgccgccctgttgcacctggcgtggggaccggcgacggtgacctcgacggacttgcagaaccacccgtggtgctcgccggcgccgttggagacgagcttcatgcggcagacgggggctcccaggcatggcccgcggccgctgaagatgtcgacgttgctccgctcgaagtagtcgtggccggccgccatgaggccgccccacgcctgcaggttcctgatgaggatgccgttgccggccgccgtgtagagctccacgccgatcgccgcgtcggtgccggccttccagatcgagcccgtctccacgtagagcgtgtacacgcactggttcgaccccgtcgagcccgggagcagcagcgcgcccgtgtcctcctccgacgttgctccggcggcctgcgcattcaaggttatatatggtgaagctgatcacgagatggactcataagcgagactcagaaaatgtagaacacgtaccaaagccgccatggaaatgagtgccgcaaagcagaggagcttatgcgccattgttgaaggcttgaagaagcagactgtctcgacctttatctgcactttttgagatgttatgtgcaccgacgatgatctacttcagctggctaatgaggcttcttatagacggagacaaaacggataggggaattggaaatgctaccgta

SEQ ID NO: 12903 - DNA, 1501 bp, Oryza sativa
gatgtccaattctattttgcaccaccagccaggcaaaaattttacactttttaggtgcccaaggcttccaaatgatcactctatagtttgtactggttgaagttttgtacgccaatgccgccgtgtatttcccgtggtttgtgaggttccaagtgacgtgatctatctcgccgtcggtgagctgcattccttgaattgcattccatacaactgacataatgccactagctgagaggttgaggtcttgtaatggcaaatagttgctttgaagtccatgtgtgtaaatagagccattttttttttgaaaattttgcacagccatagttgacatgaaaaaaacggaaggacgttcaccccagtgcttaaaagagttccccccccccattttattgttgtacagtagaattgtgaatcggagtcagtgcttcattcaacataccattttacatttctttctcaagtatagcatctcaattgataagaaactatttttgacttcaccccagtgcttaaaagagttccccccattttatggttgtacagtagaattgtgaatcggagtcagtgcttcattcaacataccattttacatttctttctcaactgtagcatctcaattgatcagaaactatttttgacttcttttcagtaaataagaaacaaatcagtaggtgaacttacatcaaactgcttacagaaatagtgacattcctgcagttgcagaagtagtaaacaaaaacctactgtccatgcaactgagatgctactgctgaactgcattacaacctgaagactcttttcgaacatatacagaattagggataaaggacttgacaatgtgattgagcacaactgcacaagaaccctattaagtcctaatgatttatctacagacatgaaccctgctcagctcgggagctagctttcctccattgcttgcgtctgatcggttgcatgctagcgagccatcaagaactttgggagaggaagcatgcacggctccggcgcgacgaaggacggtccggcgaacaccgcgtgccgtggcttgctgatctccttgttcgtcgtcagcctcatggtcatggcggcgttgcggtcctcctcgccgtggagcgcgtccgcctgcagccacggcttcttctggatgtcccagcgctcgtcggaggacgcgcggctcgacgacgtacgaccgcacggcgtcgggagcagcgcagggagagcggcggcggccacgaactgcgccgagcgcgccatctctcgcggcgaagcgcgggagccgtgaacgaacgaacgacacagagcccgagcttgcggagaagaaggtgcagttcgttgtgggctcggaatacgacggcccactcggcccagtacgggcccatacaggcccatctaggacgaggagtaaatccacatctcggcggagatccaacggccaggatgggagcaaatatccactacactgttttaattggagcccacccgtttcggctatctcctccac

SEQ ID NO: 12904 - DNA, 1501 bp, Oryza sativa
tacgtctatgatcagtggcgccttgcgagcgcgaacgcggagagggtgatgaggacgacgagcaggaccatggcggcgaaggagccgatgagcgagccggagatgcgctcgcagaaggagtcgaactgctggcagatggagaaccagtttgcccgcacgttgcccttgtgcgccaggtacacgatcgccgccgccgccgacgcgcccgccgtcagcagagccagcatcgcctgtgcatatatatatgcacatcacacatacgtatatccatcacgaacaagagcaatttctagcaacaaacatgtagtcagcgtcgatatatgtcgttatttcctcaccgtgtcgaagaagacgaggaacagccggctgtaccgcgccctgggcctgaggatgtgcacgatggacagcgggatggacagcaccaggtacgtgcacaccaccgcgttcgccgccacgaagaacctgtccgtccggccgtgcatgcaaaaaatcgaactagctgcatcaaacttcctgcgccttgcagcagaacacagatactattgaccctgagctgtgagtggcatcatgtgtatagcggatcgatggcttacgtgaaggacgggaggtcgctgtacttggcctcgaactggatgaactgcgtgaagaaggggagcgtctcgttggtggtgcccatggcgatggcgctgccgatcgtgccgatgatggcgatgaaccggaggaatgtgtccaccaccgcgacggcgcggttcacgccggccgccaccggcgccaccaggggcgccttcgagctgatctccccgtgctccatcactgatccgtccttcgtcatgacacgtacgcaccacgaacagcaagcagctgctagtacacctagctagcttgagtgtggcaacaacaattaactactgcaattttggttgctaaatctaagcgatcgttgcaactcagaggtgtgagaatgcctgattaattgcttattgcttgagagaacctgcatgtggcaagaccttcttatacttggcaaaagaagatttatttccggtaacaaaaccaacatggtctgtttggtcaatcatgcagcacggggcaagggtgttgatttaggtggctttgacaattcattgttgacaccaactaaagcacgccttgccattggttgactctgcacctgctcttacttgctcgagtgaggctatgggacgcaacgtaccaagtcgcaaatatttctgcttgaactaagccctctttagctccaaacccacagtgtaatgtcgatactcgatactcctagtcttttgtctacttttggcaccccctgaaaatctggacttggtaaggctcctggctctcccctgcacaatgatgcaaaattctttaatttcttcggtaatttaaggctgcgtagcgagttggtttcatgagaattattgttgaagcagttcaaagatcacaccgatgcgatgtgcatgtgctgtatttgatgaaggcatacagcagt

SEQ ID NO: 12905 - DNA, 1501 bp, Oryza sativa
tttttgagaaaattgcatcctgggccacttttattgaccattgttacatgttggactagaggtagaacattcttttcagtttgaaccagaaatctttgcaaaaattttcatattgaactagtcttgttcttcctctagatctccccctcttctcttctcttccctcttttggttcaagctcaccacactttctcaggttccatctacgtgcttgacctacgtcagcgcctgagcttgagtgtgtggtagtctccgtcttaagctcaacacggcacacggcagagctccagcttaagctcaagcacatagccaatgaatcacggtggcacggtgggaaattctaacaccatatattatcactccacacttatactccaccaactagtcaataggtcacattctagcccaagtttatccatggcagcactagcttaattggagctagggcacttaatcaaggttgcatattaaatcttgagcacgaatgaatgtggcaggggcagcgaaggctgactggctgagtagagctcgagcatgactgtactggtgaagcttgagctctatctctactaaaaccaactagccaggtatgtgaatctcaaactgaaggtagagagagtgagaaagcagagctggaagaagaacactaggtcctaagtgtaacatattgtaaaaattactagcctaaagtgaaaataatagcttgttcctagtccaagctgcgaacatagtaaagaaagccagtccaatatgcaattaactattttttttttcaacccaagtccagtagtagtatactgcaatcgaaaggggagaaaagtaaaatcgatcgcaaaacccgtgtcacggtgtcatgtacattcacggaatacgctggcgtgtagtcgtacacgtaccattaccatacatggctgctagaccctacacacgtactgtacgtccagcggttgtactgtacgttgcgctcgtctcactcgcgcgtaacgtatacgatcaggagttctgacatgcgagccccaccgtccagtggcagccacaaatacaaaaaccttcgcagccctcccgtgcggcgtacggtcaccgaaaatcaccgcactgaaaactgcatcggacccctgcttagccgtgcggcccgtgcggcgtcaatggcgtggcgcacggcgtagcctaggctcacatccggtgacctgatcctctccgtctccaactcctatgcttccctctccccgagaaatgcagtttggttaagcacacccaaccaaaataatccgcagttgcgctgcttgcgttgcgcacactggaatagccgctctctcagtataagacgaggagggagcagccggagcgcgagagggagagaagcggcggcttgggagaggctgcgtttgggtgagctgagagatccaatgccaaggccgtgaggtgatcctgtggctcgggagagggggagaggaagagagagcgagagagagaggtgagcgtgcgtggcggcgatggcgga

SEQ ID NO: 12906 - DNA, 1501 bp, Oryza sativa
tattgatgctaatgaatctagacatatatacctatctagattcattagtatcaatatgaatgtgaaaaatgctagaatgacttacattgtgaaacggaaaaaatagtttatagacaaatatagaaatatttataaacttggtcaaacttgaagcagtttgattttgattaaattcagaatattttataacttaaaacggatggagtaataactgcagtgaattttaaatttttgtttgaaattgttagcgatcatccgtgcaaaataagctactccagtactgttttgtggacacgtttgtcacgtgacacgtcacggtgcgtttgggatattgagatggcccagatatcccatgactactaaggcctggactggacgtggctaagtggttgctcctagtccgtggcctgtgggtttacggcccacttgaatcagaattggcctgcgccggatttggggtttggcacgtactgtttttttttcttttttttagacacactacaaacgcaacaaacgcagacactcaacttaaaaaaaataataataagcagtaaatacaagtattggtgttaagtctaagacttaaacctaggtgaactgatttccccataagaaacttaatcacttgagttatgttaaatttacaaacctcatgctcatagcaggaggaaggaaaaaaaatagcgaatcgtaggagataccacgcgtacatgcatgtgtgcggctgtcgtctgtgagactgtgacccgtgttgatcatggtcggcggcggcggcggcggcgtgccggcactggcaacgtcgagagccactgtgtcactggtcgccgatcgatggaaacgcatggctaggactcatgagaaaatcaagttatctcctgtgttatctaaaaaaaaaagagaaattcaagtttcaaatcctgcgtagaaggagcaaggaggagggcacggacgagacgagagtgagtgaccggagagcgccggcaggcgatcgatcggtgtggagcgttacttccgaagagtggcagctgctatcacaatccgtcgatggtggctcagttaggtacacaaggaagcactgatttgaacatttcatatacgcattgtttcgatccatgtcgactcacaccccactaattaatctattgctagtacaagctagtacttgacttcaacagctaccaaacatgccagttaatttacttgtgacgtatcgctgggaagttaatttttcatcagttctcacgccgggtcaaggctctccctatcggtctcagcgtgcctgtgttgtgtacgtgtcatggcaacgggcaatggaattcatgcaccaacccaaaatcgagagagcaagagagttacacgccgtttacctgctagctaaccaagactccgactcttctattagtacctacacatatggcagtgagactctctctagtaattacagtaagacacacttctcagaaaagaagtacagagcttgcccagagagaaagagagaggt

SEQ ID NO: 12907 - DNA, 1501 bp, Oryza sativa
gcccctgatcctaaaccgatcaatccccatcacgctcgatcgccattggcaacttgcatcgggcatcacctgcggagccacaagcccgcgtgcgcgaaaagagaaatttcggagccatcttgtacgacgcctagctctgctcctccttgacagcgacggccggcgctcagagggaaacacgcggacggcgacggggccggggaagatgcccatcatccggctgtccagccaccgacatcatattggcgccgctctcccgtgggtccatcccgtagtgtcgcgcgcagcgtacgtgacgcgcacgacgcgaacccgcgcggctcggtcggtgcaccgcttcgcccgcggccaccacttgttcccggctcgccccggccgccacgtacgctagctgcaagttgcgctggggataacgctgcgcgcgcgcgctccatgcagcggctgatggcgacggcttcccgtgtggtcgcgatcgcgtccatgtgatacgcgcgctcgccgcctcacctggttcgatcgcggttgcccgatcacccgcaacgtctgcctgccatagtgccatggcatgacgaccagggcgtcttcgcgttcaccaccgcgcgcgcgcgcgcggtcccgcgacgtgtggtcgggagcccgccaatgcagaggccccgcgcaatccgcaattaacaccgtgacgcacggagctcgcgatcgagcaggcacggccggttctagagcaacctcaaactgtccgaccgagcggcgagcggatctacgcgacagcgaccggccgtggaaccactggcccaggacgaagcgggagacaaatcaaggcgccatggtaattatctcgctacagggacgatcagtacttgcgtaatggcacgaaagagccacatcgagctctagagctggtgtcgtcagcgtgaggcggccggcacggcagatctcacggccatgacacgtcgaaatcgcaggtgctgtgcactgagctttccggagaaaagggagcactattagccaagcttaattgggtcccgagattgatcttgatctatctatattttactctttccatggtaggcttcttgattaaactagcttgttcagttggtcgagtttgcaagaaacgttcagttggtctaagatgactccacgaacagtagtttcgtgactaatgacgagagcgcgatatatatatggtctagaactcagctcagtccaggttaatttggaagtggctggatttggaggattaaatgctccgatttgctctgttgttctcatcacccttccccacatatttcgcttttcagaattaaagcttcattcacgtgaagcaaaacattatttagacgaatcaagcttgaataatgaggatgtaaataagtgaggtagatattgtgaggttccaatcgatcctgaatgaatgccgttctttcagaaattatttgagatagaaaccgatcataaatgatcccgttttttatcatgtggtgatgcatgtagacacgtt

SEQ ID NO: 12908 - DNA, 1251 bp, Oryza sativa
ggtgggaatggagaggtgcgccgaccttctccccaccgttccatggcgcgccatcgcctcacgggccgccgaaggcggaggagctcgggcgccgcccggtgacgctgcgtggggcggcggcggccgccgcgtccattggcgtcagcggcggaagggacgaggccctgccggctgcggcccgcgaggcgatggcgctgggcacgctcctccgcccgcgaggcgatgacctgaacgccgcggagggagggggccgtggcggtggcggtggcggtggccggaacagatcgacccgggcgataaaaggggatcggcgataacagggagtcgccgaggatgccgaggtcgacgtcgacgtcgtccgcggcggagggcggtcgccactccctctcccgctggccgccgtcagctgcgcacctctccctccgtccgtcgccatcaagtccccgcccatggctctcggccatcgccggcctccctgcgtcctccctccctgcccgcctcgccggtctttgcgcgttgctccctcctctcttgccgccggccgcgcgtcgccgcgcgccgttgtcttctgtggcgcctggagagagcagagatagggagatgaagagagggaggtggggagagaggaggaagaagagggggtgagttggactgacatgtgggacccacgtgggtcccactatttttttattattttctatgtgagactgacatgtgggtcccatgggtcgaattgctacgtaagcgccacgtcggacaaagaccgagtcaaattagccacgtaggcgccacgtcagccaaaaccgctctcaaaaccgccgagggacctaatctgcaccggttttaatagttgagggacccgttgtgtctggttttccgatcgagggacgaaaatcgaattcggtgtaaagttaagggacctcagattaacttattccacatgagcagagatatgggctgagtttctgcccttctctactcaattgcaggtgggcagtgtttgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcc

SEQ ID NO: 12909 - DNA, 1501 bp, Oryza sativa
cccatggagctcccttcgccttcttccccttcattgccggtgccgcgccatcgcgccaaaccgcctccgcacgccgcgcctggctgcgccgcttcctcctctcccgccggcagccggccaccgcgtgccgctgcctctccgtccccgagagagaggagaggagaggagagatagatgaagaggggagatggggagagaggaggaagaagaggagggtgagttggactgacatatggggcccacgtgggtcccactattttttttattattttatttgtgatactgacatgtggggccacgtgggccccgaggattttattatttttccggctcgaattgccacgtaagcgccacgtcatataaagaccgagtcaaattagccacgtaggcgccacgtcagccaaaaccgccctcaaaaccgccgagggacctaatctgcactggttttgatagttgagggactcgttgtgtctggttttccggttgagggacgaaaatcggattcgttgacaagttaagggacctcaaatgaacttattccctgctcatgttaagcattcggcccattgaatacttgggccgtttcgagtagttcagtatcacgttttactgtgccgattatattccgcttccggaagcaaaagttcgacatctttccccaccagtgaccacaataacacacgttagtaacatttatctctctcctttttaggagtatttcagaaaagaaaaacattaaaccagctcaaaattactcaaccaaaaagcagtaggtgttcaatgtactatgtcccctccggccatggaaacgtctggatgatctttcgtgggggtggcccatgacgacaaacgttttcacaccccaacctaccaaacaaaatggcgtattgccttcattcgaccagtgtatattgcaacctactcatatggctgtagaaaacaagtgcgttctttctcaggataaaattacgctttcttaccgaaaaagtagaacgacttgcgtcctatcacaaaggttgtatcatactattatgctataataaaataaacgtagcttaacagcttaagttttatattattcataagactttatatatgtgcttatatttataaatatattatatatttttttaagcagcagacgacggagatggtcatagacaagtcgagtactcgagtgtgcgtctagtagagattgggtgggtgtgttgctaccacctaccaggtctttcttcctgagcaggacacccaaccgtccaggaaccagtgcaaaaaatcacgcggcaaacaatgggataaaaattcacagaattttttttacatatgattcgtgagaaatggttcgatttttctgtggacctttatcatgttgaaagccatcaacaacaacaaaaaaaaaaaagaaaaaaaaaagttgtttgtgccatcagcccatcaccaacggaagccgcgaaaaataggcaaaaaaatccccaaatccaacaacctgtagcccgcttca

SEQ ID NO: 12910 - DNA, 1501 bp, Oryza sativa
cagattctcgctcgttcttaaataagccctgcttgacgcgtactaagctggaggaatagacaacggaaaatcaacggagattacacatcacgaacagcgagcttagtgctcagcctcggtagatcattcctgacttcttgtggagtgaggagctgtctggcgccaacgaacagtcggacacgttcgcctccacgttcaccggagggaaaaggctgcaaaagccaacgaccaactaaaaatacggccgcgaatacatacggtgtcaccgcgatcccactcccacgttgtaaaagagggccgtaagggttggtttggtttgtagtctaaataggtcttatcaaattttgtcaatgctaaattttagtaaattttgacataactaattttggtaaggcaaaattgtataagtttactattaaaatggtctattttcttatatatgctaaaatttagcttcaaatcaaatagatactaaacactattaaaattaacaaatattgaaattcctaatttagctctcaaactaaaccagtcctaactactgttaaaaatacaactgctagtctggtactgtcttcctgtggcgcgtgttgtgccgttgagtagtgacgtgaaaacggcaacggtcaagcgaacccgatgcagcacgcacggtgggtcacgcacatcaacggtctgcccgacccggtcacccagcacgtcgcgcgcacatggggcgagacgagaggagctgcccgctgcctgcctgcccactgcccggagtgtccggggcgacaaagcgtgacgagaaaagccacggccatgcttgttttacagtgcttgtaacgatagtggtacacgagaaaaacacactgtagtaatgggaagaaaagaacggtctagtatagctacgcaataatacaagctcagtcatcagtgcctttccccggccccttctctctctccacggttctcttcctgaaaaaaggtcaaggctattcatcacggctagcttcacaagcgggcagggggttccacttccacacttccactgcccatccacacactggtcactggacacccacacccatatggagcgagaggtctcagcacagcagttgcacttgcacacctcgcagctcgccggttatttcttttccagctttccattataaatcaggccaccactgtggtacactacacacgcccagagcccccctgcccgctaaaccctgcattgccatttgtacagaagagccagctagccagccaagcgcccaagcgagagcgacccattcctctgatctctgccgcgcattggggcttgggatttctcgaagccataaaaggggaaagctccccaaaacgaagcctaccaactctcccaactccaagccgccgcagccgcagccgcagccgcagtgctagcgagtggagggggagtgcgagaaggggaggaaaggggaaccacacccacacccaacaatggcggctgcctcctcgcgctccttctcgctctgcg

SEQ ID NO: 12911 - DNA, 1501 bp, Oryza sativa
gtggagggacgagtgacgagcaattgagtgcatttatcgtgaatatctcagccgttggtaccgagtaaaaatcgcggggagttattggaagacctgacacggtcttgctggttgctgggctgaacgcactgaaagcctcgcagcacgaatcgtaaagcgccggagcgactcgatgattgacgcgagtacacggtgtgtagcgggggcccgccgaaattccttccggatctcacgcgatccgcggacgccggaggtcgcgccaaaaatgccgtaacgggcggaatcattgtccccgggaggagaatgatggaaaaactaagtgcatgttcacttcgatgtcaaaaaaaaaatcttactaaattgacaacttgctaaaattttagtaggattttttatatagttataaaaatttggcagcaaactaaatgtagctatttttttttataattttaccaaaatttgatttgactaaaaatggcataaagtgaacagccgcccgatgcaaatgtgacggatgcgaacacaataatcctcctacttattttacaggtatctattcctaattatcagctcagtgaaaaaaaaatgcgaggtacagtactactacgaaatacagtactgattcctgcgtatttgctcatatggtatatgcttccaattaaatgctacaggaaccagtatgctttggtactctctactgaactgtgaggagctgaaaatggagagacgagttcagagagtttaccggtgctgccgtcgccttcggcgtcgccgtaccacgtcgcggtcgccggccgccactccatgtcgaccgccgccgcagccgccgcggacttggacttcccgccgtcgaacaagaacgaggcggagatggggggcgcgagcagcagcaacagcagcagaacgcagagcgagaaggagcgcgaggaggcagccgccattgttgggtgtgggtgtggttcccctttcctccccttctcgcactccccctccactcgctagcactgcggctgcggctgcggctgcggcggcttggagttgggagagttggtaggcttcgttttggggagctttccccttttatggcttcgagaaatcccaagccccaatgcgcggcagagatcagaggaatgggtcgctctcgcttgggcgcttggctggctagctggctcttctgtacaaatggcaatgcagggtttagcgggcaggggggctctgggcgtgtgtagtgtaccacagtggtggcctgatttataatggaaagctggaaaagaaataaccggcgagctgcgaggtgtgcaagtgcaactgctgtgctgagacctctcgctccatatgggtgtgggtgtccagtgaccagtgtgtggatgggcagtggaagtgtggaagtggaaccccctgcccgcttgtgaagctagccgtgatgaatagccttgaccttttttcaggaagagaaccgtggagagagagaaggggccggggaaaggcactgatgactgag

SEQ ID NO: 12912 - DNA, 1501 bp, Oryza sativa
aacctctctcggtgccatgagctacataaatttgttactcctatttgtgtttggatcagaatcttacacagtaagattaaatctgctgcacttaatcagaactttagacaacggagaaatgaaatatatgctaatcataaaccagataatggtagattggatatgcacacaatcatatgcaagatacaagcattagaaatatcattcgagttatccattcatctcttcaaagttttaaccgtaggttactctccatatctggaaatggatacattagtaaatttagcgaatgtgactcaaagttcataacctggaaacctagaatcaagggggttaatcatgtccagaaacaggtaagccattccaacttgtccttcaaacaaggaatacggctcatcaccactgtgcatgatgccatccgcaatcagttgtttagctcggtcaaggagaaagcaagcgaaagctttagcacggtagaggtgttccttctttttcgttaggcggaaaagtgctagaaatgtataggcgttcccacttactccatggcatattccaactcttttgagcagccctctattccaaacaacctctgccgcctctgcaattgcctcaaggaatcgttcttctgggaacacctggtaaggatatgacatagtatatgcagaatgtaacagattgccagaacgaaacatgcagccaaagcaggtggttgagatgagatgatctgagaatagaaaacaaacctgtgaagcctttgctaaggtgagggaaatgccaggagccccatggcaccagtgcacaaatcgatcatgcttatcctcctcagtaacagggtaattaccactagggaaccggttctgaatcatgtagcgcaaggttccctttacgcattccgtgtcatctttagtcaagtccatgtccagcaaaacatgcatgatcccagaaagtccatgagcagcaccccaatacttctcaccataccattcatacatcaatgggcagcctatcgtggacagtgttctaccatctctgataatatctctcatgacagtgtcctacaaatagttcaatagaatgatgatgatcatccatcgcatgtgcccagcgatcatccaacaagtatgaatggaagaatgacaaatgaaggcactaaagattgaactgtgtacttactgtagtggttggcggtatagtattatctccaaggtgcttgtttaggaaggtgcatgcccataggtatccagctcttccatatagaagctcatcaggtgatttactatgaattttgatctataccaggataatacatgttatgtcacatgaacatgggccatactaccatagataacatattgctttgtttagatggatgaactttcaagtgagtaaagagacatacttgggactaacattttttttctataaaacagtgcaaccgatcaaacgtaaaattgttattgcatactgtaataaaacagcagtaaaatttctatggttcagt

SEQ ID NO: 12913 - DNA, 1501 bp, Oryza sativa
cataccttgatgagggtcaaattcaagctgagttcaaccattcctaatgttctttttagtttgcatgctggtggtgatatactgattctgtggaggcaatttactgtgggagatgatagtaacaaattctagagattcaagctgagttcaaccattcctaatgttctttttagtttgcatgctggtggtgatatactgattctgtggaggcaatttactgtgggagatgatagtaacaaattctagaggtctgacataatgttcattcgaaggaaaatattttcttcatttcctttatgttgaacaaaatatattgaaagaagagtaatcaggttttgtccctttatttccgaacagatgtttttgtggttcattggtatggatttctgaaagaacatgcatctgttctggcatgatctatcacatcctgcattatttgttgatcataaggtctcaacttgtggatttggtttccccttctgctggatcctgagtttctgttggaacgtgttcacattctgaaacattgttcatttatcatatttctgttgaaggttacacttcaacatagtaactgacagtatgctgcatttttcttccattctctggatgtatagttaatcaggtcaatatacacgtagaaattagagaaaaatctttatttatcgttgcataatggaaattaatgcttacattaccacatggaacttggtcattctctgaatcgacggaattgcatcagatattccaaaaggtcttatctgaacaaagctttcttcttttattttacactatcgcactatattaatatgctttggtcatgagactgtcttccaaatgaggcatgtgatatgtcttttattcgttttaggcgctcgtacaaattacaatcatgtgttccatgtctcccattaatacgtaggaatgtaggattatgttgacagttgtgatcatcaaaagttgggtgtgatgagggtagagaatgagacatgaggtagcagtgcattgtacttctagcgggtaagcgttttgtttactttgctagatcctgttttcgttcagcttttcagcttttgtgaatgcgccaactttgtacagtaaacgtcagcttgggttctgctgaaaactttggattctattattacgaagtgaaagaaagttggtgatttatctctcaggccatcaccaatgtggtgcttcggaccgtgcccctagcgacagctgttcgcttttccgtcggcgtcgtctccttgcgatggaacgcgtcgctctggtaggggacgcggctctctccgcgcctcaccagcttttcatgggagacgcagccaggcgccacgctgagcgcgtatggagctcgtgggtacggcatcgtccccccaaatttccccttgcaccctcgcctcactctcgctctcccctcggtctcgtcgtgtcgcgcccgacatcgccggtgccacgtccaccaccgccgggaccgccaccgtcgatgcattgctgatgg

SEQ ID NO: 12914 - DNA, 1501 bp, Oryza sativa
ccttttaaaaaaacaacttgagttacttgcaaggcagattaacaacagtgacgtgtgatggtaaacctgacgttgatcagggacatgatgcagcacccaacacggaacagcagattagcttagctacagcagcagcaaacagcaaattcggagttcatcagacgacagagagagatggggaaagggaaaggaacaagaaagcaaaaggaagcgagatcgatggatcgaaaggtggtgagaaaagggagactgagaaaggaatcgggcaaagctggtgtcaactcctgttcccgatcctttttttctctttcttcccaaaaaaacattattctcgtgtatactcttctttgcttgacatatcagatcaaccagtgtaggcccatgtcttgggtgaacgaatctgctgtttttgcataattctgttcgtcgaatttggtcagattcaggaactgaagggttattactctgcttcagatttcagacaaaacttcgatctgttgggccttgggaggcccaatcacacaatcactggtctaaataaggaatatgtatatttttctccttcctgtcttgctctatgtagaatcgcctccctcaagacttattcatccaaagggaaagtttactttaggtccctcaatttgtcgacgagtctgaattcatccctgaactaaagtaacaagatataacatgcccctcaaccttcaaaaccaattcaaataaggtctctggacggtttagatggtggttttggctgacgtgacgcctacgtggcacttaaagtatttttaaaactatgggacccacctgttagtgagttccaattaaaataaaaaattacagtggtcccccttatttttcgttccttctttttttctctctcacttttctcctttcttgcttcttctcattcccggtacctggcggtcggccacaggttgccgtcctcttctacattcttgatgttgctcaacctgttctggaagaagattggcccgccctagtcggtcaccacgaatgagagggagagaaaagatggagagagcggagaaaagagagaaaaaaaaggtgagatccactgtaattattttattttaattggacactcactgacgggtgggtcctatggttttgaaaagactttaagtaccacgtcaatgtcacataggctccatgtcaaccaaaaccaccatccaaaaccgtcttgcaaccttatttgcactggttttgaaaattgaggaacacgtcatattactgcggttcagggacgaattccagacttggcaacaagctgagggacctaagtgaacttattcctcatccaaataactcagaatttgcgcattccgtggcccaagaaacacccgcaagtcaagtctcgtcatgggccttcggatagcccacgacgtggtgctatgaagtgggcctcgcattgcttcctctcccgacgaagcccagagacgagaggcacccacctgcgccgccgccatcgcagcagcag

SEQ ID NO: 12915 - DNA, 1501 bp, Oryza sativa
tgtcatcagattttttcttttaaccatgcctacatctgttttttttttctcctctccatccatgaaacttttttccaagtttcctcccctctgtttttttaaccttctactagaaactttacatccaaggttaaacaagggtagagctaaggttagccaaatttaaaaaaaacgaggaaaataaaaaaaaactaatccacttcggcccaggcccatcagacggccggcatggtctcgtggcgaagcgccgagacctcgtcgccgaagccgaacaagccggcgtcgaagccgtcgtcgtcccactccgccgcggcggcggcggcggcgaccgcctccggcgaggtgagggcgaagccagcgtagccgcctccgccaatctcgtcctcgaacccccagatctgtccgccgaacccgatggcatcctcgggctccccagccccggcctcctcctccgacgaggacgcggtggcgggcggcaggccgagctcgtcgtcggaggcctcgagaaggaacccgagctcgggctgcgtcgtgggggcaacgtccccggcgacatccccagcaacaatctcctcctcgaagctccgcatgacggacgccaggtcgccggcggcgcccccggcgtcggtatcatcgtcgagcatgtcgagcaggtcctccgcccgcagcctcttggcctcgtcggcctcatcctcggcgtcgcgcgccctcttgttgttgttgttgttattagaactgtccatggacgacggtgtgttttgccgcgtaaggaagagagagagagatagagagattgtgagatggaagagtacaaaaagcaagggggggttgctttgcggtgcgacgccgagttgggggccgcgtaatatatagcgttggacgcgggtgccgggtgcgcactcgcgggggggtttttgcgcaaaaacatgtgtggcgtgcgtgcgtgggagcggcgcggcgcggtgcggtgagggcttggttggcacggctggctctcgtgagcggagagacgttttctttatttggttttggtcggggaggggtgcgtgtggcatgtggaagaccagcaagcagccggcaagtcaggtttctatggatgtggtcgtgcctttgccttgacgtgccgtgcgttctagacgggggttggaacggagacgccttccaaagggagtgatatttttctgccaccggtttggattttgattcgctgtaaagtcatccgtctctgcctcgtgggaggggtaattgctaatcggtgctgttttaacgggtctctttttagttaagaggggaaaaaagaatggctatattttacccacgcggatcttgatatttcttctttttgttctgtgtgtgtcactgctgtgcacatttatatggttttacaatagtacagtatggtgaaaggaatacctttagaacaaaaaaaacttaattaattgttttggagtgataatgacaaaattaggattccaaatggatactacaactatagaatcga

SEQ ID NO: 12916 - DNA, 1501 bp, Oryza sativa
cctttgcagctggcacgcccgcccgcgtgaggtgtgtcatgtgtggactcgatgtggtgcgcgtaggcggccgccacgcagacccagacccaaaggtgctcactcacgaggcccagggagtgaagcgagccggtccggttgggtgggtgggtcccagatggaagcccttgtcggttggtgtgcgcaatttgactaatctttctttctttctcgctagtaccggtagtgtccctttttctcttcttctcctcttttcttttctcccttttcgaggcgtgcaagctgtttgcactgtgcacgcagcagccttccctcatggcccagcacgtgcgagctgcgtgcgccgttttagtttttcattttcctctctctcttttcagacgggataatatacagtatcatcagctgcagcagtatgcatggtcgagtagtagtagacagtatagtagagtagaccatgccggtttttgtttcggcggcgaagaaaagcatcggcgtcggcgtggcacgaccacgagcggatccgatgagtcgcacgtacggggcggcatgcgcgccacgtgacgcgcggccgagtcgccacccacttggacggactctcgctttctcatatggtggtacagtacgaaatattttatttttgtgaaggaaggtgcgaaatattttatgcagccaaatggattcccaactttgtcgtggagtcgtgcggtgcgtggagtggagatcccctgcggtgaccaagcgaacacaaacagcggaccggtcagcgtgcagcagttgcaccgctgcgttgcacgccgagtaggagtagaaaggcgggtgaaacgagtaaaaaatgcagtggacggtgcgggccaaaggttaactgcagggtatacgtagcgcgcatgcgtgccggtggggatttaccgttacaaaaaggttcgtgtgctgttttacctttgcagtcgcggtaaatgtcagtttgttagcgcactgcttctttttgtgaggtactactcgtttttgcgtgtgctcgtaaatggctatgaacaattcatgcgaatggcatgaacatgtttcgagagaaaaaggttggccggatatttgtttggcccatcacagtccagatccgcacggtgggctaacaggccgcatgatttcaccatattcgctcgccgtgttgggctaagggaaccgagctgcccttaccagtcattgatacatggaataagtacatatgaggtcccttaacttgtcaacgaatacgattttcgtgcttcaaccggaaaccagatacaacgggtccctcaactatcaaaaccagtgcaaaaccagtgcagatgaagtccctcggcggttttgagggtggttttagctgacgtggcccctacgtggcaaaatttgacttagtcttcttttgatgtggcattgacgtggcgccatacgtggcaatttgatccggaaaaataataaacttcgtgggacccacatgtcagtctcacataaatcaataaaagaa

SEQ ID NO: 12917 - DNA, 1501 bp, Oryza sativa
ctatttacgactaatcatcagacaaaccacaacttggtgatggttacgtgggtgtgcattttccataaaactagtgggcaaaatgcagtctcgcgcacagttggccttgccaatttgtaaaagcgccgagaacccaccgttgaaaaatccaagtcaaaaaatagaaaaaaagcaaaaccaccagccgtagttgagccggctccaagcgagccgtccactcgcgattggtcggaaaagaagatcgctatcggctcatcttgggtcggctcggctcgcggacgccaaacccgcggacttgaagcgcagcggatagcggacttaagaatcgaaatttaaatcgggaaattaaatagaaactggaaaaaggcgacgcgcccgtgacggatggccccagaatcccgatctccacgctcccgccactttttgcgctttagcccctgccaagatttcttatcttatcaatcctctgaataaaagtatttgaaaaagtacccactgttctggtgcttgaatgtgcggtgtatttgcgtttaagaccccaagattttcatgttttgagaattgatccgacagttggggtcacatgcttggcgctttggctggttgggttgggagcgtggtttttgcccggataaagggtagagtggttggttgggtacttgggttgggttgggtggtccattctgtacggtgcgccgggtcgtctccgtttttctgcctaagccattttggacaacaaagaaaccgtgcttgaatactgttttcttctttcttttttgtgagggatgctttttaagtttttgggtgttggtcagatcttcacactgttccatgatagctgccggcactaacccttcactgtcgattaatatatatggtcgattctatagttgtagtatccatttggaatcctaattttgtcattatcactccaaaacaattaattaagttttttttgttctaaaggtattcctttcaccatactgtactattgtaaaaccatataaatgtgcacagcagtgacacacacagaacaaaaagaagaaatatcaagatccgcgtgggtaaaatatagccattcttttttcccctcttaactaaaaagagacccgttaaaacagcaccgattagcaattacccctcccacgaggcagagacggatgactttacagcgaatcaaaatccaaaccggtggcagaaaaatatcactccctttggaaggcgtctccgttccaacccccgtctagaacgcacggcacgtcaaggcaaaggcacgaccacatccatagaaacctgacttgccggctgcttgctggtcttccacatgccacacgcacccctccccgaccaaaaccaaataaagaaaacgtctctccgctcacgagagccagccgtgccaaccaagccctcaccgcaccgcgccgcgccgctcccacgcacgcacgccacacatgtttttgcgcaaaaacccccccgcgagtgcgcacccggcacccgcgtc

SEQ ID NO: 12918 - DNA, 1501 bp, Oryza sativa
gcacaaaacatgcttacgtgtcaaacgaggcacgctacgaaaaaagaggaagctgaccaatcgacggcccctccgtggccacatgtttttgcccgcttttccaaaaaaaattccgttccgttttacggtgcccgtttaccttggccctcaagttagctggaaacacaaaatccttccaattctgtcgtggggcctctcacgataatttcagcattaagtactttatttattctaaaaatatctatcgccatttccatgtgtcagaaattagttctgagttaaggacgtcttgattgggagattagccttggccgcgtggaatctcaaccatagaatcccaatccccttcttttccgttgccctatcactagatctggtcactatgcagaagtgtaaggggcccacatgtcatggagacgatgatgtacaggccaggcgtgtaggtgaagcatttatcatttgctagccgcctcatctcgcccattcgcttccccgtcataaagcccccccaaaaccctccccacctctgccatttggtgcttatccccatgagtggtggggacacatcgcccgggccccacatgtcagctaaaacccccgcatgcttccggacggtagcaccggtaccgagatttttactccgcgaggtgaccgctctgtcactgcgcgtgggcccggacgtagtagtggcccacccgtcactgtgttcgtagcaggcgactgtgcagaaatctggtgcgtgaagccgcagaatatcatccggaggcagagaggccactcccgcgtgacatgagggaccatatggtggggtgggcccacgcgtcagtgtgatggggtgggggataggcgcgtgagggagaggaatgggtggaggagtgggaggggattaaatatcggcggaggagacgagcccaaccccttttgctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcaggtgcgtccgggtgccccttccccaccgtgaaatttttcatctttggcgaggtttacgccgatctggagtggatttgaccgggtttcgcggccggttcgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagattgacggattcgatcgattcgtgttcgtctccgtcaaatttttgcacaagagaaaaaaaaagtttccc

SEQ ID NO: 12919 - DNA, 1501 bp, Oryza sativa
caagattttaaagttgggtatttctgtctaagtgctaaaccgctggccatccctgcccctcgtggccgccggccacccaaccagcctgaccgcctgagcttggcagagtgtcgggtgctggcctccagcggcggcggcaatggtctccccctccatggtagcacggtctagctcccgccgccggttgccacctagcctcgccgcgccgccgcctagggtttgcaaatggggagcggcgcgagggagccgagccagggagggataggtcacggagggagagcgagagggcgtcgtctggaagagtggtggctaagtaggtcaactgatgtctgatgggtcatgacggagtggatcaggttggtaggaggcaatgcaagaggccagttgggccgtgtttggatcgaagagttgaggatttaggtgcactaatatgtgtacatgtgtatatattaaaagtatacttattttttgataaaaaaattttaggtattcccgggaatacccaggaaccaaggtacctccgcccctgttcgccgccccgcgagtcaccgccgccgcatctgccgccccgcgagtcgccgtcgccggtgctccgcccgtcgaccaagccactgtgcgccatgagcttcgtcgtcgcagctcccaaggcctggccagcggccggatggagagtcatagaaaggagggagaacggtgggtggaggcggagagaggagggagagaggcggagaagcacgtggaatatattggtgggcgcggattttaataggtgggcggtggatttttcgccgtggtgctctttaatctgattttcggtggcggcatcagggaaaatagcaacatcttcgctagtggcccgcttaactcggccgccagcaaaaatctgttttcactggcggtccgtagccctccacctcttgttacgtttttgctagcagttttctcgtatgaccgtcagcgaaaatgatagaataacgctatgaaaaatcttttttctagtagtaaatacccaaatctacataccagaacaggcgaacagctcttcaaatgaattctgttcaaattgaagtcacgtactcgggctttgataaactcttgagctactcacacatgcgtgcacgtacatcatatcaaatccttagttttttaaccagtccgccgatgaatctcagcgcgtcttgggttgctacagggcaacagttcctgtttgcttctgcgccgctcgatctgctcctctcgattggatccatccgtccgtcgtctccttgtggcgggcgaagccgcgatgcttccttcctctatcgtatgcgtcgcttcgctggccccacatcccaccaaacagatcgatggatcccatcccgcacggctgcgcaattcccccacgcatcgctgcattggggcgagaggggaaccgagctagggtttcacctcccccgcccgcctcctcctccttaccgcgcgaaccgacccgacccccgcttcgccgctgccgcagccgtga

SEQ ID NO: 12920 - DNA, 1501 bp, Oryza sativa
agtacagaagagaacgactgaactctgagattactgacgagatccttgtcgagaggggttcaacgagatctatcggcgagtaggcttcaagtcctccggattgcgtctatggtggcaggtgtcttgcactaagatttgataccctgtatcccttagggggtttgtatttataccgtagatcaccttagtctccaagtagaagtcggagacaacggaccccgtacgaccaaactatatcctaatcctctccgagtaggactctgttactttccatttcacaaatactatttccttgatttatacagatccttttcgtgtacttatggatataccgtatccgtatgtctcatgaccctaaggatagagggtatgacttatccataaccctgacaatattcttgtccaatcacctttattctctctcctcatcctcctatccccttgttcttttttttatgtagaactagtttgttgcataaaaatggtttcttcatcttttttccctctctactcattaactcttttgccaccttatttttttcttatgtgacaatatatttaatgatgagtaaattgcacccatgatgcatcaacttagcaggtgggtgcaatttggtgcaagaacttgagaaatgagcgttctagtgcaacaacttggcagataagtacaatttagtataagaacttcataagtgatcgtataaatacaacaacttacaagatatgtatgattttgatacaataagttaagaagttattcaacaacttaattatttggagcacatttttacacatattagatttttaagtacttattttgataatatactagcgtgggtttgtatataagtatatttatatttttattctaataactaataactgaaagtcaattaaactggatgtagaaattattatatttcggttgagatttgggaaggtgaagaaaacaaaaattcttgaaggtaattggatgtgcagtataattcttaaagattaaatttaatattgtaagataatatctgtaggattgctatgtaacagcatattgacatcgtgaaaaaaaaactcacctagcatatgcttagctaagttgatgcaccaaaatactaaattgtcaagttcttttactagaacacacccacttgtcaagttgttgcactcgaatgtttaattcttaagttcttgtactatatcacagccacccgctaaattgttgtactatgggtgcaatttactctttaatgctatagaaattagctcatgtggagggttgggaccgttctaattaattacccccatttcatgcaaacttaatttgcatgtatagacaataatactgcacgtcaaatgaagatgtcagtgttatgtgacgatcagtttgaaatttctgaattttttttatgtgatgattaatatggcatggagggagtatactagggacatttaaacactaaagtagctatatttttggatggttgtgtactttgtaaccgccttt

SEQ ID NO: 12921 - DNA, 1501 bp, Oryza sativa
atgctaagtaacggtatcttattcggatgaaataataccttaaagatttcgtctctaatacctaatagcggctgataccctatttgaaatagggtatcacacgatacttatgacttatgatatattatttcatggaaaaagtacaccgaaggtcactcaacttgtcatcgggataaaaaacatcctcaaaccacaaaactagatatgtgaggtcccttaactatacaaaaccagtcacaataggtttcttagcggttttgatcctggttttgtcttacgtggctgctgagacagcgtgagccccatatgtcggcctctttctttcccttcttctctcccttcctcttctctctctcttctctggctctgggcaagccggcgccggggcgaggccgcgaggcgggggaggaggtccggcggggcgaggcgggagaggaggtccggcggccggcgacgtggcggcggcggcagcggagacgacgcgggatcaggggagcaaggcggcggcgacgacgacaacgcgggagcaggggagggcatcggcggcggcgagggtgaggagccgcctccgccaccatcagcgacctcaggacggcgctctgttcctccttcactctcgcgctggtttcccttgacttccacctcttcctcaagggcaccaagctcatggccgacgcccgaggtcggaaacctccccgtcggccccggcgagtccatctctttcatccctgtcaactccgctgcatcctcccgcttggaagccgacgtcgagctcgagcacgccgaatccatggagaaaacgcaagttttcttggcacgacggcggcggtgaagacgtccacgccaagaagccaacgagcccagcgctgccgccgccgctctcctgccatggatgtgtagttcggggatgtgaatgggaatggattggatcttgggattatggtgtccgccgctgttgccgatcttgatggcgccagggttgagctcaccagtgggaggatggtgaatgcctggatcgagtactcgcccaccttgtcgtcgccgtcgaagccatcgccacgtacgacggcgcctttgccgccgccggaagcgccagtttcatccgccgttccgcctcccgtgagttttaatccaatgcttccctcgcctccgcagctccccggcgtaaccacggcgccgtcgccgccggtgtccacggtttcgatgcctcccaccagctccgccttgctcccctcgccgccgccgacgcccctcacctgctcccgcgtcgtcttcgccgccgccaccgccgccacgtcgccggccgccggacctcctctcccgcctcgccccggtgccggcctgcccagagccagagaagagagagagagagaagaggaagggagagaagaggggaaagaaagaggaggctgacatgtggggcccacgtgggcccacgctgactcagcagccacgtaggacaaaatcaggatgaaaaccgccgagggatctactgtgactg

SEQ ID NO: 12922 - DNA, 1501 bp, Oryza sativa
ctaaactacaaaaccagatatctcgacccccaaactcttaaaaccggtgcaattcttttgcatgtcaatgataaatgggtcccacagatatttttaattctaaatgccacctaaacgccatctaaacgccacgtgtaaaggagacccggtcaataccgccacgtaagcgccacgtcagcaaaaccgccctccaaaaccaccaagggagtcaaattgcaccggttttaagagtttgggggtcgagatatcccgttttgtagtttagggtcacggattagatttcgatcacttttgagggtcactgagtgaacttattccaacagatggttccaggtcctctttgtgtaggcccattacaagcttgcaggcctaggaatgcaatggtcggcccaagaagccaaaatattgatttgttaattagcaacaaattaatgccattcaaatataggtttaagaggtcaataaaagcaaagattaggatagatcgaatttaattctattgttgatggccttttcctctctatataaactgctctgctgagcaatgtagcagcaattccaaattgcaatagaagagcaagtgaaaagcttagaacacaagagagattcagccagcctttttgaatttccaatatcctggccatatctgtctatcatggcgtttctcaacatcaaggacactaacagggtcatgtttttggcgtctcttttactcatggccatggtctattcatgtgctgcacaaggtaattataaaagagtttctgccatcttaatttacaaaagtatcaatacgtataactcaattctccatccgttcataaatagatgttattttttatatatagacagtcaaatttgaagaactttggacacagtatacatataaatactgttatttatcatgtgaagaattgcattggcaaataattgtgaaatatttttttaacccggtgttttgtgttatatgagccatatatttttggtgtcatctgaaaagtataacaaaatatggtgtttcatgctatataaatgattctgacacacaatatcttccaaaatttaattcatacattgagcctccctttgattgtcaaaaaaaaaaaggaaacttggatgatttcaattgtataaaaaattcttagaaagacctttgaaaaggattgaatctatctacttctttaaaattcctataaaatagataattctataagaattttagtggaaaattagcaagaacttcaacttgttgggacatatctttgattctgtttcttttttctgattccctcgtctttctggtggtctattatattcaaaagattatttatgtattttttttatcttgtacttatatttctgtttaaatcttactgtgttttgtgtttgtattcctatcaaaatttatcgaattttttttctttgtatatttattatcggttttttcaaccaaacgttctgacccttaatcgaatatttgtgcacagatgattggtgccat

SEQ ID NO: 12923 - DNA, 1501 bp, Oryza sativa
agctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgagg

SEQ ID NO: 12924 - DNA, 643 bp, Oryza sativa
ggatcccggtttttaggaaggggctcacaatagtggctgccattagagcccttgagcgtcacttaggcgttgcactaccgccaaagcctggcgcaccccaaccaaaactcaaatttcaaactttgccaaaattcatgtgtttcgggagtttcgttttggtttgatttgctacaagtaaattttttgtttggaagttttgatggatctaattgccaaagagatgatttttgagttttaaaagttaagtttgggcctgcaaaacttaaacttaaatgggcctttaagcaacaacgtcgctacctctcaacatcacgcctgccgatgaagcagctacgatgtttgacaagagcttccacgtacgacgaactagctatcacactccatttcgacgtgcacaaacgccatacatattttttgtgttgctgcgaacgctgcacgacctgcctagctaaccctactcaccatagacgtcctagtctgttgattcgtataaaatctcacattcgatcttagtcgccgtcgtaattaacagaggctcacgtacttacggtactagtaggacagacgacgatcgaaaggaacgcaatgcttacatctgcgcttaatagataggaagtggaaattctaccaaacacaactataa

SEQ ID NO: 12925 - DNA, 1501 bp, Oryza sativa
atcaccacgtacgagggcacgcacaaccacccgctgccgccggccgcgatggcgatggcgtccaccacgtcggcggcggcgtcgatgcttctgtcggggtccatgccgagcgccgacggcgccgcggggctcatgagctccaacttcctggcgcgcaccgtgctgccgtgctcgtccagcatggccaccatctcggcgtcggccccgttcccgacggtcacgctcgacctcacccacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaaaaacgagttcggatcagtaattttcacatagatttccaagtttttactcttctttgttcaggataggttcttgatttctctcctttggtttcgatagctcggccgagctgtgcagtgggcacatggtatacactttcttttttcttctccactttcctggttttgcagcagcaaaaagttgtattaattcattgctttttcttagttctttttctaccgcaaaaacagctgttgatacttcgcagtaagtaataatcagtacaataataagtataataatagcatcttcctgagaattatgtacacttgtcaaagcaacaaaacaaaagaaacaatgacagcttactagatccctcttttctacgtgtttgttcatatcctcagattgtttttcatctaacacttaaatttcatcgcttgttttgtttcgctttcttctcattggccttttcaaacaaagtcacggccaggcccgggccggctctgggatgtgaatgcgatatctgtgaaccgtaattttttttttagaggagaccccagcgtagacccagtcagtttccagcagcttagctagctagcctagcctggcccgtcacgtatttgtactattaccggtcttccgttggactgtgcatatactgacaacgttacgcatacgttggctttgaacacgggatatgttaattcctgtattgactgtgttccacatcggcatgggccatatatatatacatacatacacacacacatatatatatatatatatatatatatatatatatatatatatata

SEQ ID NO: 12926 - DNA, 1501 bp, Oryza sativa
tctttctcttttctcggttggggggcaagtaatctacggaaggaaccttctgaccgtggaaaaaaaaaacgcccctcgtgcagtacatgctgacctcaatatttcttccctattgcacacctgcatcggcgctcgtaccgccggagatcgaatccgagataaccgtagtagtggcgatcgatcgacacgtcgagcggcggagtggacgtgtacggtgcaccgtccatctgcccgtgcaaatgtacacaaaacctctttcatcaagctacgtggtgtgggcgagtgacagcgcaacggtggatggatggatgatggatgttgaaaaccggtagaccggcgcggggtgggagtcgccgttgcggggggcctcgctttggttaatttggcgttgcgacgacgggagccgtcggtcgctttccgctccacggaaaaaaaaaatctcacgctttcttaacgagttgggattctgatccggaagagaaaaggcggaaagctaaagtggagacacgcacgtaaacgagccgtctccgcgcctcgccggaaaggacgatccggtcgcctcggcaccaggctcgagtcgtcgtcgactcccgggtcggccaatggggactcgccacgtgtgcgcctcgccactgacgcagctcctgatgtcagagtcgagggtgcttcccttttttatacgagcctcctcccaccggtgagagacttcagactctcccactctcttctcccccctaattatctctctctccctaccacgtcgtcttctcttctctatcttctccgcctccgggaagaaggacaagaggagtaggagctccagttgcatggacaagggccacctcggtggtggcggaggaggaggaggtgggctgctcgctctggacgcgtcgccgcgcccgctcggcttcttgaacctgctctccccgccgccgttccacaggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaacgttagccgccgccgccttcttcgctcgtcgatcgccagacacctgtttaactcacggcgatctaacgcgtgtgctcgtccgtgttcgttgcagcttcttcccgccgggaacaacgcgaggagcgaccggtcgatggtggtcgacgacgacgcggcgtcgcggccggatcacgaggagaagagccggagcagcaacgaggtaggtagctagcccggcagggccggttgatcgatacatacagcttagctaactaaaattcatcgtcatcgcgatctcgattattcgacggggttgaccctgaccgtgctagctcagcggcgagcatggtggatctgacccgagctgaccccgaccggtggtca

SEQ ID NO: 12927 - DNA, 1501 bp, Oryza sativa
gagaagagggaggatgatacgtgggttccacttttgttttgtttctttcttttttgccacgtaaacgctagtcagcatgaatgtattaggtcaacttgtcacgtcagcaaaaccgatcatccatatagcccaaatacataatttaaaccggttttgcatgttgaggatgagatttcttgtattgcggtatagggatgtgatttaaactcgatagaaagtgacttattctgggtgggctgcaattttgaggcctatctggaccgtgatgagcatacctttcgtttggatcatgcatccgcgtagttgatcaaatcataaacttttggttaaaaagaagttaggagtttaatgataatcagctgtatgtgataagcatcaaacttgaggactccatatagtgttataatccactttggattttaggttctaattttcgagttagtttttagagttgttcttagttatttgttattgcccgggttcttttttagtgattcctaagaggacaagtaaaaattcacctaaaatgattcttaagcatgaaactaatttaaattcaaaaacactttataaagaagtaccaagcatatctatctcggtcaatcgatatttttggtgtataacaaagctagttaaatgtgaaaccacagagccaccataggttactttcagaaaaaagatggaaaaaaacagagagcataagagtcattttatagcagtactagaaagaggcaagaccgcaagagttacacgcatcatcaagcacaccatagaaatcatacaccacatcacggttgcagacaaagttgcagattccagcaatgacgcaattaaaaccgaaagttatctctcaaaccatttcattcaggccctatttagatggaacttaaacttttaattccatatcacatcggatgtttggacactaattataaatattaaatgtagactattaataaaacccatccataatcttggactaattcacgagacgaatctattgagcataattaatccatgattagcctatgtgatgctacagtaaacattctctaattatagattaattaggtttaaaaaatttgtctcataaattagctttcatttattgaattagttttgtaagtagtctatatttaatactttaaattagtgtctaaataaaaagactaaagttaagtttctgatacaaacaccacctcaatccatcaactcatgcggtgatcgatcgatcagcttcatcaaaattaagccggcacgcaagcctgaaagctaccgttgacgtatttgcttcagagcacacgtattttttacccatgccagattaccaaccttgcaacgacttcttcagttcagttctcctcatgtacgtctcctgcagagtctggcaagattcgagagctatcttgacatgttctgaattctgatcgcgacatgaacaccatggttcgttcggttttttcaggaaaaagaatcgcatgactcgccaagcgcataatta

SEQ ID NO: 12928 - DNA, 1501 bp, Oryza sativa
gcacaaaacactagcaatctccttcaaatgctccaatatgaaaggaggattggtcatgccaatgcgaagcatcgtgcttctgtccgcaggaagctcagcagcaattccatttaatagatttggaagatttgtaccgatatccctgcctgaaaacctcgcaaagtcagaggagcaaattgccataataattctatggcttatctctcagaaggaatccaaaaagatctggacaatggtattaccataagcaccagtatcctcactactcaaccatatttctcggacaccttcagagacaacaattttcacacgatctacctagagtagcaaaccaattttcatgcttgagatttaaataaataagcaaaacttcctacaggaaacaaaacatctatgaacgtaccaaactttctatagtatagcttccaagatgaccacgagcatgctttgtcttgcagtatgtgcaagcacccaaacacccaacattaataggaagaatctcgataaatttgttcttccttacctggaaattgtagctgtggtcagtcatcaggaatgatattagtatattacatctgtcagtggtaaaaaggtaatagcacataacattggcactatactagccataaaagattgatacatataacatcatgtacagaaatatgagttgtaccttaggtaaatcaagtgagggcagtgttttccgactcaacaaccgaacctcatggccttttaaggtttcttcaacaacttcaacaacgcggtcaatctgttgcactccaataacgctaataccttcaagctctttcagatcccggcttccttgtggtacacatccagccacaaccaaaggcttgtttgcactcttgcacttcgatatgagagttgtcatggcagactgacttgggtttttcacagtgcatctgaaatggcaaaataggtgtcggtcacaatatattcttcacctctgaagttaatttgaaggtttgcccctacgtgtcaatatatatctcactcttcggcactgcaagttggatttatgcttattatcccaagtttacacagctcatggcatattctagtgcaaaaaatagcgtagctagttttccacaacacaaatccagagcagcaccagtttgaaaccatcacaggttaaattcaactcatgtgtacttttaatgaacgtcaggaggtaatagatggaaagaaacaaataagagaagaaagaaactaaaaccatacgtgttaattagccacaaatccgctccttcgggctcttcagtgatcgcatatccaaacgctgacagctgccctgacatgtactcactgtcactctgcagagcaggaatgatcaactggttattttacatagctaacaacagcagaaccattggcttcctagcatcagcacaatgaataagcccgctagaaccacacactatcagtggatcactacttgtttcagcacttcaaccagaatttcttcatttgctagtggaag

SEQ ID NO: 12929 - DNA, 1501 bp, Oryza sativa
gtttttatattacggagggagtaaaaattacgtgtcaaaaccccaagatataaaagataaatgcaaaaaatacgaaagatataggcaaaattacgtaatttatgcaagttgagtcctaagaaaattatggctacactccctgttcgatcaacgattttgttaaagtcaactgatatgcgcggctcagattcaacatcccccaggtggcatatgtggtgtgaggacagatgtctctgtccacatatatcataatcgaaaggaaggaccaaaaccaaccccgagtacccgaccaaccaccaccacatgagcacttcgcacggtcgtccggctcgattatttcctccgcccgcgcaaggaaaaccaacctgtaccgcttcctcgcgcgagccacccaacgacgccgtcacggcgcggcgacccccgcgatccacccacatccgcctcgtacgccgaggcttgcgggtcgtacgccgaaggcgtgcgtgcgggtggccggggtggctgccgcgtcgccaacctgcgagcccgagccgagctgatgcgtcgggatcgcgcggtgcaggtaggtcgtcgcgctcacgtacggttccaccaccaccaccaccacgtctcgctctcgctctcgcggtcgcagcgacgggcttgacgggacgcgctggtcggaacgtggagctttgttttcttgctgttgttgttgtgagaactgagacaaaaggatgctgctcgtttgcgacttgcgagctgccagaatattcacaggttatactacatctacagggatgtaggagtaacttgtactaacttgtaagccctgcgtgacgattccacttgtccgttttctcctgcgtggccccactgggaatcccggcccgagtcacagtcggcaaacggccgcagatcagtttgaggagtcaggggcctcagggcagcagggccaggatcagcagtgccgaaaactgatgcatcgatgcagactgaagcctttctacgtttcgaaccagaaaagagaaaaaaaacagtcgagccagaccaaaaaaatgaactggggaccaaacacaatctttacgcccttacatatcgatatagacaaatcaacaaaaataaaactgcatccatgtgtacgcatcgggaaagaggatcggtgaaagaacgtgacgaccatcactctgcatctggagtgtactcatcaccagctggtaaacaaataccctatgatcaccaaaaacgcggttgatccagcctccgacgcaatcgtattttttttatctttctgaatttttaaattcaaaaacaaatctttttaaaacctattttcaatatttgaacagagtggcaaaataacagtgccacgcacattctgactgacgtggcagcgtatttgaccatgacaccctagctagcatgataagacaaaactgtcactccccctgtgtgcgacgtgtcggtgttattttgccacgttagatggactgtacatagcccaaatgatcagattctataa

SEQ ID NO: 12930 - DNA, 1501 bp, Oryza sativa
gttggaaagtaatctaaactataaacctttttgtttcttgtgcatatgttcttggcaagaaatacatgcatctctaatcgtctttatggaaagtgttggtacttatgggatcttaattctctcaacttgtggtcatcatgcttggcagttagcagataagtcatctattggaagtaatcctgtaccaagctgaacgttgagcattttcttgtaattttcatggacaaatatatctcggataggttctcaggcagtcctagctatttgcggcatgcatgttccttataaagtttgcaggatcctatataactgacagttgttgatctgttttgatgtacctttataaatggcatatgttactatgtaattctgtttctgtacattcttcgacttactccgtgtatgctagcatttatgtgattgacatgttctttgataccatttttatataggtagtccatgtgtacttccaattttcttcttctctcctcttacaagttatggtgtaatggcaatactttatccactggtatggagaaacactcactagcagcattttttgtttccatttaaacagcatgcagacatacttgctcttgtaaaataggcatagaagctagacatggaaaatcccttaaaagcactaactcataatgccattcccaattcttatttgggccaatttgtttggttccatcacaaaaaacacaagagttggaaaataccgtcgcacgtgtcattgacaggtgggtccagacaccacatgtcaattgtcattcttacatatgatgttaaattttaactcatttatctctacgatggtatttttccaaattctcttattaaaaagaactcaatccgcaattctacatccagtccttttctccaccgaaactggtgtggaaactggatgagaaaaaacagtatcttcctttgttcccttccatctaataatatttcccatccaacatattctgagtgcagttatgcaatgttgtctgttgcagtttgtattgactgctgcaggtacccaagcagaaaaagtaattgatcaactgaaaccttcgcatggagggaaactgcagagaatacctgttttcttcatagctaagcgactaacgtaagcactcatcatatcactcattcaagaaaattgcattgttatatcattcaaggcttcacaggaatcatgccattttcttgtatagaattagctaccggtgctaatgatgtgagaatagttaattgctattgtttgatatattatcttttaaccatatccttccaagtaaaaattggtattggttatttaattcttattttcatcttcttatagtcttaatctgaattagaattcagtacagtatgctgagtgctagtattcagaatttcagattaatttccttttagggattatcacagttttcctgcaccactgctactttgcttcccttgggtgcactataatgtattgaaacttgtctgaacctgtatgtgcagg

SEQ ID NO: 12931 - DNA, 1501 bp, Oryza sativa
ctcgcatgcaggcgtacgtggctggctcgattatattgaccgtgcggttgagggcggccaccacgtacgatgataagaagaagatgcacggatgcaatgcatatgcagctgcaggtgttgattcgaccgaccagatcgacgacgatgtaatggatcatgtatggataagtcatcatccgaatcgatcgatgatcgatccccacatgacatgcatgatcctgcaatttcctgccgaccattttgccctaccccactatcaattacgggtggtcgatcaaatgaaatctttctcgcgctccctcgacctagtttaagagcatacttgcatgcatgaaaggtttcttctaattttcagtttggacaagaacaataaaaatgagcgatttgaacagcttgaaaactaacattccaaaaacggaacgaaacattagcatataattaattaagtagtacagtattagctactacctccgttttttaataaatgacgccgttgactttttctcacatatttgaccattcgtcttattcaaaaaatttacgtaattataatttattttgttatgagttattttatcactcataatactttaagtgtgattaatatcttatatatttgcataaaatttttgaataagacgaatggtcaaacatgtgagaaaaagtcaacggcgtcatctattaaaaaatagagggagtaatttttttaaaaaaattaatataacatttttaaaacaactttagtacgataacttttttaaaaaaattcaccgtttaaccgtttgaaaaacttgggttggaaaactcagctgcggaacacaggctgagtagtaatatctgtctaggccctttaatttcacgcttcatatgcatatgtatagcctcttattcttctttttttttttttgagaatttgtatagcctcttcgatcgtataattaaccagcgttgcgtttggagaacggccgagcacacaagagtgtgtcctagcctgccgtggccgtgcgtacgcacgtatacacgtacacatgcgtgtgcgtgcacgctgctgggtggtggtggtggtatatagtggatacatcagccggccacgtacgaaacacgactactgccctccaggtagctagctgaaattgcgacgacgacgacaccaattaattcgcatcgcacccgtacgtacgcgagcaatcgcaattcgcaatcgacgacatacatccaacactggtcgcgcgcgctactgatgcaacggcgcgatagcacgtacgtacatacgtcggtacgtgcgagatttatttcttcgacgtacggcgcgtgttaattaattttgctgtgtacatatagcagtacacagcttacgtgcattatcattccgttctttttctccaacaaaaattaaatgaagattaaagttttcgttctttttctccaacaaaagttaaatgaagattaaaatttttgtggcacgttttctaaactgctaaacggtgcgtttcgtacgaaa

SEQ ID NO: 12932 - DNA, 1501 bp, Oryza sativa
tatgtacttaactgaactgtaacaataattgcatggatttgctattgcaaaactaatgctacatgatcacaccatctataagactataatctgcaagtttctctgtggctctcgaagcttaatgttttcataaattaaatatttgattaaacataattttggttatcaacgtgctggtgcatggttctaatgttcatttatctaaccaatagttgtctaaaacactttcttctttttcattcttccaaatgtcctttaataaagagctgtaacattgaaactctgttaatgtgaacctatatagtgtactaatcccaagtaatgtgttgaaaaaattgcatatgtcctttttagtttccaagcttgtaaacccatagaatcaaagatggctcgagacataaaaagaagtggttgcatcttatttgaacaaaagatgcatggtgttcgacttcatgaatggattaaggctcatgtgatttagtcctgggattaatgtgaatcgtcagtttgatatatttttcccattttgtccaggatcaagatcaagaaaaatgtttggggaagagactatgaggaaggtgtactcagagtggctgatgccattaagaccaattgttgcaggaattcaatcagaaagtgaagaggatggtagcgacgttgcaaatcatatcatgtgctcgttaaatcctgttcaattagtattgtaccgctgcattgagctggcagaggaaaagatgaaaggtttctaacgttttcagttcactggtttttgtacaatatactgctgtctcgaggcaaaacatgaacaagttgtgaatattatcccaatgatttgaagttgcgtttttttatgttgtacagtgatactgtcgtccttcataattcattttgctggatggtctcgttcgctttttgcaaagctgcaccggccgagccgtgcccgcgcgccacgcatggccgccacacggctccggccgatccgtgcccgcacgccgtccacgcgccgcatggccgccgccgccgcgcatggccgccgaccgggcgcgccattgacggggagaagaaaaggagagggaaaagaaggaaagaggaagaagaaagaaggaaagaaattagcggctttgcaaaagagccgctggattttttggaaatcacgcgcataactcccagcatggaaactttttgcgcataggaccctagcatttcggaaactcccatttctaaccatcgactgcatggaaacttagaaataggcccttaaactttgcagatttcgcttatatttcattttggagcatattatgtcttagtgcaaattttgaatttaaatttattaaggcattatttactgttaatgaatattttgaatttttcgttttcagtatttatatgaatatatgcaactttttcaccctttttctatgtatgtatttgtacgcatttttaatatgaactctagtatttctttattgaatatttcacatttcttattcgcattgcc

SEQ ID NO: 12933 - DNA, 1501 bp, Oryza sativa
ttgttctagggctaattattatctcatatattcttccggagattttgcagaatttttcatacgcaagcttgattttctcctaaacaatttaacgtatagtttggttaattagagcagaaaaacgcatgcaaaatctccaaaaaggccaaaggcaaagtactgtttgacccaaaagatttgccctagtataaactaaattaaccgaatatgacataagtcaatgataggatcatgacatatttggtggcatccatccattttctttaaccattcttgacacatacgtgtacacacagttgccaacagcaatgcaagcatcatgcacacgtaacatcacatcggccagctagcataagctagcacaaattaaaggcagatttcttactgaacgagcaaaaacacacatgcaattactacgttttctttctcaaaacacataacctactgtatagcacttttcgaaagatcgacatataaaattgacaaaggtaccacgtaccactaaaaagaattattagttgcagtaatatgtagggcttgatcgaacacctcgggtgagtaggtttaactgagtgtatttagttatcataatttttctacctttttctacacatatttttgtaccttttgttttcatacttactcctattttgcaggtatatatttttataaaattaatggctgttgatagtacctttttttttcaaaatcaaacataaattctttagttgttatcaagcagagtagctgtatttaattggttcaaacagtcgtgcagcacaccatacgaaccacagattggtcatatagagtctggctatcaaatggtgcttatatatatagttagttaactggaaacatacatgactagtatatatgtatctttttgtagggttcttaattaataagcttggtcgctactagctagatactgtttctaattaaagaatacaattttcgtagagacaaattaataaaagtgttagagcccagaggtcggatccacattatccaatatacatatcttgtatactaaagcttttatggtagagcatgatcaatcttccttatcatgcatactctaacaaggaggcagctagaaagttaattaattaagcatatgaaaacaaaaccatctcctaattaagcttctgaatactgaatcatctatctcttaattaagattgaaattaaacttagtcatgtgacagacaattcgtgcgtgcaaaggtttccgaacaaattaaacccaagaggagatcgtccgtgcatgcatgtatgtgctatatgcttggacggaagagattaaacaagtggattttaatttgtagagaaatcaattaatttttctgtcttggctagttgtaaaacttctttctttgaggttgtttaggttcatcatcagagctttcctcagaacttcgccataaagttgtagaactaacgccatagagttatatccaatttaatttgcattaattgtactataacacagaagagt

SEQ ID NO: 12934 - DNA, 1501 bp, Oryza sativa
gagggaaatagctgaccgtgtggtacgtgctggccacaagccttggactgcagccgtgcttcatgatgttggtgaagaggaaaaagaagttgcactttgtgagcacagtgaaaggttagccattgcatatggtttgttgaagacaaaagcgcctcacgtcattcgggtggtaaagaatttgagattctgtccagattgccatgaagtagcaaaaatagtaagcaagtcatatgatagagaaatcattgttagggaccgtgttcgtttccatagatttgttgagggaagttgttcttgcaaggacttttggtgattcctcaaccgattgaatattgtcccacagctgggggtgagggatgtggcgttgaaactctttggagtccatcaccaaacaataatgactactgatcactgagcataatttggtatccagataaaaaggaatcctggaactgactggaccctcttgccctgatacaagtatacaacctctcaaggtattgaactccacttgattttactttgttttttatgcaatgttcgttgtcttagtgctgctatgaacgggaaagaaatcatattagtgatggagtagatgttctatgcaaccaacagaacctaaaaggagaaggctactttcctgctattgtttgttaaaacgtgcctatcatggtttgttgtccatacattaatagcaacattggttgcattatgcattacacaacttatgcaagttggtcattttaaacacttaatttagttggatacgtacgcaattcattgtttggttagtgtttgtttgttgctttatgccaagtagacgtcacggcaaaagcattaacatagcagttcaaaacattaacatagcattgccactaatcacatagacatggaccacatggtgcatccaaaaggtaaaaagatcgttcagagcctcagagccagaggtcggaactgtggaatgtcatgcatatttacgttatccacgtattggaccatatctttttttgtttcaggcatggttcatggctgcccgctctaactggtaatgcaactacaatgtcaattgttggcgtctacagcacagcaagacagattttccgttaattggagatcaagacagcctgttttaagacaccagaaagccaagaaaagaggctttccacagttctgatgttaactttacaataaatagaaagtgtcttgatgtcaagagttagttagaattctgaacaacagggcagataattctgaaaatattttttttatgtaaattgagaggaaaaacgataacaggggatgcctttttccagttgctctttattacgggctgaattagagcagtcatgacactttcagtaatgttaatgtgcttcgcaacctcatccttctggctagaaggattgatgttgaaacatctaggataccagttttacccgaacaaatgtaaacgaaataaactggacagaattgaaccgatgaaatgatgttcaaagcctca

SEQ ID NO: 12935 - DNA, 1501 bp, Oryza sativa
tgacatgaacttggaataagtccctggaaacctaacaggccctaaaaatgttagcttttccctgactcttaattcattttctagattttagctagtttttgcttgtctcagtgtctctctctctatatattttaactttgttgcccctttgtgtcatctcagtttccactctaaaaaaagagattatgttagctattgatgtttaaggaagctaaaacttttctccccaaacaagagcttgcccagattccgctccgatctccctccaactgaatttccgagcagaatttaaggcccccgcgaaggcgctgtacccagttctttcccagtccccagtccccactcgcggccagactgtggcgccttgccgcccccgcattgatgccgcattcaaagtagacgcgcgcgcacacatggcagcagcgaccatcaatctatccgctcggctctggcctcgcaaccaatcgcccatgcacgcattcaagctgcggttttgccccggtcgggttcttctccctccctcctccgcgatattgctgcatgcggctagcgtggtggagtgggatcagtactactactgtgccacggctcggccgcattgaagagcgtccaggagtaggagtagccggtgtgatcctagctaataatcggcgatccagcgagtgaatgagagcaagtttaaccgtgtagcccactactagctccaattcatctatagccaatctaatagccaattcatacaatagttgcttactatactattaatatatggtcccacctgtcatacacacattatattttggagtccgcgctgtagctggctacagatttataactcactgctcttctctctcatcttttatcttattaaaatatatttatagctggctaatagcctgctattgtactgctctgagcgtgatacggaggacgagccggtcggcgagacagccagccaggcaggtctgggtcgatcggcaggacaggggtactggacccagccgggtggatttcgattaaattcaccgttggatttgaccacagtgacccgtgacgtctttgaagagtggatctctgattctgtgtgtagtgtgttgggagatttcttcttcacttgctattggttcagtataaatgtataatgtactaacaacagtagtagcaagtttgatgaagcctgaaagacatcacagcactacagctagatttgtaccactgcgggccactcgggagaacgtacgcacgctagaattttttctggtatctacagaaatggaactgattccgtatagtagtagaaatgtagcatgagaattctaaccgggcgcgtacaaaatcgcagtcgtgctcgtctcatcccgctgtatataagcaggcgactcctgtgtacccgcgcacacgcaaaccatttgcatttgagccttttgcttgccttctctcctgtcctgactgcagcgagagatcagtagggagagggcaatggcattgacggtgcggctgc

SEQ ID NO: 12936 - DNA, 1501 bp, Oryza sativa
gacgccgtcggggctgatcgccgcctccctggcgcacgcgctggccctgttcgtggcggtggcggtgggagccaacatctccggcgggcacgtgaacccggcggtgacattcggcgcgttcgtgggggggaacatcagcctggtgaaggcggtggtgtactgggtggcgcagctgctggggtcggtggtggcgtgcctgctgctcaagatcgcgacgggcggcgccgccgtgggtgccttctcgctgtcggcgggcgtgggcgcctggaacgcggtggtgttcgagatcgtcatgaccttcggcctcgtctacaccgtgtacgccaccgcggtggatcccaagaagggcgacctcggtgtcatcgcccccatcgccatcggcttcatcgtcggcgccaacatcctcgccggcggcgccttcgacggcgcctccatgaaccccgccgtctccttcggccccgccgtcgtcaccggagtctgggacaaccactgggtctactggctcggccccttcgtcggcgccgccatcgccgcgctcatctacgacatcatcttcatcggccagcgcccgcacgaccagctgcccaccgccgactactgatcatatcatatcatatcgtctgctcccagtctcaataatcgaattcgtcccccgtctcgatccatatatagctagaatattaattactccatgcagctgctacctgtgtcgtcttccacccccaatcaattactactctcttcttctgtacaaacaaattacgtaaatctcctttaattccaaaatctgtgctgtgctgtcaaccaagccaaccatgcattgcagctgtaacgtcgtccatccatcggttgtctcatctgcaatataatgtcaacacatcccatgcatcctaatccaaagctctcttcactgtcgttcttcacgtccttgtttgagttggtggaaagatatatacatacatgctgcgtttgcaccatcacttcatgattgaaacgagtttatgcgctccgatccatttgcttcctccaaatgaggacctaaataaatcccatctatctattatttatatattattaagggatgtacgtagaaaatgaaccatcatgttctcaataatggttgtaacttatttgaagcaaaggccgaaatgaattcaattatctaaaaatcactagttctgccatctgggttgccaactacggataattattgggttaacttgattcgtgggtggagatagaggcaagctgatttgaatcatctgtctttaacatctccactagaaagagtagagatcagaaagaagcctttcacttctagaaagagggtgctaggatgcaaaatcaaccgaacacatgaatgtggataatagaggcaaagatattgggagttatctctaactctctcttcggccctgtttccgagggaatcgcctccttatttggtatagacgagctaacgatacctagttatttgctagttacgtagagttatgttaaa

SEQ ID NO: 12937 - DNA, 1501 bp, Oryza sativa
cagccaccgaggccttcgtgaggagggcaacaacggtggaggacgacgccgccgctgccgacaaggccgagaggcgcggaggcgacaacggctgcctctccccatctgctgccggcgactagaagagaagaggatagaagaaagaaaagaagcgccgccgaccccagcaacatcctctccctttctctctcgccggattggatcgaatcgttggccgccggggaagcagctgggcacggccggtcggtgcggcgggcgtgggtggcgggggaggagctaggcgcggacgacgatggcttgggggacctcctcatcgattcgcacgcgcatctcgacgagcagcgcgtcatccggctccagcacgccgttgacggccaacgactcaaatagcagcgccatgccatcggacttgacggcgtcgagggcgtcggagcggagggcaaccttggcgaggtcgttgaggtcggggtgggagaggaggaagagcttgtgggctagcacccggtgctgctcctgcttcgcctcctcgctgccggcatccatgtcgttctcattggagttggggaggcgcggttaggtcggctcgtcggaggagcggggtgcggcgctgcgcccgaggagcgggcagggcagggtggggcgaagcaagaggccgggggggagtgggaggcgtgcaacgcgactggcggccgataggggagaagagcggcggtggcgctcgctggcgaagacgggcagcgggcagggggggggaccagaggtgaacggcgcggccggcggccagcaggggagagcggcaacggagcatgtctcctcccctctcttgtcttcctcctctcggtgttcgcctccatcgacgctgccatcgatcagggccaagctcatcgtcaaccacgacggcccgcgccgccacggcggtgtcggggcagacaggcagctggccctccccatgctcccccttcgcctccccctgtgctcccgccgcctccgccggttgccgcacctcctctcctgcctcgcaacgccggcccgccggcctcctccccgcttgccggccgccctgcccaagaagaagagagagagagagaggaggtgagaaaagaggggagagaaaggtgatgacgtggactgtctgacatgtggggcccacgtgagtcctatgctgattcagccaccacgtcagataaaaccgggctgaaaaccaccgagggacctcaggtgaccagttttgtacagctgagggactccgcatatctggttttgcggttcgaggatgttttttatctcgatgacaagttaagggaccttgggtgtacctttttccttccttttaacaacaatgaatctgtatgcatgggccgaacaaggctcgtcagcccaattctttgattccccacacttccaattccaaacttgccagagagagagaaatgtcttgtttcttcaggaagggtggggtggaatagatcagatcggatcgagatcgaagaacaagggggaa

SEQ ID NO: 12938 - DNA, 1501 bp, Oryza sativa
gtttaatactcctactaataagctgcctgaatccaacaaagcagcaaactacggagtaggagtatgtaagaagcaattcaattaggcaggcaggcgattcatcaaacacgtagtactcgttttcaacgatcattagctactacggagtactactacccatcaagtgatgaagaagaaagtaagtactactgtagaggggaggagctccactactggggtagtacagtaagccctagatgggatggaatggaaggagtagctgcctagctaggagtcggcgccggcgaggtcgtcgtcgtggttggagttggaggggaacttttgcttgaaggcgtcctggcgctgcatccacatcatgtgcccctgccattcaattcaatccatccatccacagatcgatctgagtgagtctgagagagagagagagcagccaccgcgcgccaccatggatgggatgggagtaggtgatactgatacctggagcgcggcagcccagacgaggaggaaggaggcgacccagaacctcttctccttcaccaccctcctcatcgtccccatcttcttcaattccaccccttccttccttcccccttgttcttcgatctcgatccgatctgatctattccaccccacccttcctgaagaaacaagacatttctctctctctggcaagtttggaattggaagtgtggggaatcaaagaattgggctgacgagccttgttcggcccatgcatacagattcattgttgttaaaaggaaggaaaaaggtacacccaaggtcccttaacttgtcatcgagataaaaaacatcctcgaaccgcaaaaccagatatgcggagtccctcagctgtacaaaactggtcacctgaggtccctcggtggttttcagcccggttttatctgacgtggtggctgaatcagcataggactcacgtgggccccacatgtcagacagtccacgtcatcacctttctctcccctcttttctcacctcctctctctctctctcttcttcttgggcagggcggccggcaagcggggaggaggccggcgggccggcgttgcgaggcaggagaggaggtgcggcaaccggcggaggcggcgggagcacagggggaggcgaagggggagcatggggagggccagctgcctgtctgccccgacaccgccgtggcggcgcgggccgtcgtggttgacgatgagcttggccctgatcgatggcagcgtcgatggaggcgaacaccgagaggaggaagacaagagaggggaggagacatgctccgttgccgctctcccctgctggccgccggccgcgccgttcacctctggtccccccccctgcccgctgcccgtcttcgccagcgagcgccaccgccgctcttctcccctatcggccgccagtcgcgttgcacgcctcccactcccccccggcctcttgcttcgccccaccctgccctgcccgctcctcgggcgcagcgccgcaccccgctcctccgacg

SEQ ID NO: 12939 - DNA, 1501 bp, Oryza sativa
tcttcaactgtgtgattttgtcctcattttttaaaaacttattatgccctcgttctttttaagaggactaaacgatgttaaaatttatgtatgccctaacagatttggccctacttgtatgaggactttaattatgattttacctctgttttgacatcaaaattttaacatgaactttttacttattcagctaaaaaaaaagagtgcacacatgcttgacatgaattttaaaaccgttgaatcttcctctcgcggaatagggcaaacacaagattctgttaaggaaaatggggacagtaggaaaagtagggcaaaatcataattgatgttaaaacaaagataagaatacaaacgctgcttttttaaggcaaactcaaaagcgagtgcatcacacctatgaatgcatattttactcacatacctattttaatatacccttacataagtacttgtttaactagatgcaaagtgaatcaaggttcgctctacctagcgaagggtgcaatttactttttttaaaaaaaacactctgttagtgttaaatcatgcacagcgcgcgctataatgtactattagtacattatagcgcaatttatttaatttagcagtatgcgctgtaatgtactacaacacacaaatatttttttctcccaattcacactggatggtacagtagttctacactcagtaaacgataactaagggtaaacccgtgcgctttttgaactttctacagaagggcacccgtgtgtatatcatgtaaatgtggctatgcaaccaatttgcaggagcgttcggctcggcacaaatttaatgatttcgtttccaatttgtctagttgatggaagttcagcaggatgaagcaacaggcataaaagaataaaaaaggtagataaacagatacgagcagaaggatatcccgaaatcgaaattattgcgacacgaacacagcacgacaaagattgcgatgcatttctccaaggacgactacgtccaacggcatgcgtgcatccggagtgtcgagttcatgttcatctccagctaatactttggataagtgttcagatctagcttttttttttaaaaaaaagaaaaaggtccatatcaaagtagttcagataagtacccttcacgttttaagtacaaaaggagagtgctcaagattgtcaatccatcgctacatgcatgcatatatgggtattttcaagatgagcaaattgcatatattggtccatgttttttaaccatggtttcacattggaccaccattaactgaatgctttcactttacaccagattttattaccaaaatatatcactttggaccagtggcccacttgccagtgtggctgaggggaaaaaaaaaggaaacttctcggttgggaaggaaccagcgagtccgctgactcatctcctaccacaccgtcgatctctttccaacttcacccaaccatctcatggcggtgtgggcagagatcacgctaaagccttgggggcaaca

SEQ ID NO: 12940 - DNA, 1501 bp, Oryza sativa
ctctattccaaaatgtttgacgtcgttgacttttttaaacatgtttgaccgttcgtcttatcaaaaaatttaagtaattattaattattttcctatcatttgattcattgttaaatatacttttatgtatacatatagttttacatatttcacaaaagtttttgaataagacgaacggtcaaacatgtttaaaaaagtcaacggcgtcaaacatttagggaaggagggagtataattgatccgctcagtcaaagcccgctgcctccgctcccaagtctggcggtggcagatccgatcctcctgaggccaccgccgccagatctgacaatggagaaggagaggcgaagggaggtcagccgttcccgagtctggcggtggcggatctcccaaggccgtcaccgccagatggacgacagagagggagagacaagggaggccggccgatctcaagtccagtggcggtgtatccacacaacccgtggtcgccgccgctggatcaacaatgaagaggaagaagtgagggaggttggctgctccgaggccgacgaaggcgaatccacccctcccatcgctggcagtggcagatccaccgccggtggccgtccccgttgccgacatcgatgtgtgccacactatcggacctgcctccgcacaccgaactatcatcgatgctgagcttctgccgagaaagagagagggaggaggacgaggatgaggtgatggagataaggtggagaggaagtggaggagaggtggagtggagaggatgaggggagagagagagagggggaactgaaatatttaaaggatgagctcaacctgatgatgggtttgtggcatgcaggcctctcaactgacccgtctgcgaaatatgtttattttcacaaacgattcttgaaccgtcaggatggttcttatctggagaaatcaattatgtagcagtgcgatacatacaaattttgaagtcctaaaaaaatcatctatttagaacggacgtagtactttttttctacgaacttctgtacgcaagatcattgaaatgccgtctcatgagtcatgatccaacgtcatgcatgtatgtaagtacaccacatactccctccttccctaaatatttaacaccattaatttttctaaacatgcttgaccattcgtcttattaaaatttttttgtgaatattattcaaaaacttaagtagtgtatatttaacaatgaatcaaatgaagaattaaaatttacttaaattttttgaataagacgaatgatcaaacatgtgtaaaaaagtcaatggcgtcaaatatttagtgacggatagattacacacaattaaaagatgccattactttacacgctgaaaatgatcggcgtctatataagaaggtaatctaacacggacagccaacgactacgagacgcgaggttgaagacaagtaagtactcctacatgcaacacccagacagagactagggcaacgcacgctagctctcgatcgagcacca

SEQ ID NO: 12941 - DNA, 1501 bp, Oryza sativa
aaatatttgtagtatagttaccgttaacatgtgggtcccattatattttttcactgatacgtaaatgttatgtcggacaaagagtaagtcaacgtgccatgtaggataaactgtagagggttttgatagtgagggatactctgtacccgatttcagaaaattaataaaacccgagtcatagttggtgaggaccgaaagtggactctttcgatccaagcgaataccgtttcggcccaatactgatggtcgtattggggggcagaaacgagaggcgatcgatccgattggacggaggagcagagtcacaagagtgagggcctgtttggtagagctccaactctcagatcctaactccaaactctaactccagctggagctagctcttgtaggagctagagatgatgtaaaagtgtttggctcatttggtcagctcctaaatttctgaaagagaggatagggaggagatggacaatactacccttgtaattcttgtcgtttacttcatgaaggattaatatgctatttttccttagtaatataaatgtttaacaacttgtagcatcattatcatcaaaagatagagcaaaagaccacaaaataacatataatatggtctatcatcgtgcagtatgaccagctagatcatcatgaatgctttgtgttatcccatcctgaaagtattggcctctctcttgcaagatatcaaaccaaatcacaatttgtgcagctgctacatgcagaatcacaacacagataatcacttggaaaacatgattgatgaaccgaatttacaacaatttttgataaaggttcaaacaatttttaataaaggtccagacaattttcaatgactttccaagagattcatagtaatctattcacaaaccagcagaatacacagagcagaaaaaacacaaaggtgcactagctgtcattagctaacagataaaactgaaggcaggcgtgaaatcttgatagattgcagttcaccagctgctaacctgcaaaatgaaatgctataacccatcgttgccatgcagataccttccacacagatctggaaaccttgcacaccactgtcgttgccgtgctccgaccccgccgctgttgccgtgctccgtatacaaggtaaaatgcatccatccatgaataagttcaaggccttgcttgcaagcaagagtccaggtcagctccaagcaaaaaaaccaacaatagttttagtctctcagtcataccgacatctcataacccactgaagttttgtgctgctactttacatccaacagaacctttgcgaaacatctcggtatcacatatttgaaaaactaacaagtgaaagcaaggacaacagtgatgacggcaaaaaaaaagggacttctggcagttcaatcttgaatcctttgtagaggtgccctctaaccaaatcttgatttgaaaatctcacttgtgacttgtctttccgtcgaggtctgcaaaacaccccatgaatcaattaaggaca

SEQ ID NO: 12942 - DNA, 709 bp, Oryza sativa
gaggaggaagcttagcggcggcggcgctagcggaggaggcagcggcggcggacaggcccctcatggcagcggtgttggcaaaggaggcgtagcggcaccggacaccggacgggcccctcgcagtggcgtcgccggcggaatagtggcgccggaggaggcgtagcggtggcagcgggcgtggcaccggatcggagggagagaaggagagagaggagaggctgactagtgggtcccacactggtttcacccctccattgctatgttgacctgccacgtgggcaaaagtggcaaatagttaagatggcatctcataagaggagaaaaatatgtgcaatcctaaaaggggtatttggataattgcccaatctaaaagtagcaaatagttaaatttcccgatgatttcgtcacatcatgtagttgtatattcacatgctgacatgcgttctattgatctgcccaacgatgagaaataaaaaaggaagggggagaaacttgatggacgatcagtatctgaatattcggtaaagccatgagctagtattcctaaatcaggaggaatgtctgagagagaatccatccaggttttgacatgacatgtattttcttttcttttcttctactaccacaaagaacagacaaacctggaatatcatttgcacgtgcagggcaagtcagacacacgttctatttccttctttttctttataga

SEQ ID NO: 12943 - DNA, 1501 bp, Oryza sativa
tgtcgatgtcacgttgccgttacgataacgcaggcccctgcggactagaatgtcgcgaaatcgattactcgattgttcaactgtcatgagttagttttcgatcgagctgcattttgaagaaacggcgaagggcactaactggttagcatgatagcacctaattaagtagtactatgtggcacggataggaaaaggaaaaaacataaacggaggggccaaagctaagttaaatacgctcaattcagaatttctgtagcgttaggaatgctgaaatttaagggtttgttcttttctgattaagattcagattttttttacctaattacctaaacctcatcttgaaaagggtaccactaactgaacaatcttcaagaacaccgaagtggttgatgagactaccctgtcacgagccaaatgaacctaacacaatccagagcgccgcattggttgatgaaactgccctatcacgtaccaaaacgaacctaacacgatccgctgaaaatcactggcgatgtattatgcgccagccagccacacatccctgcaggatgcagcagcaagagccccgtgcacgtactgagaccgccttcccttttccctcccagcaaaccgaacaaagaaaaccatacgcagattcgccctgcggctcatgcaacggcccgcaacttgcagagatcgacgcacgcacgctcgctgctgctgctgctgaactcgtgattcaagttgacagtagtacgaacacgcgagcccaatctgcagggacggcttatgcagcatcagccagcgaccgaccacgcattgtgctatcgcctcggggtcctggagaaaggacagccgcgacggcctcccctcttccgttagttgaggggtgccaatcatttctgccgacacatttggacatctgctacgctaaacaccgccacggcggcgccacaccaacttaatgctattggctgagtacacatgatagtagcagcagcagcagtcagttctaaacttgtactagtactagtatcagtaaaaacatggccccaaaaggaaaaaatgagcggctgcaagaaaccaaagcagagaactgctgctgcttcagcggtccaggctgcctgctttgcctttcgtccctaagatctggcaggcgcggcagggaggataaaagaaggaaaaaaaaaaggaccatggaatggcggatgcggggggagcgcgacctcctcgcgtcacatggcttggattctcctcgccggttaaactagcgcggcgcagcgaccaccaggtggtgcatgagctgtagctgccaaggcaacctgacaaagttgcttgcaagtagcctcgcttgtgtgctttgggcgctaacgttgtttactggctagcgtttagtgtgtgcgcgctacttgcttgcatcaggagagatggttaaagaagagaactttgcattgtttaactcggcgaaagattgcgagagagagaattgtttttttactttgggggtggtttggatggttac

SEQ ID NO: 12944 - DNA, 1501 bp, Oryza sativa
ttatatacgtgttagttattaattatttttaatatcaaattttagttatttgtaaattatatatatttctatatggactctagactcgtcttttaatatatttttttaattccgaattttctgtaaattgtatttctatatagactctatgctcttcttctaatattatttatttttatttatgatttttttattatttctaattgtatttctacgtggactctaaactcatctttcaatattctttaacttttaatttcgaatttcagttacttctaaattgtattcctatattgaccttaaactcttcttcccatgtttttcttaattttgattttttttatttataaattatatttttatatggactctaaactctacttttaattttattatgtttattccaaattttagttagttttaaattcctatatggactctatactctacttctaatatttcttattttttaattccgaatttctattttatttttttcctagcctcctcttctaatattccttattttttaattccgaatttcaactatttctaaattgtatttctatatggactctagtctcctcttctaatattccttattttttttaatttcgaatttcaactatttctaaattgtatttctatatggactctgtcttttctttttctctccgattaatgtgagaatttctaggccatgagagcgaacgcggaggctcctttttctattcctttaataatataatagatttttttataattagtattttcattgttgttagatgataaaacatgattaatactttatgcgtgacttttctttttaattttttttataattttttcaaataagacggacggtcaaacatagaaactagggtttgtcttttttttttttttttttacctggggagtacacttgtacacgcaaactccgaagtccgaacacccgcgtaacaaaagccaatttatccgagtcattagttcaacttctaccacacgttgttatgataaagaaaacaaactgacaactggtgcccagtgtccatgcagcatggtcgtatctaccatcatcaacacgcatcacaaaagagcctcgaagatacacagtacaggtgcaaacaagcagggcaagccaaaaggcagatagccattgccttctttagttcttttctccaaacaactcaccagccaccgggagaaaacgacgctggaaagccagaagccccagaatttaagtactagatagagtaatccacttcagtacgcaacgaaccgccatgcgtggcgtgcaaccgcgacggcctcatgccatcgcctgacacgtacgcccgatctccagaaccgcatggttactgaaaaatacaggatataaacggacgtgtggtctcgtggatcggcctcagttccagccatttcgtcagtgagggagagagagaggtctgagaagaggagagagagccttctgcctgacaagaaattctgagaagagggagaa

SEQ ID NO: 12945 - DNA, 1501 bp, Oryza sativa
attcgctagtcataattcataaataagctgacattgtttgttgagggaactgatttgatttgtctgtaatgcaggattaccagggatggattgagcgtgggctgtcaatttcacagcgagttgggaagtcatcaataatttctagactgatgctaatttgaagagcaataaagcatatccatgtattatcggcaaggaagctgcatgtgacttggttagaagatggaaaagaacaaaatagtgggttttacgttttactaagagctttatagtgatatacttaccaccatccatgccctatagtccttatgttgtaacttatgttcttctaagcaatcatgttcaacagaggtagagctcaaagggttgaatgtttggtaggtgccggtggttataggtagtggtgtagaacaatttcgctcgttcccaggggatgcgctgtcaaacccttcagtcggcttgccacccaactgttgtattttcttgtcctgtatgtgctcatggactcttagtcgtgagctcgtagcagatagttcaatcatgtttccctcgtgccaacatggcacagtacctcaaaattatttgctgtgtctttgaaattcttatggcggtattggaaggacaaatgtgggggttcggtttgtactggtttggccaaacctaagccaaactttctgcctaaggcagaaaatttgcagtcctttgttacattttacttcggattggcaggtcaacgagttgcatttttgtagtaagctacttggttaattgctgagttgtttaactgtatactagtcgtattttccaggacgaatatgcttgttaatcaatatactctctctctctctctctctctctctctctctctggacaagtggtgagtaggtgatattctctctctggctgcgctggaagaaacattccagctgccagggcatgtgcttccggactaacacgattctgcactgggatctttgttatttcatccaagttgccaaaaaatatctcaggaattaccaattccctatggttgcatgttttcagaggcgatctttgcagctccggagctacactgccatcagatgcgactgataactgtcacaagcaacttgccattttagtactgctgggtcttaacccttccggccctgttaggaatggagtagttctcctgaaatttcatattcccactctcaaaatatgttcatttttaatccatctcatatactaccaatacaaaataaaaagaactaaaatacatttactttattaaattccaatataactattctccactttatctattctcaacgcaagtttttttttactctcaccaactccgatggaatgataacaaaaaaataaacttattttgggacaaggcagatgagccaaaattgaacttagtatgggacggtaggaaattaataattttgtactgaattatcgtagacttcatatgttcgaaataagtactcccttttataaacacaagtcaaca

SEQ ID NO: 12946 - DNA, 1501 bp, Oryza sativa
acccatactacatcagcagtaatgcattgaagctgtttgctagtgaaaggtcattgtcaggtagctactgattgttattgctgcatggcacggtcgatgcagagagagagagagaatgcgacccatacatgtgtgcagatgtgctcatcgatcgtcgtctccttgcaagcgacctgtcggttgcggcaaaaccaaccacatccacatgaacacacagtcagtaacattaacagtaaaattaattttctctgtacctttgatatataatgcttcctccgtcctacgataacttcacttttcactcatcacacatatcaataaaagggaaaaaagctagaatatcttctaatttaacatatcccaaaacaatcgcccccaccactttaataagtctcattatatttgcgatctactttcacaaactctaataaagtgataatctaaaagtatttgaggacagattagatggtgaaaaataaaattattttagaaatgtacgacctgatcgtgcctgaggagtaaacaaatatactacggctgtacggcatatatggctcgttgcgtccctatcgaaccaatgctattttccaagcaaagaactatgaggcatctagcaaatccacagcatcgacgtgaacgaatatgcggccatggaattacagtactaattgccctaattttttttcctgtagaaaggagtataaatgtataattaataagatgatataaacgagctgtggaagttgcgacaaagagaacaagggagccaagagccaaggatttatttatttatttctcctttttaacttgggagtcttttgctattttcgtcttaattaagccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccataatgggtcttaaaaaacataatgagtgacaaaaagataagcgtggtcccctgtttttgctagccgagcacatttttgtgggcctaaagttcacaggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcggcagtattgcatctggtttttgctgaggtggcgcctacgtggctaggtctttgtccaatgtgtcaatgtggcggttacgtggcaattagatccgaaaaaataatagtacacgtgggacccacatgttagtcgcacacaacttaaaaaaatggtgggcccatgaggacccagacgtcatcctctctatcctctctctccctgttctatcgctctccagc

SEQ ID NO: 12947 - DNA, 1501 bp, Oryza sativa
aacaagcgattcattaatatttacatgtctcaatgcccatgtagccaatcacgtgtagaagaatgaagagtcatgcattaaatccaagaaagtcattaagatgataagttgttggattgaaatatgcctatcaaaaataaaatttttagatttggaaatatgactatcaaaagtagatggagggagtatatggtttctctccttttaaatttatcacgtcgttaataggacgatggtgcgaactttttttttttttgtcccttaaaggtggccaaagtcgtgcaccatgaccatcgtagttgtacaccgtatcgtcgttttgatttgctcaagtgaggtccatgttgagatcatgtcccatatttttctcgtgtatctgcattttaataggaggtgataggacgtctttggatatgacggcaaagcaagcattaggtattatttggccagccacagattgctagtttgttattagacatccacaccctatttggcgaaaatcttgcatttcttcggcgtccactgttctagatcgaatgcaattgcatttgtcatcttctattttaaactcaggaagtacacatataaaggagatttgagaacgaattggagaacggaagtgtgtaccgttcaagtgggccttaaagggagaggcccagttttccaggaatgggctttgatggttaaggcccaaagaacctcacaagaatggagtccaacttgagcaggggaaaaggtacggagaaagtccaccttgactcccttaaatatcggcgaaatctaatttgtacccctcaacaaaaaaaaatcggatagaatgactcctgaactattgaaaccagtgcaatttgactcctccagtgattttggagggtggttttactgacgtggcggtgttgacctggtcttagtcccacgtggcgcttatgtggcataggaattaaaaaaatcagtgggaccatatgttattaacacacaaaaatattattttgggacccacatgtcatccccctctctccaactactcttcccttctcccattctcctcatccggcggcaacttccccactctctctcccggcggcggtgcggaggtagggcacggagatccggaggcggcgtgaaggcctgtctcctctcccccctctctcccggcggccatggacgacaaggaggacggcgtgtggtggggcagagatgttggcgccggcggcggggtggtcgacgaggaggacggcaacggaggaggcggcccgagagccaacgccctcgccgtcgggcccttgctgccgcgcccttgctgagagatgttggcgccggcggttgaggttgagaggcgtacgcaaagcgcagcggcggaccgcctccacccgacgccgcccgggccgtcgcgcagggccaaccatcgcccagcctcagcgtcacctccctccccccggcggcgcctccctttccaccaccccatcccccggccctccccgcagaagaagagaaagggagg

SEQ ID NO: 12948 - DNA, 1501 bp, Oryza sativa
gtttggtccaagccctggcttccgtttcccttttgtaatgcagttgtgagctcgggatctgtccacagcccaacatgactgtactcctactctataataaagagacctctgttgctgtgatattctatcttcctgtgataccagcactgtttcctgggactggtatcgattaacaggttaatttggagcgtcacgggctaattccagtcgggactagctcggggcgtgacaagttcacaccaaacttcccccaaacttttaactttccatcacatcacatcacatctaaaattttcctacacacataaactctcaactttttttcccaaattaccaactttttccaaacttctctccagtttcaggaactaaacacagcctcagtttgagaattgacacacctaggaatttttttaaaaaagaacgattcgatgctaggctcaatccacatactggataatgtcaactatcaacaagaaggagattagcataagcttggcacaatcactttcaatattgaaattaaccaacacacagagcaagtgtgtgtgcccaaaatgttcaacgctgatgcaacgaaaatgaattaagccgcggtgctagctgcatgcatgtaaatatgtaattgagattgattcgaatcgaagagcagttagtagtgatgaactgatgataataactactgatgcacatgattgacctgaaaaacaaaactctaaatttttttccctgtttctgtctcctttgtggggtttgaaatggaaccatagaaagtgcgagtcgtatgtatgcacgtactacctgcagacacgatagatgattccatatcaaaatcaacataaacgcatatacaccgtacgtatgcttgaggattagtatctaacaaggtagttatacctttgtcctataataattatattttaaaatttaaatttatctcgaaatagttatcacaatagagtatcaattgttccatcaataacttatcatttatttttttaattctacccttaaccaccctctcgctcttgcctatacattatatctagtaagggacaccatagttttctttactcaattcttaatatatgctacatagaattataattattttaggacatataaagtatatatttatctgtaggtatttcaggacgaagttaaaccgatatcattagtgcctttatgtttagtcagttgtaatcttgtatacaaagatgtaattcggagtccccctcatctagatcactcatgctattcatcgtatttagacttttttttataaataaaaggaatgcatttttaaatgaaaaagtacgaaaccgataagttaacaccgagccattttttctaagttaaaattaatttataacgagccttcttccgattagtttgtgtgaataggacaacaacaaaaacctctaaaaaaaaggacaacaacaaaaaaaaacttgaaataattaacacaaactaatttaagcatgcaaaggccaccagttta

SEQ ID NO: 12949 - DNA, 1501 bp, Oryza sativa
tagcatatctcaaactttaaaaaattataatggcaaattataatatttatggtactgagatttgaaccttggtgcgtttcagcaaaacatctccaattatttgaatataatgtagaaacttgtcataattttgacaaacatattttgatgtcctgcgaatatgtgatattttgcactttatttattaggtgtgatctaatgtatactgacattcacaatattacaccaaattatgggaatccaatacacaaaatgctatattggtctaaattttgttttcccttggcttttaactttatctgtctttgtactctatttcgttcctataaaatcggttactatcccatctctcggatatgcagatagttcactccatttgtcgcgagattgtccatgtaaccactatactcacattacgccaaagttgtatgtgcatgcacgtagagctagtaactagaatgttaataaagaataaagttgaaagaggagaaagctacaacagagatagatatgaccgtccgaacaagatggcgccatccttaccgttgctaggtaccataaagttgctgcagcaaacgccgccacctacgtcgtgtccccagtttgcgcttctagctccaatatctcggtcttcttgtcctcccttcgcagcttctttgtcaacttactctcgtccatgccaccgcttatcactagctagctagcagcagacaattcacggcattgattctatgtcgtcttatgcgtaatgcactcaacaacgtcgcaagatccagaagtactcacggtgggaggacgagggaagccacaaccattgcgctaagggaggacgaaggaacgccaataccgacattgctcaagctcattatcatcatctccgggtgggagaatcagcgcatataaccatccccatctcttcttcctcctcttttcagcttcgacctgataccctaggtatcaactaatattatttaggtatggtattgataaggaaatagctatgcgtccgacggatttgtacgacatgcatccgattgcggcttgcattggttcgctggagagaagccaaagatggtgattgatgcacatggtatggtcggacgcgggtcgtacgaatccgtcgtacgcatatcagtgctgtattgataataagatattatatagttgatatatgtgacgagtatctacgagtatcaccaatttctgaactatatttgacgtgttcctccaatttccaaccaaaaaaaccaacctttatgtcggcatgtcgctatcctatgggctttgagcccacaagaaaatagatgcgactgatcttgggccaacacatagcccatactccaagcccacgctactggtggtaggtacacgagtaaaacaaaacgtgttcttgcctgcgtatatacggtgtacgtacacacgtctagtacacgatcacacagtcacacgcacagatccacacgattccaaactcccaactctcgactagaaccgactccaa

SEQ ID NO: 12950 - DNA, 1081 bp, Oryza sativa
catcgctggcgatgcctgccaccaccgccaccaacgctcccctccgcctcgtccccatcggccactgccaccaccgccgctcctgagtcccgagagagagagataggaggaagaagggaaggagagggaggatgacatgtggtctctcatgtcagtgagtcccacttttttgtgtgaatgacatatgggtcccacatattttttttgtttttattctaatgccacgtaagcgccacattttttaattttgtttttgttctaatgccacgtaagcgccatgttggataaagactcggtcaagaccgccacgtcagccaaaaccacttccaaaaccaccgagggatattgtttatttgtttgcaccggttttaatagttggaagttggaggacatgaatcatactcgggtgatagttgagggagtcagagtatacttttttcctaataaataaagctatatgggcctttcaccctaacccggcccataataatatggtttggtcctatctcatacccaacacccaacccaacccaacccaactcctcctcctccgccttctcgcgctcttctagggttttgcctcctcccgatccggctgccgcgcttccatctccggcggtccggtctatcctctccgctccttgcgcctgcgccgatctccatctcgctaccaggggagggggagaggcgctcgccgccgtcgtcctgctgcttcttggtgagcatccgcatcctcttttctcattcatctccctctctctctccaacccacccgcttttgtgtccaatttgcttgcctgcgttaactgtatcttctcttctagatctgggagaagctgattttctcttaatttgatagccttaaaccttaataataggactagaagttttgtttttatttgcccctcaaaaatgtttggggatcccgtccactgggtgctaatcctgcctcttgcgtctgcagattcttcggagctaaggcggggagggttctgcggccagtatggtagaatattttttttagttttttttgttcaactgctcgttgatttcttctcttcccacttcattttttttgttc

SEQ ID NO: 12951 - DNA, 1501 bp, Oryza sativa
tctgaaaaaaaaggaccacttcatgagaaatttgacaattggttgcttagacaagttacctaccgattattcttacctagttattgaatcaactaaccaaacctagttattgaatcaactaaccaaagcaagtgacacaaaatatccttatatacagcaaaagaatctaattcacctatgcacttatttgcttcaacattaatggtaaaaccgatccatccatccctcaacagaatttaaccgaacacctaatgggcactggatccatatccatccctcaacggcatttaacataactctcctcattggcatttaagcgaacacctaccgggcacaatacaatacgtgcatagggaagtagcaatcattggttgaccatccaagaagtcacaatcaaaggagtaaacgaattcttgcaattattgaaggaacgggaaggggattgagcgatgcttacctggctagcggagtgggggcgaggaggcgcgatgggtatcggagggcgagtaatcgatgacgacttgatggcggcgtgacggagaccgccgggattggggaggaggagagatggctggggggcgcagtggaagccggcggcggtgcgacggttcgatcactgcaacgacaaacccgcattgggcgatcggtgactcgcaagatgggaggagctgccgggattggggagaggggggatggtcggggggcgtggtggaagccggcggcggcgcgatggaggattcgtcgggattggggacggggagggagcacgggtcgggtgaggtggcggcgtcgacgggtgatggcgcggtcggcctcggcgagcgccgcgcggggggctccgcttcttggtccctgcggcggcgcgcgcacgggcgaggagctgggcgccctgcgcgaagtggtggcgagactgcgcggcggcggcggcggcggcggaggaggaggaggaaccggcggaggcggtgggccgcggcgaggatgaagaggaggacagtgacggggttctcattggcggcgtgattggggatttgggggacgcgcgtgaggagctcgtgcggaggggagagggtccgcgacgatctcgacccgttggattcgatgattctggaccgtgggatttgatgaatgaattatggggggagataaatgttcagagctgattgtttgaggtttgaatttccatttttagtttattaacgtaattgacttataattatgcaagcatgcaaatctctatctctactattataaaaattgaagatgtttttgtcggtatttagtaagtcatctgtgcatgagtcggtttttaagttcattcgtttttttggaaatatagaaagattcgtataagaattctctttagaaaaactcgcgtgctaacttaagacgatcgaacttttaattacagctcatgattttctaaaatatatatattcaagtgaattcccacagtgaattttatcttaactagattgtataacagcaataaaataccttaatt

SEQ ID NO: 12952 - DNA, 515 bp, Oryza sativa
ttgcccacgtatcaagaattaacaaactcgattagcgatcgtatcgacaacaaactcctcgtaccaccaacaactatcactccacgcatcgccaccaccgctctttctccatgagccaccatcgttgctcatctccgcctttgcatgtgcaatcgcaccctcaagttatcctccatgggtcacccttttttctcgtcccctctcgtcatgcacactatcattatggtcgccattaaggtcggtggtgtcggtcttacagagacacagggagtcaaggaggaggcaggagtcgacccgatgaagagcgaagacactagatttgggctccttcttgctgaatatagcggttccccaattgttggagggaaaaagaaaatggagagagagagagagttagtgtgcggagtggttcctgagtcactgtgatgtgaccatcaagtatatgtaaccaagcataagaaatataaaacattgtcaaagaatgtatcggatgaatagaggatctacaagatatt

SEQ ID NO: 12953 - DNA, 1501 bp, Oryza sativa
gagggaaaggttcccaaccaagactaactctgctaaatttttaagcagcatccatgtctgataggactatacaagttctcattgggcctccttttgggaaaaagtttgaaattttacataaattgaactaattttgagggttttttttctaggaagtccttcatatgtcaaatccaaattttcacaaccatctagcccatcaaatgatcttatgaaattatcaaccatgttatgaaaacatgtttgatgagaaacaaaagctctccaagagtttaaaaaaaagaaattgagtttcctagtttatgcatttggttggctaagcctaagccgagacatataatgaaacccttgaaaaaaaatttatgagtaagaatttaatatttcgttagcaaatactattgaagaaataatacctctaaattcactgtaaggtccaagagcgcttactccggtgatgcaaatgttttatcaaaaatgatattgttctttaaaaaaaaagaaaatgatactaggtgctagtaagggcatattagtcattgcacttgtccagcactaaggttttgttaatttgatcccgaggctcctacgtcgatgtttcgataccaacgaggctcagctccaagggaagcgatattaaacgattttgtgacgtgtacataggagttggcaattggatcgtcttctttttgttttcttccttttgggatatggtcaaactcaaaccatgatgatatatatgaaaactttaactcactcatatttttttgagataatgaactcactcgtataaaaaaaatgcaatgtaaaatggtgtacaattagagggtgacatgtggggcatgggggcaacacgtcggtgatacattggatttttttttgtgttttttaacatagtcaaatatggggttgaagaaaggtagcttgatagcatcctagaagggaaaaagatacttaaaacgaagtaagtttagcatatgattaattaattattttttaaaaaagtttaaaaatagattgatatgatttgttaaagcaacttttctatagaactttagtattagttttacatggtcccaatattttagttgtaggaattcaataataaatcatctcttagaaagatgaatattttcacacttcaaattttatttagggttccaaagatatttttggatggattttttaggtgatactctaaaactaggcatttttcaattaacggttaagggcgatataaattaacatagagcttgtccacattgatgtcattttagacaatattatttaaaaaataaaaaaacatatgaatgtatttattttattatcgaacattggtaacacccacataaatttggtaacatcacaataaaatctggcagcctccaaatgtaacaaaaatttggtagcctatatgtgggtaccaagctaaacacatccaaaaaagaaaccctaccaaaacttgacaatattaccaattactaaaatttttgttattccaaat

SEQ ID NO: 12954 - DNA, 1501 bp, Oryza sativa
ctgggcataggttcaaacgcttaaaaaagtgaaaatacccaaagaattgtttcatagtgaagccccatttggattggaggtttttgtacagtgagtattccgtattggaagatttgactgtacccagattagggcttttctcatgacagtctaattataattatttggttcctatttattcacgaagaggcacaaaatggatcacacggttacatcatgtgcccataaaagtacgttaacaacagttaaaatcatgtttgttaacacttgacagttggtatgaattttgtattagagtcatcactaaattaatttgtattgggcaaatccaatgacttacttttttagcatagtttctttattaaaagaaatacaaattccgaatagagtttcgtgacccaacacagcaacttcgtagtgatttcatagagataagcagagaatagagcgggggttaccgtggaggcagcatcagcaagggatgcaagaggagcgggacctctatgaaagtagtaaaaccagtgaaggtaggcattgtactgctgcaaggcacatagactagtgtttttcaagtcacaagaaagtagtctgtctgttcccagtgatttgaattcatctgatttcaccattaggaagccacatgggaaaaaaaacagttaacgtaattaaattaaacaaaccaaaaggcctgggagttaccagggtaaactaaaagatctagcagtggcggcggtggggaagaagaagctctggcttgggcaacttgtcctggaccgcctgaggcgccttggaatcggatatcgcacttgtccgacattgacgcgcgcagatgcgaccttgcgagaagcgacaggggaatgaacgagcacggtcaagtttagtgatattccccatggacgccgagcgtccccttcctccgattcgcagtcgcacatgatgaggatgaaagagaatcggaaaagctagttggcgcgcgcgccggcggggcgcgttttaggcccagaaggcccagtgccggcgcgcgcccttctgcacgctttttttttctttttttttcgtttttttcctttttttttcctcacttttttttctgattttttttaattttttagcatgttttgagtttgaaagtttttaaattttgagttgaagattttcaaatctggatttgaaagttttcgaatctcgatttaaaattttcaaatcttgatttgaaagttttcaaatctcaaattgaaagtttttaatttttttcaaatctggacttgaaagtttttgaatctctattctcgagttgaaagtttttcaaatctgagttgaaagttttcaaatctcgagttgaaagttttcaaatctcaaattgaaagtttttaatttttttcaaatctggacttgaaagtttttgaatcttgattctcgagttgaaagttttcaaatcggagttgaaagtttttaaatctaaagttgaaagttttcaaatcttagttgaaagtttttaaaa

SEQ ID NO: 12955 - DNA, 1501 bp, Oryza sativa
cttaacaatttagtattttgatgcatcaacttagctaagcatatgctaggtgagtttttttttcgcgatgtcgatatgccattacatagcaatcctacggatattaccttataatattgaatttaatctttaagaattatactgcacatccaattaccttcaagaatttttgttttcttcaccttcccaaatctcaaccgaaatacaataatttccacatccagtttaattgaatttcaattattagttattaggataaaaatataaatatgcttatatacaaacccacgctagtatattatcaaaataagcacttaaaaatcaaatatgtgtaaaaatgtgctccaaataattaagttgttgaataacttcttaacttattgtatcataatcatacatatcttacaagttgttacatttatgcgatcacttatgaagttcttgtattaaattgcacttatctgccaagttattgcactagaacgctcatttctcaagttcttgcatcaaattgcacccactttccaagttgatgaactgtgggcatagtgcaaaaaaccggaccggccatcgaaccggtcaaacttctggttcaccggtctgaccgctgggtcgtccggttcgactgcagaacagaagacttcatattacatgtgtattctccttaaagcaacatctgtaggtggtcttgttggcttagtcgtcgaacctgtaacgagacaaccagggttcgagtctcatcttcccacccttttttcatttatgactccttttttttcatttatgacttgggcctagtgggcctttgtagcctggtccacgtgctcgtcagaaccgctggttcagaagcgtccggttcgccggttttcaccaaaaaccgcccggttcatccggttgtgaccggttcgattgcatatccggttcttgcagcaaaccgaaccgactgaggggctggttccggtttttcccggttcaaccgccgggccggtccggtttttttactaggactgtgggtgcaatttactctagtaaataatacggagtactgtttaggtgggccataatgggccccgcgtctccttactgggctgtggcgtggtaggcctggggccaattctcccaaaacgaaacgcagtcgcgatcggtagccatggcggtgaagcgatcgcgccgtcgtggcggtcctctccttcatccgctccctctccccctctttctctccactccatccccttcattctcttcggggatggcttgcgcgcgcgcgccgggaaaagaacctgccgagcactttatccctttagtcttaattacgtatattagttaatatacttaacactaatgatagtaattaagaaaatatttggaaatttttttgggatatctttttactaacagattgaaattttttgaagttagatttgaaaacttttgatttaagttttaaattttaaagttaaattttaaaaactttcaactaagatttgaaaactttcaactt

SEQ ID NO: 12956 - DNA, 1501 bp, Oryza sativa
aataaaattactgtaggcaaactcacctgtgacgggctctatctgtggggccgtcacaggtgacctcacctgtgacggcccatagtgttgggcccgtcacaggtgagtttgactagggttgacctagggttggacatcttctagatcgatccagatccggcacccactctcactcactcactcgaccgccgcctcgcctctctctctctcgatccagatccgccgtcctcctctccaccgccgcctcgacctctccaccgtcctcctcaccgccgacctttccaccgccgctcgacctctccaccgccctcctcgccgccgccctctccaccgccgcctcgacctctccaccgcctcctcgccgccactctctcgaccgccgccgtctctctgccgccatctccgccctctccaccgccctctccaccgccgccctcaccgccggtcgtcctctccgccgtccgtccatcgacttccccgacctccccgaccccgacctcccggacgccgggatccacgacgccgggatccccgaccaccgccgaccacatcgacctcttcgccgctgcctctccgccgccgccttggacgactacggcctgcaccgccgtctccaagtatgccgcttctccaagtacgccgccaccctcccccattcctccttttttggtgcagtgaatcttagcatcaatagaggatcttacatgaattttgctgcagtggatcttagcatgaatcttagctagtttaatgtagctaaacttgttgatttatataccctttttgtctatgaataggtcaattgcatgaattgttgtttatatacatgatatatatacccttgctgctgctgccacataaatgattgtgggctgttttattatctacacttgcttgaattgaatggatgaattgctgtttacatgaagttagtagtactgtctccttttttatctacacccctgctactgctgttattgtgggctacttgttaatacacctgttccttgttttatgctgttgctgtccctgtggattatctttgcccctgcttctgctgcccaatgtattccttgttaaatggccagtgatgaattgctcaataaggacaaattatctacactctgtcatttttttatctattcttctttttgcccctgctgtggctcaataagtgatgaattgctcaataagaacagtttatctgtacccttattgtgggctgttttttaaatttgcatggttatatacctctacacttgttctttatggataagaacagagtatctacacttgttctttttttatgcataagaacagattttctgcacttgctcttttcttctggattgataagaggagactatctagacatgctgttttagttaatttgcccctgttgttgctgcccctgtggactatctttgccgtgctattggtcttactgtggctacttgttcaccctgctgtttatgtgaatttccccctgctgttgctaccc

SEQ ID NO: 12957 - DNA, 1501 bp, Oryza sativa
tagagcattgggtatttagtgggttggctgatattgatattttcagcaagccgtctgattttccccttcgcattggtcggccagactaaagcattttcaagaattacacagtacaacgcagacactcacaacgcacgcgcactcaccccctataaacacacgcacgtaaaacttacccctatgagtatcttcgaagactaggccggcaaatccttgagagattgacgaagtcaccacaggcgccttgttgtcgacggttacgtcgcttaccactgaaagcacaacgccgttaaattctaaaaaatccacttttgtggggagtcgaatcaaggaccacatgtgctactgagactcttgtaaccattaggctgttaccaaattttagtagaactaaaaagccgtctatatcgatatgcctaacctggaaggatgaagccgaggacgaatccggatcacctgtctgttagccctagaccggcggcatgcaggtgtttgccgacacgacagtcgacgactcgtctcttttccccgtttcgggcaccgggggcgccttgaccctgacatcgccacgattccggcacgctgcggttgcgctgccaattccccccgtggcccgcccatccatccgcttcctttcgaccgcgcccggggtccccccacctccggccaccaaccgttaaacgatacggacaaacgcgccaaccgctgcacgcgcgcacgcatggccctgccgcgcgcggggctccgctccggttgagttgatcgcctcgcgcgcgaggtttacggccattcgcgaccgctcggagtcaacctgtgcagtgcccacacaacgcaacgagacgcgcgcggaccggcggcaaggcaatgccccgcggcgccggtaatcgatcgaagcgagcagcgagggacgtacgccgcatggcaaccgatccgatcctcccagatggcgcggctcggcaaggcgacagggatggataccgcgcgcgcgccgctgctctgattgtgtgtgtgtgtgtgcctgacagggacgtgcagccgacgcgcggccggcacgtctagaaggcacgggttcgccggcacgtgacagttgacacacttcaggaaaacgagcgcaaccgccgcgctcgcctcggccaattaatccacgcacggatcggtcgcgcgcagcggtatgcgcatcaaaacacgtacacaattacacaattacagctcccgatcgtggtagctagcttgcaatgacttgacgcagaacacgaccggcgtatatgtatccatagaaacgacgacagtacatatcgagacaaagagaagagaagacggtagcacagatggcaccatcacggaggtgtggcacgagtgcaattcggatttgtcaacaccacgggcggagatcacacgtcgtcgatcgcccacttgcaggacctacaaaaataaacactatgattgtgtttatacgccatctaggatctacgctcttttgtcgctcgtgctcactttctct

SEQ ID NO: 12958 - DNA, 1501 bp, Oryza sativa
atcattgattgaagcgatcgagaagattagtcgtcgttccgctatatcgactacttcctccgtttcataatgtaagccattttagcattgcccatatttatatagatgttaatgtgagcaatgctagaatgacttgcattataaaacggagggagtaacttttatatataaaaaaggtctctacgagctgcaaacatcctaattcaatcatttccatttgagttttcagatataccaacacaaagtgctttgctggctctgcagagctgaagccgacgacaagccactccgaacagttaaaaaaacattacggtaccttatgcatctgcattaaagttttaaataatataaataattatacgtgtgtctaaaagttcatagtgttatctattagaaaacggagtgttctaaagttaagagcgttatctcttataaaacggaggaatacaactttttcaggttcaggcagtgtccaacatggcgtgtccaacatggtagtagcgccattccacacgcctgtatataaccgcgcccattgctccccaggacaacatggaatgcatctttctaccagaagatagagctttctctgccacgaaatattcagctttactggataccgtctacagccgtctccattcatcgtttcctttccatgatggtgtgacagaattggcttttgtatcgtgttcgttcgtccagtcattttcgtgtgctaagcttcgcaggtcacagacatgcctcgtcaaatttggttttagtcatagacatcacgtaaaatcgaccaactgctcggcaggccaacagtaatgatctcatgatcacccagctgaaactaatcttggcgtgcaatgcattcgcaacaacactttacgccagctaaagagcgagcgagcactgaactgaaggttccgatttccatatcaatcctgagctgatcaaagtgcttgaaaaaagattcttagtgcttgccattgtggatcccgactagattagaagatgcgaggccgaggattatggcgggggaaacacactgcaaagaataaataatcactggagttctagttgtcgtagtggtggacagagacagattaatccagcggcaaacgcgacgactccacgttgccgccgtgccaatgataatccgagaaatcgagctgcacggcggaacaaaggagagcgacgtaaaccggattaatccaaacggcttcgaccatctgaggggatcgagtgaacaatgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatcc

SEQ ID NO: 12959 - DNA, 1501 bp, Oryza sativa
aaatgttctacagccaaatgtagctcgcctagtcaagcaaaagatctgtgatgccatgcaagatctgcacgtaaacaatgataatgactctttagcaagtaacatctgtgatcagttggatcctgctagcccaaaatgctcagccaattcaaccatgtcggatttggttttgccggcaagagacattatttgtgcattcaactacagttgctgttgtctccacaggagaaaggacttggttttgtattttaggcatgctttcaatgcactgtcaaaacgaggtggtatatttgtaatggatgtgtatggtggcacatcatctgaacgcaagctacgtctgcagaggaggttccccagcttcactgtgagtgatgttgtgttagttattagcccttatactagttacgaatccactaaatgctatcttcttgctcaccagatagaaatgtggtaggcatataatgccctgaaaaaactgcgttcttttttatgaaaattcacactatctgcttgtagaatctgcttattccaacataaagatgttgcagtagtagtagtatgcaacataaaagaatgttttagtccgaaatacaattttctattgaccatgcctcctttttatagattctaaagcggttagctatatttttatacaacttcaatctagctattctgaaataattgtaaagtatatatgctatgttgttaccctttatggtgagattttgtgcctcctttttatgactcgatgtccatttcacttatcagtcatataggtttttcccttgtgtagtttattctagttgaaataaacaacagatagagttgtccaattatcaatggcgtgcgatttggagaatgagaatgagattatatatagatttatattactgttcttacatacaagatacaactatgcattcagtatttctgggagcaagaagagttcgatatcataagtcaccaaacaaggatcagtctccacttccaagctggaaagaagcaaatgttacggcatgctttcacgtaccattggcgcctgtaagttgatcacatactattgagaatggtatatttcataattattattgctctcctgtttccttagtggatcttcaccgtgttatggaaaacctgcaaggttgtaactgtcaaaaagaactatagaaattcttattaaaatataaagttgaaaatattttgcttagtccggtcctccggtctacaggttcaggggggaaactagattggtattaatatcatgtgcaaggtgtttagaatacatgtgtattagtcaagggtattgtagtcatttcccgtttctaggccaatcttgtaatctatattttccctttaggcctaactcaagataacagagagttcattacccatttacatcttcttcccaaattataacacagggaacaaccaaaggcaatgccactttattacctctgtgatatattgataccaaccacttctacatctactatatctctga

SEQ ID NO: 12960 - DNA, 1501 bp, Oryza sativa
aaaaaaaattatagaaaagttgttttaaaaatcagattaatttatttttaagtttttttagctgttacttaattaatcatgcgctaatatgcctcatgttttttttttgcatgggggtttagttcccaatccacataggttgtattcttcccctactttcccaactttcacgtcctctttttcgcgttcacgcttcctaaactgctaaatgaggtgttcttttataaaataaaatttatttgaaagttgttttaaaaaatcatattaatctattttaaaagttttttagctaatattttaattaatcacgtgctaatgaatcatcccgttttatgggtggagaagagaagttctcaacttcataaaaagaacgcagcctaagttctaacccttgaatcttcatgtaccaaaccaaaatcaaaggccgggttaggcaactgaacccctacctgcctatatacccttgaccaaaaacaagccgcctcgtcatcgtcaggcctatgatacagaaaaatatgtaccgtgctgactcgcattggtgtcacgctctggttgtccaatgcccccgaccaagcaaaaaccgctccgaattcggttcgcaatgtcaccgatgagagttaggcgcgcaaaaccagcagcgctgttacggctctacttctggtctcccaagcaagcgaaggcgaccgagctaaccgcgcgacaaaccacgcgaggccgcgagaatgctgcggcgtacgtgcgtctcgtggtggatttgttgctgcgggaaggcgagcgcgagcgcggccgcgcgctacccaccaagcccacagccgaaacaccggcagccttgctgctgctgctgccgtgcgtacgcgccgcgctgcgtggatgcgttgccgctagcgtggtggcgccgcgcgcgcccgcgtctcgtctcgtcggttggttggcgatcttgtccgttgcggtgctcgcgcctgcgcgcacgtacgcggcttggcggcacgtgctgcgggcctgcggcggtgtggatggggactcgtcctcgctcgcctcgcggctcgcgccctcctttttgatttggccgcacgcgtttagcaccgcaccgtgcgatcgatgtctgtcttcccccggtttggatctcacctgggtgtggctctctaaggtgtttatgggccaaaaagttctggcccatcctcacgaacataccgagattctaagcccaagtatcctacgtatttacgtagaggaataagttcaccggagtccccccaacttaacagtgagattttttgagatctcttaaccataaaatcagaaatcttcacccctaaaccagaaatctagatggctggttttgatgacgtggcattctaatcagcaaaaataataaaataaatatgtggggccaacatgtcagtgagagaaaataatgtggccccacatcacttttttcttcccctttcttctctttttgtcctttattttcttctcttctctcttcttcgacaggccgaga

SEQ ID NO: 12961 - DNA, 1501 bp, Oryza sativa
tttgtgttccgggaaggaggggttcccaacccctcctcccgaacacagacttaatggaagctctgagaggtttgtggttcgatttgtggttcatctgatctctctactttggtcacaagcctgtagtatattttgaaatggagggagtattgggttagatgcagtcatagacagtatagtgatgttggtaatcttgattggtcgtaggatcagaatggtaggttccaatgagtaagttaatatgttcggttaacgagataacctagatggttaggcacgtgatcacctgcagcctaggaacattaattattgcttttgatgttgctacagccagatgattctcactctgatttttttttgagagaaattctcactctgatttcatcagtgttcttaaccttattcagaacggatcaacagtgctgaattggatagaattactccatattagacacaattgccgcattcatggacttagttaattaactgggattattttatgaagtagtattaattctatataatattgccgcatttattttgaagtgtacgttttacggccagcgtgactcatgcacgcaggaataattgataaattctccttagctttgtgtcattgtgtgtttgacgatccatcatatatccatatgtatatatccagagagacagaagtctacgtacgatccatggagctagcagctcgtgtacgtacacgtccatttcgatcgatgacttaatgcgcatatatatacacgtacgtacgtgatcgacagattaatctatgcaagattgcaaaagctctcaatgtcttcaatttattatgtgtatgtaggagtacactggagtactaattactcctaattaacacgaaacgtcttgaatatttctggtggtgtgtgatggcacgatgcatccacttttatggccatcagcctgtccaatacgccgaattggccggtttggttcacctactcgtttgcacgtatcaattgccacagcttaatacgtctagctgcacgtgtctctgcctttttttttttaattttctcgactgtttcatggcacgaaatagtcgcgatttcagcagtaattcattcgttaccggtaggagacattggggcctcgtagtttactctacaaccttatcaacctctgtctaaattttagtttgaagttaatttttgagtattttcaacgtagtctttttttaaaaaaaacattagcttttaagctactaagagcttatatatatatatatatatatatatatatatatatatatatatatatatatataagtttaatacatcaattatctttttatcactaataaaccattacaatttataattagttttggtcacgatcaatggggcaatttctgttgagattatgggcatataaggatttaatttattccataaataaatcatgacattacagatgaaaactagcatgaacgcatcattagatctacacatgtaaactacgcagaataaca

SEQ ID NO: 12962 - DNA, 1501 bp, Oryza sativa
aaagtcattgtaagtatagcggagaaacaaaatgttgaggtagagtttctgtatgaagttggcggtgtcaaacatgataattaaaccactgatgtcgtagatatggttcgtatatagacctatggtttgggaaaaaaaaaagagaccattgaagtgataatttaaatacttaatagtaatagactctttgatggagtattacaacatgcagcagtggcattaatacgccagtacattaattaagttacacatatgcaggctccattttggtttcttttaatttatcgtattacagaatttctgtagccttgctgatgatcacttggatatcatgtactagtaattaacaataggatgcatacaaaagatggcccaacgacaacagaagatgcgtgcatctgacattgtctggccttatttggttggtagtactccaattaattaacaagagatgatgcattcttgtgccttagtttcttcacatgcttggcttcacgttgagcctattcgcaatcttcacccccaacgactcatcacactgcatgaagtaaatgagttaattacatagttagtgcaaattaatagctttttttgccggaattagtgcaaattaatagcgattaagtcatattaatttcaaattctctacagtggtttaaaattatatatttcatataaaataggattaaataatttatctatggattcataaaactgttgtgctaaacatggtgttaatcatgtggattaactaagagaaaacaattaatcattactaataactactccctccgttttttttatatgacgttgattagttcaaactttaactagtagtgtcataaaaacaaaaatggaggtaatactaaattgctggtatgaattacctgggagaggtagttgacccagatggcgcggagctcaggggagaccttggggtgcgcgagctcgccggcgaagcggcggatgaacctctcctgtctatccggcgcccacgacctgtacctctccccgggctgcttgaagtcgttctgcttgtgtatcgtcgccttctgcctcctccccaccacggggcgcggcgtgatgggcgtcggcggcgcgtggcggagcggcgcgtggcgcgatgggtagtagtccacctcctcgtcccggtgcatgaagttcatggcgccgtcgtagtggttgttgtggtgggcgcacttgggcgcgttcaccggcagcatcaggtagtttggccccagcctgtagcgctgcgtgtcggcgtacgcgaacaccctgcactgcagcatcttgtcgtcggagtagtagatccccggcaccaccagccccggcccgaacgccagctgctcgttctcgttgaagaagttgtcgacgttgcggttgagaacgaggcgccccacgggccggagcggcacctcgtcctccggccatgtcttggtgtcatccagcgggtcgaagtcgaacctctcctcctcctccgggtcgatcacctaacagtatt

SEQ ID NO: 12963 - DNA, 1501 bp, Oryza sativa
acacgcaccacctcccaccgaaacaggatgttataaaaccagccctggaatcacatcggaaaccaaaccacggaagaaaacgccataggagatccaaacatgatgacgacaccgaggcacgatatttgataatggagttcagctgaggcctacatctccggggcactgattacgggcgctcctccccgatccagcatatatagcgtatcagagttacaacgactcacggccggtcgccgccggcagccgctccctctcgctatgctaagtcgccatgcggttacaacaggcacgcccctctatttatgagagaacctaggatagagtccgactcttactctaatcttatacctagtacaactcaaagtcctaaactgtaaccgactttgtacacatattcgacacaaactctaacaaactccaccttggcgaatatgccacgccaacctgaatatgttacttgctcgaacctcgtgtactcggacttgagttggttcttccgccgctcacgccgagccgccccgacaagcctccaccaggcttaccgtaaacaagagactcccgctatctctgtaatttcttcctcttgactccacctgcaacagtgctccactttctcacctatcaccacagtcgtcttgccaagcgaaatttgaattccttcctagctgtcacatcatagacttcccgaagaccatgttcacctccatcttccattttcaatttgacttgaactaatccatggctagataacttgtgtcatcaccaaatagataaatcaaactcaccagacatgaagagaaccatttattccttgttgtcttatgaaccgagctaacgaattcaacatccacgccttcccgcatccatagactgaatatccgataattttgagaaaattcaccgttgccttgaatcacccgaagaaattatcaccatagcgctcgctcttcctcttcagtgacgcagatttcatatatccccatcatgtaaaccccacagatcctggatatatcctgtactgccaaacagcccgctgacaccctcaacgatttttacccgctgttgcccgggattttcttcacgcacctttgccccactcctgcaccaccgcagccttgccttcgaatcataacgcagaagccctgatgcacagttattcttgctgtcaattccagccacctagcctccgtgctgatctccacgtccatcgcgactccgagttgataaacaactccgcaaccgtgtcgacctccaccagctacacaaactgcacatcctctgcaattggattccgataccaatttgctgctctgtgaatagacctacacacaatatgccaatggacacccttgccgcatgcatgcacacatccacagccaccacgaaaccaagcttgttcctcgtgactgcatgcgatccatggcaaaagtccaagaagctcctattgcttgatccaattttgttgtgctgctcctgtgcgcaccgtcaccgcctccaa

SEQ ID NO: 12964 - DNA, 1501 bp, Oryza sativa
ttatggttaattcttgctgtagatcagtgccataaaaaatgaaactccaagaagactatgtgtagcaacttcttagttcatataccatgatcggtatgtttcaaattcttttgttgttttgcctaaaagttcataataacaatacatatatgatgttctaaagctaataagctccagaacaaataaatcaaaactacatgagcaaataggcagcaatagaaggtaaactaaagtgtaaccttttattggtaaacaaagattcgcccctcgactcgtaacgcctccgctcagcacccaacacttccctgttctttatctcctctcgcagctctcggaagctaccagcgagatcgttgttttcttcctcataggacttgagcgctctcctctccttcttcatatcacagttcctcaaagcagcactgctccatttcttcctgatggcacttctcgcctccaattcatcgtatcctgattcctcctcactggatgctccaaacctcgcaaacctcatatccttcttcgcagttgatatatcctcatcatcctcatctgaggagtctggcctcaatttcctgccaaatcgccctgctgcgaacgagtagaacctctctccattcaactgcgagggagcaatccgagcactggcaagacctctagcaatcagcggcaccatcgatgtaccactggactcctgatgcgcctggaacagaggcatcactgagtaggatctcttgggaccgaagaaacagaaggatgcctcctttgttcgcgaaggaatggcggaagacgagctccattgccaccaccagggcgcggccgtctggaaatccctcctaggattgaacgcagccagacgcggctccttcccacccctcggtagctcctgctttgtagagtccaacttacggcggtcgccgccattcccgccaacggagacgatcctcctcggcggccgcggccggtcggcgcggtggatgggcccgtcgtcttcgttccagagatcctcggcgccgggcaagaggaagcggtcggcgagggcgcggatgtgggcgcgcgaggaggtgggcccgtcgccgtcgtcgggaggggaggcgccggcggcgggcaggcgggaggcgcggatctcggagcggaggcgggcgaggtagagctgcttctcgtggcggaggagcccccgctccttgtgcctcgcgagcttctcgtgcatccgcttgtgctgccacttcgacagcccgcccgggaacgtcctcggcccgccccccatcccaccggcgtcctcgtcggcggcggcggcgagaagcagtagggtttatcaatcaattatcactcgctgggatttttcccctatccagggagggttttgacttttttgactctgacaggtcgccgtttccgccttctgagaatacgtttccgccttcgcgtggggtttgcagaaaatgggtaccaactgaatcctcaactcgcagatctctcgcggggagagcagaagcagaga

SEQ ID NO: 12965 - DNA, 1501 bp, Oryza sativa
ccatctacgtttgacaaccttcttgtcaaagataggtgataggcactgctaagtgacgagggaccagcggccatatcactctgagtgactcctgcatgtctatatccactgaacaatgcccggtgatcagcccggataatagatagagagccttcgtatcgggtcaactatacatagacacgcatgccagtatggcacatatagaaggagacgacgaaccggtcggtttccatctatccaaacaccgatcagccaaaccaaaccgtctccgatcgtagctttgcgagcgtgcggcgtgcctgacgctggacaaaaagggcgatgtggacgcccaaagagaagtatgtgcaataggagacgccgagacgtacgtgctcggcgtcgagccatcgtattcgtattccaatacggccgatgcaaccaatcgtcacagcatcaatcggtactcagttccccttcgaacaaggcactgcatgcctgatgatgattctcttcgctctttcagtccttctgatgagaacactcacgctgtcacgcaggcatcaaactagtggatggtgaatacatgtgtgcgttgcagtgtcagaaaactgtagtagtgtatgcttggtccaatccagccttagagattttcccaagtataggttcaccactactccaagttgcaagcaatgaacgagatagggagcactagaaacgcgggtaaaaaaaaggtttagaaaatgaaagatactctcgtatcatgtcagccccggaggatcagtcattcagattccactgtccatttctgatttctctgcttccccgtctatacatactatgtaacatatcttttcgatatattatctatcacctaatcggcagcacttgcaatgtactactatataaacacctactgtaatcggcagcacttgctttgtgtactatataaacacctgaagtcctactcctaagtcctaaccaagcggcctatcagccaaattacagagcaggatacgggcatcttcagaagaagacgatgggagggtcaatggccacgtcgagccttctgttcctccttgttcctcttccttctccacagcctcagctgccttcaccaagccacgccaggtaatcgatcgtcagttcatttctccggtccggctatgatggcgccgtagtctccagtctccggcctcctactttccatgaactgaatagacgaactcctctttcatctcgccattgccaataggtgtacgtggtgtacctgggcgagcatgccggagcgaaggtagaggaagaaatcctcgccggtcaccatggcctcctgctctccgtcaagggcaggtaaacaataatgcaataaatcaattatacaaaaaccatcattgacatctaattatgcgctttcctgtagctccatcagctgtctgatgtgagattgacggattatacttgcttcgattaaaagtcagtaactaaactaatcatgcaacacgctctctgtccatcgaacagt

SEQ ID NO: 12966 - DNA, 1501 bp, Oryza sativa
tcccaacccaaatctctcgtttttcgcgcccacgtttttcaaactgctaaacggtacgtttttttgcaaaaagtttctatacgaaagttgctaaaaaaatcaaattaatccatttttgaaaaaagaaattagctaatacttaattaatcacgtgctaatagatcgctccgttttccgtgcggaggcactatgttcccatcatccactcgcgaacaccagaggtgacggcaacatatcgactacatgcgtgagcacggagaagaggtgactctgaaaaacttagacagacagtcccttaataaaattcatggtccgttccccattaatctctatagctagctgtaaattatctgcaggaagcaatattgtgtcggtggcatgtggcagcgtgactgtcatatgtaaatcatcctcgtacatcgcacaggcgcaacagacgttggtagagggattctaatcattcgagtaggtgctaaaaagagtatccaaaaaggaaaaaaggcaagcaagtagagacaacatatagctagcccggtacaacatgatcatgcaatgtctggtaccctaagactgtactgttgtcattaaccaacttaatttgcatctctacaatgtagatacaatgctcatcgatcgatcggaagggtccaaagattttgtcagcagatctggagcagcagcttgagtggaagtgtctatctctgatttgctgtaattagagaaacaggtgcaaagaccggtcgacatgccttgcagcgcagatcgatgattgtatgcaatcctcatgtcgggaacacatacgaacaggccggcaggccctagctagcaaaatcatgggtttttacactagatcatgtgtgcttcaccctgtactgttctaaaataattcagctttttatatcaatctaaacacaatctatattgaaattcgatcatcgtatcaaatgaaaagtaatatttagtttagattgtaaagacatattggtagccatagctctcccatgatatattgtggagattatggatatcccatatctacatggcgatactatttgggctggatataggataccgaatatgtatagaatatcttatttgtatctcgggtttgtttcttaacttgtacaacaaggaaacaccttgagacttagtcggtcacggctatatttaatctatatctgtgtattccgttagggatattgattatcttttgtaacccggactccttcccatatataaggggggtccgggcgcctctaggggcagatgttgattttctctaaatcatacaatcaataatacactcggcggattcatccccggacaggagtagggtattacttcttttataagaaggcctgaacctgtataaatcttttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 12967 - DNA, 1501 bp, Oryza sativa
aaaaatacttattaccctaatacaactttttgttaattacgaatgcatgtgttaccaacaagtaatgcgtagtacggtaacgaattcgtagtgtatatatatgattctatccaccaaagatttacagtaaattttagtgcacataagcatatacatggtgcactgtcaatatatgattttagtgcatcccttctctataggtgtacatattcaggggtgcatgtagtggcttgtgcatatatgcgtacgccctcctccgtgtgtgatcgcaaaagagaaaagaaaaaggaactattatatataaacagcatatatataaactatatatttcgattatatatagctcctccctctggaagaacggcgggttgcagaagagtgaacttggatagttggcagctagagcagccagctagctagctggagtccttcttgcattggtgggcagactggaaagagtaagctagcgttaattttccctttgtttttctccgtctatatgcatgggttatcttaaattgcaggttatttctttaatttgtccattccagtaccttcagcagcttgttcttgttcttcgtgatcaacaagagatcgaacagcaagctagcatagcagtctaccagctaacttacaggctatctcgcggtctcgccatgttttgtagatcagctttagtgcaaaactacagattataaggtacttgattaattaattacatgtagagcttaccgctagcctaagctagctagctagctatacgaaacaattagggataaccatatactacgcttgatatatatgactgtaacttgtgaattaattcgtaacctccttcattctacgcttcttttgcttgtacgtactgacagtggcagagccaaaatttactgaaggttagagctaaactatatctcaattgatgggttgttagattttatctaaaatttacattatgatttaaagagatataaacttaattttagagataagactactttagacctgcataagcccctgcgtacatgacagtatcatcaccatatgtttgtcatcttctttccttattttgcacatacatacgcccatctcacaaacgaaaaataatttgtgaataaatttttatatacgtattcttagcctaaaagcaaaggctgaaaaataaacttcgatatgaaaaatcctgaaattaactctaaatttaaggttgaaaattcaaattttaattgataagtatatgtataaacacttattttgggacagatgcattatatacaggacattaaacagctactataagtttctacttctagtgtggtgatggctgtgccctaggcctgcattcgcccctccgtactgatgacagtgtcattaccatatgcttgtcagctttatctgcttgtctgattctttccttgattttgcgcacacctatgcaggaaattaaacagctagataggtttctagacttgtgtggtgatggcatctgctcctccagttc

SEQ ID NO: 12968 - DNA, 1501 bp, Oryza sativa
tccttcccaccagcatctataattctgagtttctataacgtttatttttccttagcaatcaggttgagcaaaactcaacaaacttcagaacatgctgagcttactaatataatgtttatttttaacacacatcatccatgatcaactttactcacatttacgccaactgccactcatgacaaacggaagaacttccgaagaagaagtaagtatgtgggattgcttgtatgcatacaaaccaattagtttgtagagagtacctttgtacgaataaattcagagaaagcatatggtggaggcaatgcagtgcccaagttcacgtgtagagcttttctcagaatcacatttcagcagatctcatgccgtcatgcagtgcttaaaaaaaatgtcgacaaggccgcatacaatgaataggtgccacattcctgtacactttaagtgactgatcatatcgcataatcgctataaggtggggtgatgaccgcataaaactgcttacactttaagtgaccgattatatcgcataaacattataggtgggtgaccgcacaaaactgattaccgatttgatacttttttggaacattgaattctcatgtgagacagtaagcgtttcttgttcttttgtatctgcacaaacgatgaaataagatgcaaacaatctactacagatttgacagccgtgctgattttgtttcacatatgtactgtcataataattaaactcacaatagtcaactgtgtaaaatgtttggacttgtttctttttttttctttccttttttttaaaagaaaaacgtcaaacttcattgctaactggaaacacatcagacatcagagtctccccagtagaaggacgggtttcagaaaaaccaagtgttgaaacttgtcgatagcccctggtttgcactttgttattaacatgctaagcgtgtctatgatattttgccttggatctgatacctttgtcttcagttgatatgcctatttggatgttgaactgcataatttgggaaatgtatcttgtacacgcaagttttcacgtgtatacaccatacacagtaactaatacataggaatagaaatcaactaattttttttagataatggattataaaaaacccggcctctacaccttgtgagggtgtacacagcctaaaagtcacaaacacgagtacataagactctcccgttacatgggtaaaacataaataagttttaaagatggataacaagtaagaggaattaaaagctaagcttcaatccttttctaaagttccacctaaaagtagagaagagctccatcatacgcttctctaaaagcttggacttcgcgattacttcaatgacttcgtcttccttaagaagcaaagaccgaagccttgacaactgagttgctttgaaaattacctgagagagggtcgagattcatccacgccttcctggacttagccttttcaagtgaatgtctcccgctgctgcccatcaacctctcgctagc

SEQ ID NO: 12969 - DNA, 1501 bp, Oryza sativa
gcatgaatttgatagtgcgtatgacccaaaaccaaaattgcacatcataactaattttgataggtttgacacagattagaagaacacaacataggcccgttcttgtgtacgatgaactaactcaaagaacatactctatctaaattcattaacatcaatataaatatgggaaatgctagaatgacttacattgtgaaacggaggaagtaacatttttccctcttcaaaaaccccccacaaagtcacaatgtttttggctgcctctgattctctcctttttctggaggtctggacaaatacaacaatgacaaactagggattctcttgagctgaacaaaagcaagagtcgtgttacttgtgtaatcctgtaacaacacccatcttgtaagttgtaaatttagatgcgcattagcacgagggaatcccaggtattttggccttataggattgatgaaattttagaaactatgagtttttgttatactacgaaatcccgatgagtaaattctttatttttgcccccaataccaacttgttttaggtacttcaaaaacatggcaaaacacggataaattatgttctttgttttatttggtacacgcagcccttgcaactagtttttttccacctcatgattgcttagtctttctaaaccaaaaagaggggaaaaaaagaaaatttgctgtagcatgtgatttatctcccatatcctgtgccacaaggatatttgccacccatccttcttaaaaagtctaaaacttgtaaccgtctaacagtgcagtcctagttctatttcttcaaaaacctcatacccataccccttttctttagcttacatgatatagattatcgcagaaacacactttccaagctcctaaattgtacgattcttttagaaaaacttatcctttggcatttcttagagaacttttttaaatcagcattttaacttgctttctaatatttaattctctccttaaataattatcataaactcggtttcatccatcatctatcaacaaagaaaaaacaaaaagagaccatactactcccatatcagcaatcaactcaaggccatggtccatactactaccaagcagtccaaaaggattgcaatctgctgcaagttgcagctagctagctaactagctaggaacgatatgaacaatcagcaggttttttcttcttttaaaaggaaggtaacagcttctcgtatattgatagagtaggaatcatcagggttggtgagccggcagcacacagacgacgacccggccatttcttcaacgcaaattgtactcactcgctactactcgtagcgaaatagcgatgcagtggccgctttcacgacagctcaagccgtgtgctgctagctttggacctcggctcgttcagggcacgcacacatctgcgtcaaccttacctccttttatctgcttgctgaaaaggcaggagttattttctctgcttgttactgcttctattccaaaatataaaagtc

SEQ ID NO: 12970 - DNA, 1022 bp, Oryza sativa
gccccacaattgtgtgtgaatgacaaatgagtcccacgtataactttttaattgaaatgccacctaagcgccacatcaacgccacgtgtaaagaagacctggtcaataccgccacgtcagcgaaaccgccctccaaaaccgctgagggagtcaaattgcaccggttttcatagtttgggggtcaagatatccggttttgtggtttagggtcacggattagatttcaatcacttttgagggtcacaaagtgaacttattcccagcttgcacgattcctacgaggaataagttcacctaccgtccctcaactttatgtcgagtctgtaaaacatcccttatgtccaataccagaaatctccccccctaaactatacgaaatcatgtagaataggtcctatggcagtataatagatggttttactaacgtggcatcctaatccgcaaagagggaataaaaaaattgtgggggtccatatgtaagtgatagaagaaaaatgtggggtccgcatgtcagccaatcgtctttcttttcttccagcccgggacagctggcaggagaggggggcgtcggcgggagaggcagccggccgcatcagcgggagaaaggggagaggtcgccggccgtgccggcgggagaagggagagaggaggccggccgcgctggccgcgcctgtgagaataggaggagaggcggccggccgcatcgactggagaaatgggagaggccgccggccgcgccggcaggagaagggggataggaggccgactgtaacgccccgattttcgttcgggattaaaaatcatttgataatgcatttcctagaaattaaataaaaagttaagcaatttattcaagtgaattaatagaggaaattaaaatttcctttaaaaattattggccgggaatattttgtaatattctttgtgccctaatgtactctccataattttccgtgaattttcggagctcgagaaatagtttaaagtcacgaagatcatttaatcaattaaataaaaagaaa

SEQ ID NO: 12971 - DNA, 1501 bp, Oryza sativa
tgaatttgacgcggttaccgcggtttaccccttaccgtacccccgcggtaagcgcggtaaccgcggtaaccgcgcggtttaccgcggtaaatgaaaccctgtcgagagagcgtttggacttttggcgtgcgaaaagcccccagcaaaacagggagattttgccggctgccctcgtgccccgtgcaaccgaaattttgaacagctctgcgacgacgagggacgcctttttactactatagtacaagtacctgagtatatatacaagtttttactttttactactactactacatggcgaattgaactgctgcacgagtgcacgacaatctgtagggtagagagatgggggagtccatgtgccgcaagagctgtggtgaatacaaacctggaacgatccatcatccatgtgcggtgcccgcaagctgtggatacgaaccgcgcatgtgcggtgccctctccaggagtagaatggagtaccagaactagtagctagtggaggtgcactggaaaaagggcatcagcatgtgccgccgatctagtggacgtaaactacggagtactattacttatagtatatgacccactcaccgatttaatctagacttggagtagcatctcaccacctcgtcgtgttatttttttgttaagaacagttacaatagcagactattagccagctataaacatattttaatgagataaaatatgagagaagagtagtgggctacagacctgtaatcagctgtagcacggactctaaaacgcaatgtgtatatgacagatgggatcatatattaataaaataataaacaactattgtatgatttatctattaaattgactatagataaattgtagttagtagtaggctataatattaaacttgctcttacatctcctcgggttcgtttgattcccggtattagagcaggtacaatagcaggctataagccagctgtaaacatattttaaaaagataaaggaagagagagaagagcagcgggctacagatttgtagccagctgtagcacggactccaagactgtgttatggtaggtgggatcagatattaatagtatagtaaacaactattatatgaattgactataaatgaattggagctagcaatgggctatgctattaaactggctcttagagtaggtacaatagcaggctataagccagctgcaaacatattttaaggagataaatgaggagagagaaggacagcgagctacagatttatagctagctgtagcacggactccaagacacggtgtgtgtatgacaggtgggaccaggtattaatagtgtagtatgtaactattgtataaatgaactattagattagctatagatgaattggagctagcagttagctatactattgaacttgctcttagtcgttacctcgaaactcgaattgcccgcccaaagctacccaaaaggagtatcgtactggtccaccacggccggtgaaaacctctactactacctgtac

SEQ ID NO: 12972 - DNA, 1501 bp, Oryza sativa
tactatatagctataatcactctgaccgcattgagagggtacagagtttcccttggttggaccagttggtaatcctgaatgaggagcaaatattgctagccatccaactattcaaggatccgtcacgaacgaaaagaaaaaaatttctcaaagtatcaaaactggacttactgataagatgcatacctaccaggaatcaccagaggcttacctatgtgtggccatttgccaggctagccaagaagggtgctgtctgtgccgggcaaaatgatgggagattggagagaggcgttggtcaggcatttcgtcgaacgtatgtagggcgcaccgtcaacgtgcgtcgagcgagcacctaccctcggggctcggggcacggaacagcagaggcgcgtggatgccccccgcgcgcgccctcttcgatcggatggcgcccgagatgcgccgcgcccgcgccctcttcgatcggcggccgcggcgcggggggagccggtgcgaacgacgacgaggtctgcagctgcaaggtcgagagtcgagaagctgcacggtcgctggctgtgcgcgaccccaaaaaaggccggaccagtgaatcatgggccaaaaatggggtctcggcccacgagcaccatcgttagatcataagactttcaggaaaaagtatacttttcctcaactatcgctcgagtatgattcatatcctccaaccataaaaccggatatattgactcctccaattatcaaaaccggtgcaaacaatatccctagggacacaggtcgtctgcagtactgcacatgcagtgcagtactgtaggggatctcaattgatatccctaggtggttttggctgacgtggtacctacgtggcgcttacgtggcattagaaaaaaaacaaaataaaaaaatatgtgggacccatatgtcattaaaaaaaatattgcggaacccacatgtcatcctccctcattcccttcttcctccctctctctctctcccttagctctctctcccttatagctctcgagagcggcggtgggccggtggctgtggcggtggggacgggtcagcggcaaggaggtgagacggtgactcgactcctccctctcccggctcggtgatgaggagaggagatggcggcggtgctccaatcgtccctcccttcctcccagatccgtcctccggcggcgggcatggggtggaggagcagccgacggcggcggccaccgtaaaaagcactggccctacccctcccagatcaggacggagtaggggagccggctagcagcggcggatggaggaggagagtcgtcggccggaaggggaggccgctggcgacggtggcgggtaggggtggtggcagtgtatttatttattttattctctgaaaatattttcataggcgggtggatctaccgcctgcaaagatggagatgccgttgcgtgcatgcgtgttagggttaaggataaggtatactctctacccttggatatacgttgtacactgata

SEQ ID NO: 12973 - DNA, 1501 bp, Oryza sativa
ataaattattggtctcaatattatatgatctgatcgtggatagatgtgatttatctgaatagtcaacgcattgcactttaggcagccatattggtcttctctgcaggtacacgtgcacgcctgggcacgtactgagtccatgcatatgcacgtgtacatgtcaggagtaagcacgttgactcgttgtcttgttgttcagtagattacgccgtggtgattttgggcagcaatatatccggcctgagtagattaacacatggtttcctatcacgtggagtgacaggcacctgtcattcacctatccgtccggcctgttattgtgtccgaccaaagcacgcgttagccaggaaatcgatcagtgtagtagtcaattccggtctcccatggtgtcagcaacatcctcgagatcaccgatggtcgataatactgaacagatgtcttcagctgcggcgacgatggttccgatctcgtcggaagacatacttcggtcggattagatctccccagtcccccataaccgaagttgtcgagtagtttggtgttagagaatccatctcttgaaccaatttcatcgaaaccttgaagcaccaaactccccctacctggcgcgccactatcgatgtttgatatcgcgactacggtatttagatggtatagggatcactccacctacctggcgcgccactgtcgacatttgatatcgcgattacggtatttagatggtatagggatcgttggtaccagggtatatgcgagattgaggtaaaagagatggagacagggatttttatacaggttcgggcccttatcttacaggtaatagccctacatcctgttggccgaagccggtgttgctctttattcatctggatcacacagatacaatatttaggataatatatctagctgtcgtcgacttgacggatagatcaccaactcgtagtcgacgatagggtagtcttccttattgaatctatactcgacgagatcagagatggcgctagatccctcttgtcggcttccgtaggcaccaaatggggtatggctaggctaatctttgatgtcaatatccgacgacttgtgttggtgtcgtaggctctccagaccttccattataattaagagatgaagtgaataattcaagtcattaaacaagcataatgaagtagccgacgcctcgagaaaggaatattgaagacattgctgggctttaagcctgccagtgaacttcagtctgagtcaacttcagtctgagatgtgcccgtcaaaccactcgaaggcggtgacaagatgtgttacacattcaggagacttgataaaaatggctaaatatctacaacatctcaaatattctgaactcatactcatgtgaatctagttctgaggatgtgcactagattcacactttcatcttaagcatggacatacatagcaaacacaaataagatgaaagcgattaaaattacatctaacttagagatacataggccgaccgaccaaa

SEQ ID NO: 12974 - DNA, 1501 bp, Oryza sativa
cgcccggaacagcctggaagcctacgtctacggcgtcaagaacgccgtggtgggcggcgagatggcgggcgccatggacggcggcgagaaggagaaggtggaggcggcggtgatggaggcgtacgagtggctcgacggcaaccaggacgtcggcaaggaggagtacgaggagaagctccgggagctggaggacgtgtgcaacccggtcatgtcggcggtgtaccagaggtccggcggctcacggcgagatggcgacggcggcggcgacgacgatcacgatgagctttaggccgccggctagctagaatttatttttgttgttttttttctgtagaaaattataggcagataataaccctccctccatctatttttgatagtaatatttcatcttgacgcacagaccaatgataagcaattccgttctacttatcatccatttaaacatgctgctagtcattcctcgtaaacaagcgattcattacttgtgtgtaagaatggagagtcatgcattaaatccgagaaagtcattaaaatgatatgttgttccgttgttgaattgaaatatgactatcacaaataaatttttcagatttgaaaacataactattaaaaatagatgaagggagtagtgatatttactacttacttgcatttcatatatttttaagatagtggaagagtttagtctagcttctgcacatttgcaattcaatcaatgttatgaagattttctgaacatatgagggcgtataaccgacaatggtttgtgtttatgacccgattagttgtttggttactgccaatcctaacaagctattcggcacatgtagccctgaaaagcaaagcaaagcctcagtcattccgatactggcagtcttgcaatttccctttgttttcagaacagaaaggggaagaaaaggaaaacatatataacaatttgatgtatcctaattctcaaatcgaaccggatttgcattgaaaacactggtcaatccaaaatttcaaattataactcttattgaccaaattcaaacaaaacataatctgcaccaggaagctctgtccagcaggctccaaacggaacatctgcagaaactctgagtaacaaacctgagaactgtatgatgtaattttcacggacccatatgatcaactcatcattaagggtgtgttcggcaacacgtacaggttcccaacttctcccctcatattccgtgcgcacgcttttcaaaccactaaacggtgtgttttatgcaaaaagtatctatacgaaagttattaaaaaaaatcatattgatctattttttaaaaaataatttgctcatacttacttaattacgtgttaatagatcgccctgttttccatgcgtgagggatttgctcccatccagaagtctcttagcgaaaatcatcatctacatttcggcatgctaacacaatatattcaagacggattgaacatgtgaactgaattttatttaaggactgactgaaatag

SEQ ID NO: 12975 - DNA, 1501 bp, Oryza sativa
ccgaccaaagatggtttctctaccagtgaagaaatccaagtttctaaccctagtttgtttagttcgcccaccatgatgtgataattttgaccaccgaaacccctaagcagaaagaacaggacatttccacgtacagttcattcagatcagcatttccatgtagttgagcgtgcggcgtgggttccacgtacagtcttctcaaatttctaattttctcttctctcaaccacaccgagcgtacaatatgcacgaacagacaaactgaaaccagaggtaaagacaatactggagtaatatatagaaagctaattcctcaatagtgttacaaagtttcttaacgaaccgtgacccgctaatttactagtacaattatttaagtgaaactgtgagagtacaaataactttaaccgtaggctgctaattaaagaaaatagtagcatacacaccatgcagcggaagtatcgatggtgtaggggacagggcctgagacatcttgggcttgagcttcaaaactccatgtaattttctttagaaattgtatgagaattttcaaaaatatataatgcctaactaaaattgtcaaattcagtcttagacttgcaaaaaaaaaaacatccaccactgatggtatagtgtagtagttattgatgcacaactcacccactgggggttttaaatcctaatgccttcaataggattttaaagaatccacgtacttaaaaaagtatttgaatatgatatgtagtggtgtgtatatgcatctttagtattcaatgtaatcgaataaaaaacatacataggatttcaactaacggttccatcctaaatgtagaggttggagatattttcatataaaagaatacaaataaaacagtaaagatcacatgaggtaaaagagtaaaaaaaaagattaattcataagtacagtggtaaaagaataattggtcaatggtgtgtggtttatatgaaacactataaccataatatccgagattatatgtttaagtgttatagataaggcatatataatatatatttttgtgttaaactcggtgggacccaccatataccaagttttatactgaatcaatcctaatatacgaaaagtattccagataaagaaagaggaaaaagagtctactcgatactaccaggactatttggatcgtataatacttgcctacttagttttacttagaaaaaggcacacccgaagatataaatacaagtcccactagaagaagtgggaggccaagacagaacacaagccaatacagatctaaacaaatacaaaacaacttcaaacctcaccaagttcatagtactcgagaaataagattacactagttgtcaaccacatgtgagagctccatgcggctaggccaacagtgactagattaggtcatcccaaatattatactcgcgtgatgttgatagataaaggcaacaccggcttcaaccaagaagagcagggctattacttgttagttaaggtcatgac

SEQ ID NO: 12976 - DNA, 1501 bp, Oryza sativa
aagggatagtattccagcgaaaccatccttttgcgatagtaaaatcacaattttctccctgcccgctgccgctccagccgtgctccccgcggccggccgaaggggagaaaaagagaaagaaagagagaagggaataagaggggaggaagaagaaagagagagagaggggatgacatgtggggccacatgtcagtgggccccataattttttatgtgtgtgaatgacaaacgggtcccatgtatatgtttttaattcaaatgccacctaaacgccacgtcaaccccatagactagttcaacactgccacatcagcgccacgtcaccaaaaccgctctccaaaaccaccaagggagtcaaattgcaccggtttcaatagtttgggggtcgagatatccggttttgcggtttagggttatggattagattcgggtcacttttaagggagtcaaagtggacttattcctatgcgtgcgaattctactcgcgatatatttctcccgattaggcccagcccatcaggaaccaaaccagccagtcgggccacggcctctttttacgcgaccacgaagcgggcccggtccgtgagagcctacacttgtgctgggccgcgagccagcccagatgagcccaagtactccgccacatccaaatctgcaccgttaacgccgcatcccacggctgtaagctcccctccgggagataaaacaccctccccccgatccagccaccatcgccattctctagggtttattccacgcctcccgtcgccgccgccgccgccgtcgttgtcctcgcccgcgcgcgaggagaacgctaaactccggtcaagatggtgagatccgaacgccctttactctctcttcttcgcgtcgttcagttattttctttttgtttttttttccagttcgttcggtgccttgtatggtcagtccagttcttgatttaaaccaggatatgtgatcgtctagttggcgtagaattacgtgcattgtaccggtggaatcttgttgcctgtgttagatcacgcggtgagttgatttgttcggttggttagttcttactagatcggtctcttctttaggttcatgtctttttgatctacctgtaattctttgtagagcgagttctttgtcaaatatgttattttggatcagagatcattttgggtaagtgctctgtgggtgacaacctggtcaagttgttagtaaatggctcaacacccgttctattagacatccttttggtaattaggagttactttctgtaaaactgtgattcccaatcataaaacatcctttgatagttatgagccattccatctcaacattaaatgtttgatgaacgcatagaatcccaaggaatgatggcatagattgtaagtgcttatttggtgaatcttgtttttactgtattgcccccttttcatttctctcatttggattggttaaacgctatcaatatgtatttatcttgttaaaagaatctccttttctgcttaat

SEQ ID NO: 12977 - DNA, 1501 bp, Oryza sativa
gtcctcgccggctcgtcgtctcgctgcgccgccaccctcgtcgtcatcatagcggcgtgttccgcgccgtcctcgtctccgtgcagctgctgccggctgccctcatcgcctcctcgccggttcctgtcgttgtcctctcgtcgttcccggtcgtcgtggcattcgtccctccgtcaagccgttctcgtccgtcgtccgtgtccgtcaagtgtgccgctgcagccccgtcgttgtcttcgtcctcgcctccgcgtcgccaagcgttgcgccggccgcgtctcgccttcgtccaaggatcgccgccgaagtcgtcccctcgcctttcgtctccgtcattcccggccgtctccgccgcgcccgttcatcgttgtcgttccctcgcctcgtcgcgtggtggtaaggatctctccttcgctgccccgtcctcgtcctttcggtatcgcccgtgcccgttgtgcggttgtcgaccccggtacccgtgtaccggtgtcggtagttgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggactgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatgtaacagcattaaacttcggatgatcatatcttggtcatacgagctctgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttaagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggatactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 12978 - DNA, 1501 bp, Oryza sativa
agcaagaatgaaattgcccctaatatttttgttgggtaaggttcatgtctagtgggctagtgggatgtggccctaagttacacggttggccctaaggaataagcccactttgacttccttaactatatatcggccccctccctcaactattaaaatcgatcaaatttgactcccttgacagttttagaggactatttcactaacgtggtgtctacgtggcaatgttgagctgattcatgacattgacgtggcattagaattaaaaacatgtacgtggaatccattcgtcattcactaaaaattatggggcccacatgtcatctgtgtctttcttcctctccctttcggccgtgagcaacgggtaagatctggagcggcgggcggcggtggccgggagcgagaagctcgtcgtacctctggccgtacgcgtactgctcgagggagaagggcaacagtgttcgacgtgtcgttggccggcggcgcccttggcatggcgccgtgcggcaagcggaggggatcattgaggagaagaagctccaactttcaactatacttttaaaactattaatttatatatttttaaaatgctaattaccataattaagttaattagactaattgccgtaattagcggctaggacggtgtgaatgtaaaagggcatgtaacctgagtagcaccccaagatcctaagttcaaatctacgtaggagcaaatttcaaattgtgttatttgagggctaagttccctgtatgatagactaaattcttaatttacaaagactacatatatccggttggatgaagaggccggataaaaaatacctttctctataaagaaaagaaaaacggcgccgatggtacgtgcgcgcctgcgcgagttacccatcaagcgctagcgcgcgctaaataggaatccccagttgggcatacaccggaaattaaaagtggagagctggcggttccgtggtttgactttggagaaaccacgaaggaggcctctccatggcgactccatctgacgccgcgacgatcatatggagcacggagctcgagctagctccactgatagcaatggtgaggaaccgggattatttcgccggcgctcgattccacgtcctccgtggcgcgtgcgagcacctggcgcacgtcagggactgcgtgcgcacgagggcccgcgtggcggcgcggcggggcaggaggctggcgacggcggcagcctggacagaggaggcggagatctacctcctccggttcggcgagctgcggagcgcgcacggccggatccccaggctcatcttctgggatctgctcggctgctaccgcgtcagcaaggtcgcgtcgctgatgatgccgcaggtgaagaggctgtgcgaagaagggggaaggatcgtgcgcaggagcaagctgccccaaccgatggagatctccacggggttcgcgagcagggatcgtaccctccgggccgcgatcgagagggtgaggacgatccaacccaacggca

SEQ ID NO: 12979 - DNA, 1501 bp, Oryza sativa
ggtttgtttttttttttgggacggagggagtatatttttatacgatcgaacggatgactgacggcctgatcaaatcgccagctggcccgcagctagaatgaatatataggatcaactaaataattactccgtatcagatagctagcagtagtgcagagcaggtcgctggatatcgtgttaatttgtattatgcgatcgagacaggacaaggattatatatactactccaaggctgtgtttagttcaagcgaaagtttagattttggttaaaattagagatgatgtgactgaaaagttgtgtgtatatgacaggttgatgtgatgaaaaaagtagaaagtttggatgtaaactttggatctaaacacactccaaatgtactactatttacaaattaagatggccccggccccatgaccccatctcatgcatatgcaaatatgccttttgtctttttctttttcttttccttttcctcgtgcttgtcgctcaagagtgttcttctttctcggaaaactatagctacgctacgtactcccccaattcccaattaatcaccatgcatatataattcttttagttatacgtaaataatcatcgtattagttttccttcactaaatctgctcgctatgtgtgcatggacgaagtaaatgtattgatgcatgcatccatgcatatgcatacaaccatttacaacaaacatgcaatatcttttatggtttggtagtggctaggaagtattagggcaagttttatagtggagatgatagtcacccttaatttagttcacatcatcaactcattaattataagaggcaatatatataacaaattacctctagcacacttgccccggtacatcatatattaattttactttatttgtttcctatcaattcattggtctcttgttcttatatctctagaagtttgtggagagattgcctcttgcataagatgtggctccttctctctccttgcatatctcaaccacctcattatgtgagtttatatggcatctagaaataaatgtgtagaggtttatagtacttgcccttagaggatttatatggcatctagaaataaatgtgtagaggtttatagtacttgcccttagaggatggtacatgtattcagttctgttaccaaattaaatgtaatatgggagagctactgatttttcttggttttgtatacattcctataatatgataatcaattggcaatggaaggagtaaatatatgggtaaggtgttttagtgatttattaaattgcatggctctgcttttgtcttgcattgccacaccttttcctttttatttcctctgacacttccctcttttcttaaagagatttggatcgaatatattggatcgcttgcattgcgtatgcgtactcgatctctccttttcattttgggaacatggttctttgcttccgatcatgctgatctatcatgcatattgttgcatactcctttcgtctcataaaaaaataaat

SEQ ID NO: 12980 - DNA, 1501 bp, Oryza sativa
tcttacctatcaagattgaataagttttataagatatcctcatattttacaatattttgttcaattataagacataaccaagtgcaaagtgaaatcgaattgagataccctggtataaagtgaaagtatgtgttaaacccagtgtaaagtgaaacaagttacgctctacccggtgcaaagtgcaatttactcaaataattatcaaaagaaaccaatttagcaatgatggattacaactaggagtttatgacacagatagtaattagaaaagtcttctatcatacacttgagtcttgcatagactacgtagacacagggttgacggatatgattatctaaaaaactagccgtcttaccttcactgtccatgataaggtctagcgcaaaatattctacaaagaactgagtattatgcttcattgcttgaccatacagagtgtgtaacatagcatgtcctgttctgtcagcagcacatgcacatcgataggcctgcccacctgaagaaagcacacacagttatagggactggaataatatatgtcaagattgtcttttcaaaataaatttagaaagctacgacctttcccaaaatctaagctctggcctccaaaggcccgttggtatatctttccatcttcagttcttgaaaatggcaacccatagttttcaagttctataactgcttttggtgcttctctgcacatatactgaatagaatcctggtcacctggaaatggataagaacaaaatgttagaaagagagtgaaactgtagaacagtagggtagttgatataagatgccattccatgttagtaactctttattataacctctaggtgttttgcagcctaaaagaagtaaaaaagggaaccaggaattaaggcagcttaccaagccaatcactacccttgacagtgtcatacatatgccatctccagtcatcttccgtcatgtttccaagagcagcatttatgccaccctacatacactcttgtaaattagtacgtgaatgaagctcataaacataccagaacaataaaagaagtaagagaaggctctaatgatgaacatcaatggagcaaaatacatcaaccaacaaaattgaaaagtttagatgttaacctaggcatttagacataccaaaaacaactgttgctgaatgactcatatcaacaaaaagtataaaaaataaagaggcacaaaaaagattcaaacatgcaaaacacacaaaataactaggtaggacagtaatataggcattaatcaattaaaaatttatatgtatagcttcgatatcggtaacagtaatatcgcaagtcaaggaatacatcagatctgcataacaatccactgtgaaatgcatatctgacttaaaggccagagaaacagaacaactgctcttcaaaattatcttaaatacatagaaagtttagaacagacaaccaagaatggcaggactaaaagtccaggacactgtatttattcctttaaaatgattgt

SEQ ID NO: 12981 - DNA, 1501 bp, Oryza sativa
tttgatgaatctgtatattaaattgtcagtttgtgtacctcggctgattcctggacgaggattttatgcacaaataagttcggaaattactagtgaatttttgggcgtgtcatataccactccaaaaattagttatgttgaatttgccgatgataactggtattggatgtgaggtcttacctgacccggacgttgtatgaatttgacagggtttaattggatatctgcccctgaaaatggctcttgcatgtaccactaaatatgcagttgtctcttttaagtgcatgttctaaacttctaaggatgattatggaatgatgtcttgttagtttagaaagtgatgtgttttgttcatggtatatttcagggatgagatcatggtatatgagtttgtttttccagcccttcagaaaaatgataatttacatttgtcaggggaaattgtaggccaaaacggcatgtctaaaatggccacaaagtcataacaacctcaatttaaaaacaaagaccttaaacacaaatatagtactagctccaacataatcctgcaataattgttgcaaggttcctataaaaaataatataccttagattgatcacaatcaagctaagaccctgtttagatgggactaaaactttttaagtccctatcacatcggatgtttggaaactaattataaatattaaacgtagactattaataaaacacatccataatcttggactaattcgcgagacgaatctattgagcctaattaatccatgattagcctatatgatgctacagtaaacattctctaattatagattaattaggtttaaaaagtttgtctcgcgaattagctttcatttatgtaattagttttgtaagtagtttatatttaatactctaaattagtgtctaaatatagagactaaagttaagtccctgaatccaaacaccaccttaaatcaaggttactattgacaaatgctacctagcctttttgaaacttggcagccaaatatttagccaagcaacaaaaaggaaaaaaaaagtgtcacctcagaaaagcaacttttgataaataacacttgaactacaaatctacacttgtctgtcccatcctaaaaagttaacaacacccaatttcacactcaaagacaccagacaccagtacaaattcacaacagcaacacaccatccatccccagccaaaaaccaaaaagaaaaaacaagaacacaaactttatgcaagaaaagaggaaaaaacgtccataaataaagagagtaaaaattcaagcataaaatccaacaaaacatcacatgtttctttttcctagcaaaaataaaaataaaaataaaataaaataatcacatgtgttttttttatagcagtagcagccagcaggagaggagaggagacgactccattgccaaaaagctctcacctttgcctcctcactctcctcacactctcttgtctccactcgccgcgccacgccacgccgcgccgcgcaa

SEQ ID NO: 12982 - DNA, 1501 bp, Oryza sativa
atgtattagaatggaaatgccgaactacacagactatcttttcccttggtaaataaaaatggacatgagtactattttcatgatttgttaatggtgtgttgtaccaaactttggcttttccatatgtaaataaaattgcactccatatcgatgccaaaaaatgatgtgtagattttctgcttttcaaggatgaagaaggttgctatcaccatttgattcatattggtgccctgtaactgtttctggatattatttcatgaaagtaggggtggatcagtgaaaggagccaattgcatctgacattgtcacactgatatcgtggatcatccaaatgctgaaatgtttaagcctttacagattgtcaaagaaacactacctctgtttcaggttataagactttctagcattacccacatttacatagatgttaataaatctaaacacacatatatctctctctctctctctatatatatatatatataagcaatgctagaaagtcttataatatgaaacggacgaagtagttggttgttgtcaaactaggatttgacggcacactgccttgctgtttcatttcgtgaatgcagtggttccatacttgtttcaccatatgatatgatcgcgcagcggaagaaggccttgtcaaaggcaaaaaccacataactactcaagagctatggaatctgatttcttatcgaagctacggctcaggttgctaccatttcctgaataaagaagtaaaggttactactagaatggaaatgctaaaatacacggattatcttttcccttggtaaagaaaagaatgacttgctaatggtgtgttgtaccaaacataagcatttttcctatctgaagaaaaaaattgtactccatatcaatgccgaaaaatgatgcttagatgatgccaaaaaattgtactccatgtacaggtgaagaagaacagggaaaaaacgaagctgaatgagaaagagaagttgtatacttgtaatcacgtgctatcttttcgctgttgcaatgaaatttcctgatcacatattcacatgaatcatatcggcagtttggcgagcagttgcagtgggaataggctgtgtttgttcacactgaaattggaagtttgattgaaattgggacgatgtgtcatgtgacggaaaagttagaagtttatgtgtgtagaaaagttttgatgtgatggaaaagttgaaagtttggaaaaaaaaactttggaactaaacagggcctaagttcaaccgtgcgctgctcaaccatctgtccagttcaatctccattgaatgccaaatcaatttgaactgtggctacaaattgattgctacaatcccaatccgagcaagtcattaccaagatgttgaaatctatctccactgcaatgccaaatcaattttctgatcacatattcacatgaatcatattggcagtttggcgagcagttgcagtggcaataagttcaactgtgcgctgctcaaccatctgtccagtt

SEQ ID NO: 12983 - DNA, 1501 bp, Oryza sativa
aagagtgtggcacgcattcctgaagcacacgctctttgtaccatcggtgagactctgtaattacctcctccacgcctagttcacactaaagtttgaaaatttggttgaaattggtacgatgtgatagaaaagttatgtgtatgaaagatttgatgtgatgacaagttgaaagtttgtaaaaaaaaaactttggaactaagcaagacctaaaaaagaacaacataaaagcaggaacttcgtgcaggaaatgctactaggaattaggaattaggatcaccattcttatcataatacaccatcatttgtgttgatcatctgcttaagaacttgcaataacactctgaaagcagtggttactagtaattgatagggccagtcatgtcagtaaaaaaacttgaggtggtgtatggacatggttcttcagagaaagatgtcggtacgatgcatggaggctgcgtcagggaaggagttaaggattgcagttgggaggtaggtcgcccaacgggcaccaacgccgcctgcaaaatcttccgtgctgtctgaaactctgaatctgtgatgcaaaaaattccctgaatagcgagacatttttttcttgtgaattgtgagatttcggaatgccagcaatggccgatccatcacgatcagttcggatcaagaatccatcaatggagactgttaccagtaggaaggtggagtacataactatcagcattcagcagatgctcgtgtggaaaattcagggttcattttacctgcatcataaataacaataattcatgtttatttgagatagttaaaattgatggattaaataaatagtttgatctttttatggctctcctacaaaatcaatcagatatttaacaagttattatgcgaaaatttatatattattttccacgaacacattgttgagaagctggtctagaataagaagagggtaagacgaaaattagtcattctcgtatgcttatttgattgttagccaactattggctccaattcatttatagctaatctaatagccaattaatataatagttagctataaaaatatactacatcattaatattcagtcctacctctcattcacatataacgtcttagagtccgtgttgcagctggctacaaatatgtaacccgctttcttctctctcttctcttttcttctcgatatgaggttatagatggcttatagcatgctattgtacctgctctaatgtgcaatgcatctccatgaatatttgtttgtatttaagtccttgtgtaatgctcaactcctgccaacaaatcttacaaagttttacatcaaggaccttggagtaaaacaatatattatatatacacccttgggcccacctgtcaacctctcaccctatattaagtaaggaaaaaaaaacctcctcttccctccacccgtccgcatcccaaattcccagcaccagcagcgcccgccgccgccgccgccgtcgccgtgccgagctctcctcctccgcc

SEQ ID NO: 12984 - DNA, 1501 bp, Oryza sativa
ggagccaatagttggctaacaatcaaataagcatacgagaatgactaattttcgtcttaccctcttcttattctagaccagcttctcaacaatgtgttcgtggaaaataatatataaattttcgcataataacttgttaaatatctgattgattttgtaggagagccataaaaagatcaaactatttatttaatccatcaattttaactatctcaaataaacatgaattattgttatttatgatgcaggtaaaatgaaccctgaattttccacacgagcatctgctgaatgctgatagttatgtactccaccttcctactggtaacagtctccattgatggattcttgatccgaactgatcgtgatggatcggccattgctggcattccgaaatctcacaattcacaagaaaaaaatgtctcgctattcagggaattttttgcatcacagattcagagtttcagacagcacggaagattttgcaggcggcgttggtgcccgttgggcgacctacctcccaactgcaatccttaactccttccctgacgcagcctccatgcatcgtaccgacatctttctctgaagaaccatgtccatacaccacctcaagtttttttactgacatgactggccctatcaattactagtaaccactgctttcagagtgttattgcaagttcttaagcagatgatcaacacaaatgatggtgtattatgataagaatggtgatcctaattcctaattcctagtagcatttcctgcacgaagttcctgcttttatgttgttcttttttaggtcttgcttagttccaaagttttttttttacaaactttcaacttgtcatcacatcaaatctttcatacacataacttttctatcacatcgtaccaatttcaaccaaattttcaaactttagtgtgaactaggcgtggaggaggtaattacagagtctcaccgatggtacaaagagcgtgtgcttcaggaatgcgtgccacactctttgcacattttggtcagcacatgtatccatgtggaagaatatatgcctagttgtgaacttgtgattgaacaatcaatttagactaaacgaacgatcatgctattgtgatcaggaagatatccaaatctgttaaagaaaacaagagatttacgcaaatctcagtcatgactagcacgatctagatacgcaaaaccccaaatttcgacaaaaccgaaagcaatcggtgatcaaacggtgtgtttttgcacactgaattttacttttgggggtccatggaccgggtccatacaatcaagagggccggatacgtcgcataactccggtgggtccaacggcccagcggcccgtgggccccacaccttcttgcccccgcgggatcaaatacacctcctccggccactccccgatccccacctcgtctccaccgcacgagcagcagcagcagcagcggcggccgcagcgcgagctctctctctctctctcgcggtgggcggcggga

SEQ ID NO: 12985 - DNA, 1369 bp, Oryza sativa
cctccggaagaatgttcttgacaagtttcaataaatcgccaaatgccttatcactaacaccattttttgccttccattgcaagaactccagagtggtatccaactttttgtgcccctgctcgcaacctgggtacaacgacgttctgtggtcctctaacatcttgtccaatttatgggcccccttttcactttcgcaatcctccttgctgtcctgcaacatctgaccaagatcatccgcaacgttgttaccatcagcatccctttcctccttgcccgtttgatttccttcaaatccagcgtactgagcaaagttcggaatattgttgtcttccacttcatcttcttccatttcaacaccttgctctccgtaggatgtccaacaattatagcttggcatgaaccccgactcaaacaagtggaaataaatagtcctggatgcagaatactccttccgattcttacacttattgcatggacaacaaataaaacccttttgcctgttagcttcggccactctcaaaaaataatgcacgccgtcaataaactctttggaccgccagtcagcgtatatccattgccgatccatctacatgacatgaaaaaaaatcgtacacacataattattcgtacaataatgacagtcatacaataattataaaataattacaaactctttcaacagtaacacaataatgacatatcattattcatacaaaattatgaaatattacaccgaataattatatatttactatttataaagttttaaactaatattaatgtgttgtacttattttaatttttcattttactttgttttctattattcaagattaactttcactatattttccttctcaactattttataaaaccttctttaacaaataaactaaatttctatatattctttcttctccacacaaattttctctctcatcaactaacaataaaattttgaagacaaaaaagtgtgcaaaacatgatccaaatgtaatatgaaaaaaataaaacattggaggatgaagttgctaaccttttaggcacctccgatttatatataatcaccaaaataaattcaatagaaattttggcatgacctcccctcttttttgaagaaattttgaagcttactcgggctggaggaggacgaagacatatatatatatataggggtgggattttagtcccggttggtgttatgaaccggggctaaagatcgctgggatctttagtccgactaatgttacgataccaaccgggactaaatatcccgggagggcctgacaggccctgacagcatttaaaccaggactaaagatctttagtcccggttggtgatgcccgttaccctttttaaccggggatc

SEQ ID NO: 12986 - DNA, 1501 bp, Oryza sativa
atatatatatttatatatgtacacatttacttttgtgttaatatatattttggtaacatatatatatgcacataaaatgttaagtgctttaaattatacatatgtgtgtgtaatatatgatttatacacacacacacacatatatatatatatatatataaaatcaaccatgcagcaaacagggccatgcaaataaaaaaaaatggtgcaccaatctttagtcccagttggtaacacaaaccgggactaaagatggtttggccggccacgtggctaatcgatctttagtcccggttggtaacacaaaccgggactaaagatcgatctttagtcccggttatttcacccgggactaaagataactatctttagtcccggattcgtagtctcggttggacaaccgggactaaaggggggttaccaaccgggactacaaacggtttctccaccagtgggaagtgcttggtgtacacggtgccgacgactccggggatcccggacaaggcctcgaacatggacgcggaggcggcgtgggagtccggccaccggacaaccctggtgaggaggacggtggtgatggcggcgcagacctggacgatgatgttgtggcaggtagagatgccgaggccgaagcggcgggacacctcgcggagtgggtcgccggtggcgaggcgccagatgcagacggtgacgcgctggggcacagggatggcggtgcgcagcgtggtgtcctccttggtgacagcggcagccaggtcgtcgcagagcttgtcgaacaccgcgcgcggcatgcggaaggctcgccggaagtccgcctccgggcacgccaccgggtccctcatgcggtcccaccattccgtgctccgctcccgcacccacacccgccggccacctggcctttccgccgtcggctcactcccctcgccgccgctgccatcgcagttggacagtgagctcgaattccttggcgccttcttcctcctcttagatgaccgggacacgacacccatggcctcgccgtcgtcggcatggaaactccgcttcccactggcatctcctccgcctgccaccacctccaccgacaccggcggctggtcagcaagaaagtcaccgtccatgaggaggaagtcgtcagcggcgagcatggatgtgtactcaaaatcagcatcatcggggatctcaaagagaggagtggagaagggctcgagctcgaggaaggcgttcatggcgatgggagaatactcaacattcaacaacgagtgattgtgtgggcaaatggccagctgatgatcaggcctttatatatacgtattgggttgtgtaaactgaggcagaatctgagacggagggaatagttgggttattgtatgtcatctaactgcttatgaaattttttttttaaaaaaaataacaagatagattaatatatgataggccactccacaaatatgcaagttaaaatttaactcttacaagttaaaaagaattaaattatgactag

SEQ ID NO: 12987 - DNA, 1501 bp, Oryza sativa
ggtgggtcttaccgagatttagtcaattactattaggtatgtggtatccataaccctaacagtatcccccaacttcaatgcaaatgagcgagttcatattcccaaccgcagaccttgtaggaactgttatcgagctctcgtgaccgttctcggtgagttcagagataatgttagacttcctttatcagcctcgtgcgggcacctaaagggttcgtctgagtcaatctccgatgtcaaccaagaaagtataggacatgcgactaagtctcccgtcttgctgtaatcgagaatttggattgaagtcaaggaaattttatctcggcgggtacaccatttcttcattccgtattccttgtcgatatccaccaaccgttcttgagtgatcgagaaggcgcagagtctgcgacggagccttgtcaacatttgtcgtactcgccttagtcgatcttggtgtagaaccatagagacatggagtctttgataatgccgaatagaattttctaaaaccaatactcaaaaaagaatattagatagaaatagcccccgagcgagtgctcaaagggtaacatgttatagaatgtatgaaaaactgaaaatgaattaggtttacaaaccaatgttttgtatatgagcatctactcttttaccgacttcgatcagtcaatttgtttagttatacactctccctagcccccacccttgtcgtcgtagaatcgttctcggaggataaggctcttggacctttgacctacctcggttgaacaagcactgatcctagcccccagccgtgaggttggaaaatccatttccgattacacggcttggttaatacgcacggcaagaactcttacacgaccagatcttacatggtctttcgtctctaaaggatccgacaagaccttatccgctctagacttccccagccgaagttcccttaggttcctcagaggctttgtcaagacggtgtaaagggacattaggataggtttcaacgctaggtgtcttttgtggtaagggatctctgggtaaaacacttggagatattgtgtacctgatatcaactttgttgaagtagaggtaatgggagaatcgctacacctctggtcaagaaccaggtagtagtcgtaactcaaccactagaaataaatatacgagagatcgctacgattgactggttgagaaccagtgagtaggtgtctctcgatcatttgaagttgtcgtgcgaggactgctgcgttattactgtagtcgtacctcgaccatctaaggttgcggtgcgagagattgctacgtactggttcgaggaccagcgaacgtgtagaatcatctctcgaacaccaatggaggttgcggtgcgagagattgctatgtactggttcgagaaccagcgagcgagtagaatcatctctcgaacaccaatggaagttgcggtgtgggagattgctacgtactggttcgagaaccagcgagcgagtacaatcatctctcgaacaccaatgga

SEQ ID NO: 12988 - DNA, 1501 bp, Oryza sativa
accatgtaaaaattggtacggtggaattggcgttttgaaaggtggtaggggtactaagcagattgcacattaattaagttgatgcaacaccggtgcgatttggtcgtccaacaaatattcagtagctagtgctgctgcagtcgtagtagtatcaagcaagtgaacggtaaacccgttgttacaaggggtgagtgagtttgatccgtacgtacgtacgtgtagggtgctcgcagccacaggattgcacgggttgcgcgtctgccgccgggtggaccaccggattccaaatgtacggcgatcccacaagttggagtagtacaggtacgcccggtaattcggccggcggccggagcgtacgtgccgcaagatacggtgaaaaaccgtcgatgtcattttaaaccatattattcttttattcttttgataaacttataaaaatgtatatatatttatttagtctttttaccaaactctgatagacacatgagaaatcttatcaaaacttgatgatgttattaaaatttgatacggagtaagatttattttagctaccatatatttctggtcgttgttttctggttgctgtggccactaccgtatacgcatgtagccgtattataataggagtatagaaaaaagaaatggtcacctagctagcaactcgtcttttacagaaggatcctgggcggaatctttttgaagtttggttgtggacacgtacggcgacagcaagcttacgtacccgtacctgcatactcatacagatgacaggcgagcgatgagagagaaaaaggaatcttctcgggggtgacgtcaggtgacgtcatggtccgtttttattcccctccccggttggcgcgccggagcaggagcaggcgacccaccggaccccatccattagcccattggagattaatcaactctccaattcaaaacagggcgcccaagggcaccaccgccatttcgccgtgttaagtacggcccctcaaactctcaaacaacattttgaagcggaggagttagcatgattagttttttttttcgaattaaattaagatatgtgtcgccttatgtgggacaaattattcaatacaaaacaaatttttttaatcttgtcagggttatagctaccacataccaaatagcagttgactaaatctcggcatgacccatcacataacatgtcctatacggaaacaacctgcggatataggaggagttccggataaggaaagacaaccagagctgtacatggaaacgacaagaactactcggattgtatccatattggtttccctagttctatttggacaagaggatacctatgggtataaatacaagaccccctaggaggagaggggacaatcaacatacacggaacaacagaagccacaacatacaagccaacatatgccaagacaagccgccggatatcgacttcagagatatgcctggatcgaccctatccgatacctacagaggccggccgtagggatctagc

SEQ ID NO: 12989 - DNA, 1501 bp, Oryza sativa
ggatttagggtataaatataagaggttttgatgtactactttctcaatacacctgaccattatatttattaccattatttactctaataaatagtaacacttcaataaatatcactcaagattgtaattgctcttatctccttgaccaaggttttttttattgtttcgctaataatttgtagtacacaaattaataaggtaataataaacgtttcttgagtgacaaatactacaggttttacaacatcgggccaatacattttaagtgtcatttcaaattatctttttactgcactaaattttctagatgtgtttgctacagctagctcgctccgcccggtgccgtgtggcgagaaggagaaagagaagagatgaaggagaggagaaaatgagaatgagaatgacatgtggatctacatgagctccactattcttttattatttttagtgtaactgacctatgggtctactatttttatatatttttggactgaattgccacgtaggtgtcatgtcaatgccatatggaacaaagaactagtcaaaatagcaacgtagatgtcacatcagttaaaactgagaaaaatgccgccgagagacctaattttcactagttttgtaagctgggaaatacattatatctagttttataattcaaggacgaatttgaaattcggtgacaagatgaggtgcctccggtgtactttttacctcggatcgcaaaagtgacccatgtttttggtgggcctttgtgggctttccaaaagcctgtctcaagcgagcccaactttggtgggccgaattgtgtttagggaagttgtgcggcccatcacggattggcccattatactgcaactaggccattcagagcttcggatccatggccggcgagcccagctctacgccggcggcggcgacggcgaggaccacgtgacgtgcggatcagctcggaggcaacggcgatccatctcttctctcccccctcacgattcagaggctcaaccgagcggcgaacgggagcgctcgacggcgaggtgcgcgcacgcgaatccagttcccctagaggtcgcaactacgcctccacagtgttcctaattttcttgatttttctgtcacctactagtttgttgatctgcttaatttgtttgtcacatgctagtttttttgcaactatcggtgcttatcgatttagcgattcttggagacttggtatctttttgtgttgactcgctggtgttaggagtgatgctctctagctgctcgatgaaatgcctgataaaagcatcctgtcatgccatgccaatacatctatcaacatttattctcacgatttgttcttctttgctaatgtacctatcaccatcgatttgcatgcagtaggaccatcggatatattagattaatggtgaatggcgtaatgattttattttacaaagtattgaacaagattgcgagtggcttgatgagttcattattctttccgatttcttctgggtttcta

SEQ ID NO: 12990 - DNA, 1501 bp, Oryza sativa
caccaatggaggtttgtggtgcgggagattgctacgtacttgttcgagaaccagcgagcgagtagaatcatctctcgaacaccaatggaagttgcggtgtgggagattgctacgtactggttcgagaaccagcgagcgagtagaatcatctctcgaacaacaatgaaagcgctagagttggtttattacatgtgtatctcatgtggccagcatgactcacacacccaacttgtagcatatccagatgtccgtttgcaatcatgtcgtgtgattaagccgacaacgttcacgaggaattatccgttaacaaccttttctcaaatagtctagccacggccggtgctattagataggtcgtcggtcttcgttggtagattgggggaaacaactctgcatttgtcgagatcattctcgataatgcggtgtacttgaccacaacctactcgagtgctcaattgttcctgaaaaatattttctagaagacaagatatatagcagataatatcgaatatgtactcaaaaaaactgcatggatcttctagcattatcaggatataacgagcagattaaatatcagggcattatgtaaactgtaaacaagcatgatttatacagaagaagatagagcgagccccagcgttagatcgtagtcgatttaacatcggggacacccgcgcaacagatattgtataaaaaaatatgctctaggtaaacataataaattatagatctgataatatcgtatagatcggaaaagtaggtatggtaaattgtgtataaaatattgcgtacctttgcagatatatgccggatgtatctacggaattagtagaccaatttaaaaattaatcttactaattaccttgggagacatggagtatgtgtcatcaaaatacatataggagctctgttcggccaatatacatgcacgtgcgcacatgggtgttggctcggtaaagggacatgcagggtgacgtcaggctgtcgaccagtagatcgtggctagaaatcgtgtcctagttagaacacggtagtactaatccagcggtagatttttggctcctcgacgtgcttggttggttggtagggatcggtgtcgggttcgacttggactcagccggccgataccttgcaccagttgatgtcgcacacgtcgagaatttaatgttggatcatgccgacaccatgccgacaccatggcaacacgtcgaagcttggttgatctcgagagatcaaataattggtgactatggttccgctcttgtcgaaagacatattccggtcaggttagatctccccatagccaaagtcgtcgagtagcttattgttggagaatctatctcttaaacccatctcattgaaatcctgaagcaccaaaatcctcctacctggtacgccactgtcgacatttgatgtcgcgattctggtatttacatggtatggggatcgttggtactagggtatacgcgagactgaggtaaaagagatggagacggagatt

SEQ ID NO: 12991 - DNA, 1501 bp, Oryza sativa
gagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacaattgattacatgcaaaatttgcccatcaaaacatatattttgaagctagattttgcaaaaaatagttggaacaaaccttgtcaaaatattaaaaaaactccactttccaccaacgaaatataacaaaaatggagccaaatgaagcaagatagagagttcttcacctttcgtatagagttcaagtaaaaatttcgagttgaaaacctccccccctaattggtgcttgctttaggagagagaaagcttcgttttcaaatggtcaagctcgggcctg

SEQ ID NO: 12992 - DNA, 1501 bp, Oryza sativa
atgtccagatatgtggcctgggaaaatgttgaccaaaaccaatcaggaatcttgcccattagacctgtgcttgaaatatcaaattcgatgattttgtgctgccactgaagccaagatggaaacagaggcccaatttgacaagatgcaagccatgcagactccagcctgaagggtggaagccaatctgaatccattgaaaacttcaaataattggaagacaggtctatgttcttcaagcttatcagacctgcaaagtgttcttccctgataacaccactgaaagtgttattgcgtaggaccaaagaagtcagattagtaagcacaccaatctcagcaggtatgcttccacttaggcgattgctggagaggtcaaggctggctaagcttaacaaatgcataacctctgttggtagatgtccagaaatatcattataagagagatcaaggctaactaaagacgtcaagtctccaatccctggtgatatacttccaataaggttgttagaggagatgtcaagcatgcgcaagctcgtgaatcttcgtatcgaatttggcaaggctccagtgaaattgttgtaactcaaatgcaactccagtaattttttccttgcagcacactgtgacgacaaaccgtcaatcaacattgtcatatctccagttatctccatgttggtgagatctagtatttccaaactgcatagattgttcagctctcctgccatcactagtccttgttcagattgttgtatgaaacatcaaggacttggagagatgtcatgcttcctagttgttgtggaaattttccaaccaacccattgtaggatagatcaagcatctcaagttttgtgagattgagatgacaagtgactggtttgcattttatatagtagcggtaaattatgaagtttactacattgtttagcaaattataattaacatgagcatccttttagactaaaattgataacaacaattaacccacacatttaattaacatgtgattaaaattttaatattcacaataacaaatatataataatgtcccgtgcaatttgatcacggctgattatcagttaataaagttctactagcacataaaaatgccatattcaatgaaaaaggggaaggtgaaaagtataaaaaaaaaatttcatttactcccaaaaaaaatgtcaccagtgatcttaattctatttattaaataaagacgcatgtaggaggaaatacatcaatataaaatgtacgcatacagatcacgtcccgcttgttttagtgccatctgatcaatgacactttcacgtacaaccatatgaccttggtacgtggcaacattggcaacgatgtgatgtttcactttctagctgaaaaaaaaaatacacgccattcatatatgttggccagtggccacttagcttcgaccaccaagtggagatgatgttcatcagttcatcactacaccgaggtatcatagcattaaagaactttatgaccaaccattttg

SEQ ID NO: 12993 - DNA, 1501 bp, Oryza sativa; identical to SEQ ID NO: 12472

SEQ ID NO: 12994 - DNA, 1501 bp, Oryza sativa
atatatttgcatcttttaggagacgtagtacgtacgttccattcttgccttgaaccgataagattccaagttccatacacaggacgaccatatatttgtacggaaaaagttacaagctggagtactagctagtacagtaattggcaaggatgcatgaatgtgtgtacactgtgcgtatgacttgaggtgggtacgagaaataatggtcgtctaaacagtagaactgtgtgatatactatcgttgaaatatctttaattctttcttctacaagtaagtgaattttatctattgcgtgtaacaactcctactgttagtattccgaaaaaaaaaatcttgggagaagtattttaagctatattaaatcaagaatgtgtgtcgtgcgcgccctcgtttcatgtatgaaatctaaatagttataagctaacaagatttggccatatagattatgccgtcacatgcatgtattactgtacagacatccacgaccaaattcatttacatcaaagaaaaaacaaacctaattaactatgaaattaaagtagtgtgtgtgtgtatttcccgcagttatattttttcccacttgttcaaattaagtttgaacatacatatttgtagggtaactatatgacaacccaatatacgttattaatgttttattgattatgtaagcgacacgcaaaaggagggcaatgaccttcttattttagaatgacctttaaaggctcaaaatatgtacaacttctaccaaggtgcagataaatgcctagcgaccccgggtagctcctaggccacccagggttgtcaatgaatcacatttttataatgtcttgtatttgaagtgttcaataacattgatatataattgttcgtacttgtgtttgcatgtactttaaaaaattataaatcttttttttagaaaaaaaatctaaatctaccagtgattctacatgttttcaagtgtggggttgactaaaacctgttcgtttcatcacttgacttctatcacactcaattgaagctcgagatcccagaaactcatgtcaatcagggatgaaaacgaggaaaagagtaggcagattgatatagcatggcgtcaccgatatatataggttcttaattaatatatatggtgcaagaagcttccaaggagaaagggctgggaaaagaaattctactactagctagtactagtagtagacatattggacatcgccatggtagagagcagtagcacacgcacacgccaactcgcccggagacatgagaagactttgtaaaaagctcattttccaaggaaccaaagggtgatccaacaagaatatatatggatgaaaaaacacatgcaaaactacaaaagcctacacatatatatagggctaggcccccattgcatcaaaattattgatgctaagaactctgcatgcagaggtcatgccatgaagccagagaggaaaatgctcgagttgtgaaagataggggtgaacacttgctgctattctg

SEQ ID NO: 12995 - DNA, 1501 bp, Oryza sativa
cccatctctcccatttcccaaaattactcccacttgatcacgcatgtcatatttgtttgtggctttctaacattgtcaagggatttccaagttcccatctctcccatttccctattatttacttttcttctttagcaaaattactcccacttgatcatgcatgtcatatttgtgtggctttctaacattgtcaagggaattaggatgatgtgacttgtttaattaccttgtcgaatttcgtcctattcagtattcacaatgattctcgctcactttctctgactttttagcatgctgacctgagtattgactactgtcgatcactgcatctcatgtggaaaaagaaaaaagtttatcttgttgcttgtaactcctctttttcttttaatgcatgaatctgggagcagctgcactttgtaaagatactttgaatttttgggggtatttggggacataacaaagatagtatcattaatatggtggcaaagactatgtaatattatgtgctgtaccgccgttgcctgaaagattataaaccatgttgtaattcaggtcattcaatgtggcagatgtagtatcttcgattgtatggcaatgatggatttccctctttctatttattatagtatttgcctggtcattctactttcttatctgttttgcacttgattttgtgccttgggcctccatcactctttagatttgtattagcctatgataataataatactaaagctataactgcaccttgcattgcagctttagccatgatgagaaagaaaaaaactgaaccccgtaatgctggggaaagttctggaactcaacaagccactggagctcctggacggggtccttcacagcgacctgagagagctcaacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactggcccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtaagatcttgtttatgtgttgccttgttatacttatacatatgaagctttgtaacttttgt

SEQ ID NO: 12996 - DNA, 1501 bp, Oryza sativa
ttgcaaaaatgatttttcagtgatgtccgcaaccatcatgcctcaccgatcgagaggaatgatcgcacgtgaaccgccagtactcgtgttcagttcacgcacacacgaaatatctacgagagaaccgcgtcaaagtaagaaggcccccaaggcaataattgactatggaaaacaacatcactagattatttcctgtataacaatgccatgtactaattctataatgctcttgaaattaaggtcaccgttaaattggattaatatatgcacacgtacgtggcccttgatccggattacagccggccggcccatgtctaattgtccatcattgccgacgatatatactactcccgtaaaacgacacaaggttttttttcaaagggttgagttgaatcgaaggccgtgatgcgtgacgccatacgcgacgacggcggcgcggcaggcgtagatagctagcgagcaagcaggaagaatccatggttacgtgcggtacgcgtgccattaatttgacggttgagaactccatccggtctcctgtttgatcgatcgtcggtcgagcatttattatttcttgtaccaatctgcgcacgtacgtacgtaggctgaggcatgcatctatatatggctcgtgcgcatatatacagcacctacaaaggtgacaatcgtacgtgcgtatgtgcgggtggaccttagtcaaacagtgaactcagcatatatatatgcacaagaatttttcccttgcttgatttgtttatacgtacaagctagtgtgtacacgccgcaacacatgcacaattgcacaaacacaaataaagaaataacatacgttggcatatagtataagtcaagttttgatataagctattagtaaatatttatgcttgaaacatttttttctactattatctcgcagtagcactaacagagccaagagcactaaaaaataaggcaacaagtagattctactgaataatgattatgttcaaggtaaattatttcagcggtggaccatgatatatgctacctaagtatttagttcgatcgggtggcctcccacctacctatgaggtgtgcctctactattgtgtttgttatcttttgtggagatagaaaaacatatatatggattgtcgacctagttgtgttggtcgtataggaactatttatattgcgttgagaagtgttcttaattttagtagtcttcctcacctacctgacattaagtacaacctccaaaatctttttatatttgtacacaacataatctctttacatttttttcccaacgtgcactccgtctgccttgctaatgttgggccaccagttgacgcctttgaaacatcaccttcctcactttcacttccatctacctcaaacccctccatgcaatctgcctctccggcccgttcccctctatgcttgatcatctttgtcgatcgagcctttcgtcacattgcaccttcctaatctccatcattttttaggaaataagcgtcatcat

SEQ ID NO: 12997 - DNA, 1501 bp, Oryza sativa
agcttgttgagcatattgaggattggcaggttgccaaccaccacctccatgctgttgagctctctcaggtcgctgtgaaggaccccgtccaggagctccagtggcttgttgagttccagaactttccccagcattacggggttcagtttttttctttctcatcatggctaaagctgcaatgcaaggtgcagttatagctttagtattattattatcataggctaatacaaatctaaagagtgatggaggcccaaggcacaaaatcaagtgcaaaacagataagaaagtagaatgaccaggcaaatactataataaatagaaagagggaaatccatcattgccatacaatcgaagatactacatctgccacattgaatgacctgaattacaacatggtttataatctttcaggcaacggcggtacagcacataatattacatagtctttgccaccatattaatgatactatctttgttatgtccccaaatacccccaaaaattcaaagtatctttacaaagtgcagctgctcccagattcatgcattaaaagaaaaagaggagttacaagcaacaagataaacttttttctttttccacatgagatgcagtgatcgacagtagtcaatactcaggtcagcatgctaaaaagtcagagaaagtgagcgagaatcattgtgaatactgaataggacgaaattcgacaaggtaattaaacaagtcacatcatcctaattcccttgacaatgttagaaagccacacaaatatgacatgcatgatcaagtgggagtaattttgctaaagaagaaaagtaaataatagggaaatgggagagatgggaacttggaaatcccttgacaatgttagaaagccacaaacaaatatgacatgcgtgatcaagtgggagtaattttgggaaatgggagagatgggaacttggaaatgaaatggaagtttgatgagcaatgtagtggaagtaattttgctgaggaagaaaagtaaataatagggaaatgcaaaagaaaagaaaaataaatgggtgcagcatcatcttgcatcttaagtactcattaggttttccactttcagaccacgccagcatcatcttgcctgtaagtactatgtttatacaaagtattaggttttccactttcagaccacgccagcatcatcttgcatgtaagtactatgtttatacaaagtattaggttttccattttcagaccacgccagcatcatcttgtatcttgcatctttaacttaagtactatgtttatatatatcggatggattgcatatatggttgcttatccagcatcatctttctttgcatcctaaatactatgtttaacgaagtatatatcggatggattgcatatatggttgcttatccagcatcatctttgcatcctaaatactatgtttaacgaaggattaggtatatatcagaaggattgcattgattaggttcttttccaaataaatactatgtttaacgaagg

SEQ ID NO: 12998 - DNA, 1501 bp, Oryza sativa
ataggatgaacataacctatatttattaaggtgggaaaaaaaaagaaaaagccatgacgacagcaaattaatatcattccgcggcgagctacagccacaaacaattgtcatctacatactcaactgtagcaacacttgaaccgcgataaagaccctccaacaataacgcctctagctaaaaagctactccctcagtcccaagcatcccaatgcaaaattattggagagtgaaaatgatcaaaatgctcctcattattgaaaaaagtagtaatgatgataggtaggtaaaaactattgaaggaataaaacttattcttttacgtgctgacggtaggtagatggtagaagttggttttttgtgggacaaagttcaaagcctagaagttaagttttttttggacggagagagtaagaaggaacgacagtcgcacgagccggtgcaaacaggtgcactagatatctataatagttttattcaaggcagacaaaatttgccaaacttgagatttgataaatttcatgttcatgatgttcgcaaactacatgagatcgtgttttgcactttatatgcaccatgatgcaatattgtttgttgaacattcatcaggatcgcacggtagaatcagtatactccatccgtccaaaaaaaaaaaaactaacctcgtacgtactaggatataacacatcatagtacaataaatgtagacattactctatatctagaaggagtagattagaaggcaccaaagatgtctaataaaatatgacataaatatataatatactgccagttaatagatgcacgcaggcgcagactgaattttcagtgtccaatgaaaacgggatgaacttcctagtgatagattagaattacctgtggttaccttttccagaggcgccgcgaacatcatttgtgtcttgctcctgtaacctatgacggctaatgtatgtatgtcggcaaacccgctagcagcatataaaaacccgtttactagttcattttctatctagtactatatatttagttcattttctatctagtactatatgttgtgtacatttgccttgggtgcagagattggtttaatccattattaaaaaaaaatctgctactatatatctatctatcttctattatatactaaaagtccattaaacttcctacaaacgctcctaaaccaccatgtgtcactcttacaaacgctcataagccgccaagtggcactctaaaatacaaccgttgatttttctttaaattagtgggtccaatattttcaaccattagatttagtaataaaaataaataaaatccccctcttcacggtaccggtccccacctccctcctcgctggtatgttaccctcctccaattagttcatacacgctcctaaaccgccatgtgtcactcctacaaacgctcataagccgtcaagtggcactctaaaatacaaccgttgatttttctttaaattggtgggtccaatattttcaaccattagat

SEQ ID NO: 12999 - DNA, 1501 bp, Oryza sativa
ttgtacaagttaaattatagtcaacgggtgcattaaattctaatttatgattttaatcataaatagcataattacacaaatataacgtataatttggtctgatagaaaaaaatttcataaagaaaaaaaggaagaggggacatctccttttcaaaaagagaaaaaaatcaatcttatcctgcggcttggagtggtgggcctattaattttagtaaaaattaaaaggctagttatttcttttttctcatcttttctaagattttatctaatttattaaagcgccacgtagtatcataggagtatttatatgagcgtcatgtggtggcttagaagtgtttataggaagtttaatggacttttattatataatagatagatagattgattgattgatattgtcgatataattcagcgacacatgtttgtagaattatttaaggtgacatagtatatgttgtcaacttttttatattttaaaaatatttcattgttatatttggttgccatgtaaaaaaatagcccatagaacaacatagatcttgaattatttatttaattataaataaaacaacaacaaaaataagccatgtaactattgaaattggaagattaggaaaaggtagagaatatgagaggagggagtacgtaacgtacgtactaattggaggagggtaacataccagcgaggaggggaggttgggaccggtaccgtgaagagggggattttatttatttttattactaaggccctgtttgattcatcttaagattattataatctagcttattaggagtaagctgaaataaacaagtagattattatagcagattattgtaatctataagccagattattataatctaataagctgctctaaaagagcttttttcagattatcgagtggctaaagacccactactcctacatacttgagaaaaattacccacctatgccatcaaccgaacagatagctgggggcattatagactttagcctttcaaacccaataatccatgcctccaataatccagacaaacaaacaactcacagcttattctatatcagcttattataatccagcttatagcaatctggtttaataatctagattataataatcataagctgaaacaaacagggcctaaatctaatggttgaaaatattggacccaccaatttaaagaaaaatcaacggttgtattttagagtgccacttgacggcttatgagcgtttgtaggagtgacacatggcggtttaggagcgtgtatgaactaattggaggagggtaacataccagcgaggagggaggtggggaccggtaccgtgaagagggggattttatttatttttattactaaatctaatggttgaaaatattggacccactaatttaaagaaaaatcaacggttgtattttagagtgccacttggcggcttatgagcgtttgtaagagtgacacatggtggtttaggagcgtttgtaggaagtttaatggact

SEQ ID NO: 13000 - DNA, 1501 bp, Oryza sativa; identical to SEQ ID NO: 12998

SEQ ID NO: 13001 - DNA, 1501 bp, Oryza sativa
atagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgcccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccagacaccacccaagtcctccagccgccccagtcgaaaacagttgttttactttattttcctttcacaaattatgtcgtcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcataattgcatgcaattttatttgtaaacaaaacaatttcgcaattgggatcaacatgttcaaagaatagtgatgacttgccttgctcaaagtcttgcgggtcttggccttcgcttggatccgcaactccctcgggctctatagttacgtgcaagaattgatttgaattcggttagaattcaaataaaaatccaaataaatccaaataaaagtcacatgcgaaagtcgattcctttttattaattttactatctgcgaactatgacaaacccaatttcgatttaaactattttgcgggtataaatgttttattgtcacaaatttttaatttaatctacctgagcattatatccatataataggttagagatttctagcgcgagctaactatctgacaaaatcctagaaacattatatgatttaatttagtctatgactaaacgattaaatatattacacggctataatccctagtaactaaatccgaattttctaccgttaattgattacttatagggattacccaaaataatctataataattaccgcgaattgatctaaattattaccgcgaattgatctcctatagacattactaaaaataatctataacaatctattaagattcatctaattgttttaattcgtaaataattagttctataatcaaatcttagtactttag

SEQ ID NO: 13002 - DNA, 1501 bp, Oryza sativa
atagatttggtttactcacactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgcccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccagacaccacccaagtcctccagccgccccagtcgaaaacagttgttttactttattttcctttcacaaattatgtcgtcaatatcatggcaatgtggcgctcatgtctccacatgccgcatctcaattaccttcccaaaggtaattgcccaagcatatagcatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcataattgcatgcaattttatttgtaaacaaaacaatttcgcaattgggatcaacatgttcaaagaatagtgatgacttgccttgctcaaagtcttgcgggtcttggccttcgcttggatccgcaactccctcgggctctatagttacgtgcaagaattgatttgaattcggttagaattcaaataaaaatccaaataaatccaaataaaagtcacatgcgaaagtcgattcctttttattaattttactatctgtgaactatgacaaacccaatttcgatttaaactattttgcgggtataaatgttttattgtcacaaatttttaatttaatctacctgagcattatatccatataataggttagagatttctagcgcgagctaactatctgacaaaatcctagaaacattatatgatttaatttagtctatgactaaacgattaaatatattacacggctataatccctagtaactaaatccgaattttctaccgttaattgattacttatagggattacccaaaataatctataataattaccgcgaattgatctaaattattaccgcgaattgatctcctatagacattactaaaaataatctataacaatctattaagattcatctaattgttttaattcgtaaataattagttctataatcaaatcttagtactttag

SEQ ID NO: 13003 - DNA, 1501 bp, Oryza sativa
  unsure (1)..(1501): unsure at all n locations
aaagacactattcattagcctctaggtgttcgacgaggttccctagccccttcccctcccctgccatgcgcgcctcgcgccgctcggccgtcgccgtcgcgcctcgcgcctcgtcccgccgcgcgccattgccgtcgccatcgccgcgccgcgtagccgtcgcgtcgccgctgctgccgtcgcgtcatctcgagccccgcgccgccggtgacgcgctgacgccgcctcgcgccgcgcaccactgccgcgcccgcgcccgaacctcgcgccgcgcgccgncgctgcccgcccgtcgcgtcgcccgtcacgtcgcccgtcccgtcgccgctcgtccgtcgccgttgcgccttgcgccccgcgccgntgtcgtntgncgnaccacgcgccgcgcgccgtnngccgtcgggttgcccgtcccgtcgccgctcgtccatcgccgtcgcgtcgctcgtccgtcgccgtcgtcgctcgtccgcgcgccgcacgccgtcgcccgtcgcgtcccgccccgagccccgtgccgcgcgcccccaccccgagccccgcgccgccgtcacgtcttcccctccccttatctctttcccttcccctatataagccccgctattcccctcttctcctccgtctccaccccctcatctctaccactcctccacgccatcgcgccgccgtctccacgccgccacgccgtcgcttaaagccgccgcgcccccgccacgaagccgccgcgccgcgccttgcgccaacaccgccaccgtcgctgtcgccgccgttgccgtcgccgtcgtcggtaagccgccgcccaacctttccccccctcgcgtccatcgtcgccgccgcccgggagagcaagagccgagagagagagatagagccgggagagggagaggaaaagagtgccgagagggagaggaaggaaagaaaaaggaagagagaaaaagaaagaaaggaaagaaaagaaaaggaaaagagagaaaaagagaaaaaagaaaagaaagagaaaagagaaaaaggaaaaatttaagagatttagaatatttaacatattagaaattaattataggattaatgagaataccgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaatcaattaacggtagaaaattcggatttagttactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgca

SEQ ID NO: 13004 - DNA, 1501 bp, Oryza sativa
cttaaaacttctctgaagaaataaacagtaggttaagtcataggacatcttacagatacattatctactctgttttttttttggggggggtggggggtgcgaatatgcagttctcattgtttcaagaagaggaggttttgcatgtgcctcagcatttttacactcttctactaccatgctcacatcggctattgggcatttcttatgcttgtcagaatcatcaccagatatacattatatgctcgtaatctaaatgtaatttcgttctcttttttatgtcaggttgtggccggttgcatcattggaatccttatagctgttgttatgcgcttagctctatggagttcttagacacgcattactcgtaggtatttgcttgatcacctcatatcgcatcgctgatgagttgtgaagcatgaaaactcaaatctcctcttggatgtgatttgtacaaatgctcagttttatgactatactataaggttcctaaccggtgtaggtctgcgttgtaggaggtagattgtagttcagttggtgctgtacatcgtagaaatttactgtgaattggaagctcatgtgatcaacctttgttatacaactggcaatgatcatgctgtcaacttttctttctggcacgcagtgatattttaagttctgcatcactgtccttagtttattattttactgtgctgtgcttgttagacctagaatgttactaccatacaaatgtcccaaaatttggtcctgggcagtactcagtagtgtgtgtgcctatgctgttttactgtcattcatagttcagactaatctgttttcctctgaatcctgaaatgcaagaactttttgttatttcctctcggtgaacctgatatatttgatatttcagaatttctagtgcaaacaaacaggaattgttctctgtttctctcttacacagatcacagatcaaacaaaaatattttcttaataagtatgagcaaagtactcggagaagttacacggagagaattattaccaccttgtatatatatgtaagtattctaagagtaaagtttgaagcctcgtccttattatatgtagctacaacgatgaggtatacatgtgctcaggctctcagagcttgcacggcgacgatgctccggggtggtgcaccacgatgaggttgtacgcgtcgagcgtgaggaagtcgtccagctccggcgcggtgcactgccggctgaagatcctgccggcctccgcgtaccggccgcgccggaacctctcggcgcccacctcggcctccaccctcgccatctccacctccacgacgcgcgccagcagctcgggcgtggcccggacctccacgccgccggcgtccagcaccgcgccgtgccggagccactgccagttctgcacccggctgatctccgcggtggcggcgtcctccatcaggttgtacagcggcacggagcccgacccggatagccacgccgcgacgtactgcacgccgacgcgcgtgttg

SEQ ID NO: 13005 - DNA, 1501 bp, Oryza sativa
tataaagatataatatgtttgcatgatgtttaaatgtgatgattgttagtggatgataatgtggcatatttgcatgttaagcttaaggagttagtgggggataactttatagtaagataggatttatgaaaatattaaaaaaagttagtcacacataaagtactatttatgttttatcatctactaacaacaaaaatactaatcattgaaaaatttcaaataagacgagcagtcaaacattggatgtgaccagtgcaaaactgcacttattttaggacggatggagtaattctttttctatcatttgattcattgttaaatatacttatatgtatacatatagttttacatatttcacaaaagtttttgaataagacgaacgtttaaacatgtgctaaaaagtcaacggtatcaaatatttgaaaacggagggagtagtggagtactatactggccaaatatttgtgtgttgcagcggactattcaaatcaaaaatagcaaaaaagaattgtgtccttgttgaacaaatactacatactagtctgtcaaaaaaaacaaactctggctatgaatctggacacatgaatctgaacacacatgtgtccagattcatagctaggattggacttttttggaacggagggtgtatatactagtactaaggtcctgtttgattaagcttaggattattataatctgcattattatgagcaagctgaaacaaacaagtagattattatgctagattattacaatgtataagccagattactataatccaataatctcctctagaggagctttttccagattattgagtggctaaagacctactacccttagatgcctctaataatccagaaaaacaaacaactagtagcttattttatatcagcttattataatccagcttagagtaatctgatttaataattcagattacaataatcttaagctgaaacaaacaaggcctaaattcaattgtcgacacctttgtttggcacaactcctagcagtctagctcctagacatccatgaatccagctttagggttcttctagtgatttcagttcaaattatagaaagttcttcgtacatcatggactcttttatcatgaagttttggatctcaaacacagaccgcgatccaaattaattcccagaataagggactcatttgcaaagttccagtacgggacgtcgagcagccgttacccgttggatagagaagtgggcgactaggattgacaggcgagggatatttgcagaaagaaccctgggtacttggctatcttttaattgtctttctatgagatgaaccccatctctcaagtgtcaagtctgcgaccgagttctaaaaaaaaaaaaaaactgcgagaccgcaaaggaagaacaaaacccatcaaaaccctcgttcgccgccgccgccgccgctcgccggcgaagaacccctgaaccctccggtaagccctggtagttagaaaccgagtacctaatctca

SEQ ID NO: 13006 - DNA, 1501 bp, Oryza sativa
tctaagcttgcaagaacatttactagtttgatttggaatatgtcggcatctttcatttaccaaaacaaggttgtgttcgccagtgtgagttcctaactccacattcttcattttctgtgtgcacgtttttcaaattgctaaatgatatactttttttaaaaaaaactatacgaaaattactttaaaaatcatattaatctatttttttaaaaaaaataatactaaattaatcatgcgctaataagtcgtttcgttttgtacgcaaggaattagagcatgtttaatagtatatcgaacgactaacttcaaatcatctatagtcaatttagtagccaatttatacaatagatacctataaacatatacaacactagtaatatctggtcctacctgtcaaacacacattatattttataatctaggtacaaatttatagcccgctgctcttctctcttcttatttatctactcgatatgtgttaatagttggcttatagtatgctgttgtactggctcttaggtcccatctgaagctactgaacacaacctaagtgtgatctaagcttgcataaacatttaccagtttgctttggaatatgttagcacctttcatttaccaacacaactaagtgtaatcggggtcatcgttttcttctaggatattgggttgtacataactttgtatttcaatgtacgtaagagagaaaaaatccattaagtagttttatgtgctatgcatatctttgtattttcctctggataactaagggctcaaattatgaacatgaattatttgtgtcctattttcggaaacttcatgtagctaatttttttcttaaaaaaatatagttttaaaatctagtaaactaggagttggttcagattctcatcagaaatttttagaatcaagctcatggagccttcatactccacaattttggggaaatgtagtggtcacacaaaaaaaaagagaaatatggcgataagaatctcctaattctatcacaatataagggcccctttagaagttgtacacttatcatcacaccacacacccctatctatcgtcaacttggtggtttctcagtgggcaggggagcagaggggcacacagtttagattttgtccctataagagcagacttctattagccgcgtacagatagatagacacaacagcaacaacaacaagcgaattcttcttgcagatagggaaaaaaaaacgaaagcgagagatgaggagcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcgg

SEQ ID NO: 13007 - DNA, 1501 bp, Oryza sativa
tggaaaaaaaacaattgtacaatttgcatgtaaattgcgagacaattcttttgtgtctgattacatttgacaatgtgatgctacagtaaacatttgctaatgatgaattaattaggcaataaattcgtctcgcagtttacaggcgggaatctgtaatttgttttgttattagtctatgtttaatacttcaaatgtgtgttcgcatatttcaaagtttttacatccaaagaactataaacacacccttatccttatcaaacattggtaatgccaaaatttgttactaccaaaatttggtaatgttgatttagacatcaaagtgagcaacctatattagttgatttaggcatcaaagtaaagttttgcttttagctttgttctgtgtgaaggaaatgcaaatgaattaggaccccctttgaaaagttcgaatctttttccagatcacattgaactattccatctgaaaaaacagtgaacttatctagtactcgtgggcttgtggcccagtttaatcatcatccggtcatgcatggcgtgtgctccgccggtgcaggccgcggcttctcggtcgcgccacgctggcatccactttctcatggcccggcgacgtacgggacgggctccacgtgtcacgccgccgcccacagcttggtcgtactccggcgagaggagagatggagcccactttccgaagagatatgctccactaccattccatatttccattgcagaccatttttctagcctatccatggttcgtcctgagtaatcaatgtttgaggctgagtttgaactactgagctaaagctggatccactgcaaccacgatattggacatgcaaaactgtggttgccccattggtagggtaggagcgtagcgtaggagcgttcgagggccaggcagttggacttgcaggtcccagatgtgcaatgatcgccgctaaactaacagtttttttgttctttttttttaataaatgccatagccaattttttaaagcaacatatagttactttaagctaaaagacagtcggcagcattgtgtcaagagtactttcagctaccgagtttttgttttttgaattaaaccgtactactgttggagtatataggaattgagaactgttgggcttcaaagagaggctcccaagtgcagtgacctgaaagctcaagctcaacctgcggcgttcgtgcgggtttggcacagagaatccgcggcggagctctagaccattccgccactttcgaccgacgcggttcccgcgcattcgcgagtcggtgccacgtaactctcccaacccccctcccaccaccagcgacctcacacctttcccactgacaagtgggtccctacatgacctggtcccactagtcattcggtaaacgagtagattccgcggggcgcgtcccttcccgccacccgcaacgccgctggactccactccactctcctcgtcgcttcgttgctgcacatcaccacccaccgcggtggcactcact

SEQ ID NO: 13008 - DNA, 1501 bp, Oryza sativa; identical to SEQ ID NO: 13006

SEQ ID NO: 13009 - DNA, 1501 bp, Oryza sativa
gtggcggaggcggccatggtgatcgatcgatcgatcgagctgtgcctgtgagtcactcaccgatcgacggatcgatcgatgaatgtgcgtgcgtgcgtatatatataaggaaatgggatggataaagtgagatggtagatgggctgctgcatctaacaaatggtagcttgatcgatcgatggtagatggaggagcaagtggtcaatgtgaagctcaccggccggacggagctaggaggaggagagtccgaatggtagctttgccttttgcgctttttcaggtgagaagaattttgttataactgggcttgctctatctgatgggcccatcgacctaccttctttgggctgtcaactctctctcatcctctttcatacatgggccggccgggtcaatgtactgatgacttaattaattaattaaggaatgcaaactaatatttccaaattatatctcaattttgaaatccattcgattttattcatcgaaattcataactccaagtaaccatatatgtagtcacccaaattaagcctgatgatgattgatctctcgccaccaaggccacacgacacgatagaacaccgtacgtcgtcgtcctcctcgccggcgaccagccgtgtcacccatccttctctcgatcgatcgatcgccatgacaacaatggcgtcgaggctcgtgcgggccgcccacggcgcgtcccgcgtcgcacgcttagctgctgcggcggcggcggcgcgccgtgacgacgagggggcatcatctcgcgccgccagcttagccgcgtctcgtgtcgcccgctcagcgcgcgcggccgctgcctccgccgccgcgtctcgacgccgccgcatcgccgacctctccaagccccctgacaactctcatcgcctctctttccgctacagcaccgagcccccaggtaaacctacctaatcccaccctaattaaggacctatttatttcaacttaagattattataacctagattattaaatcagattactctaggctggattataataagctgacacaaaataatcgtaaaataatctacgagttgtttgtttctctggattattaaaggcatctaagggtagtgggtctttagccacttaataatctggaaaaagctcctctagaggagattattggattatagtaatctggtttatagattataataacctagcataataatctacttgtttgtttcagcttacttctaataatttagattataataatcctaagctgaatcaaaaagggcctaatttgcttcaaaacaaactatatatagtctttttttttttcattcaattgatttgtattaaattcatttacatttacataaacaaactatatatctatggtctagtattattaagtaaattcattcagttgttgcatgaaaaaaaaaagtacgatcgaatagcatgtaacaattgaatgaatttaattgcatgctagtatttgatagtacaattcgctgttttaattatt

SEQ ID NO: 13010 - DNA, 1501 bp, Oryza sativa
ttgatgcttcatggactggtaatgctgggttttttttggggtgcaaaacatgcttttttaattttatcaacggttttatttttttctaaacaagaattcaaaccttgtcccttagatgttgatatgttgaccatgccatttggataaaattagttttttttcctcgggcttggttaaaagttaagttacaaccaagcagaattaaatagtttttttcattatttttttaacctttttaatttgttgttttaaaaataaactcttttaaaacttatttccaaaaatttgaactttttagctacgccaactcacctgacgtggcaaaataatactgtcacgctacccacaatggacatgatagttttgttttgctacgccagtaagaacaaataacacttccacgtcagctagctaagtaatgctctcaggttattttaggttattttagactgacgtgatattgttgtttggttgatcttaaaaataagtttctaaaatgtttatttttaaaatagaaaaacaagaaagttcaaaaataaaaaataaaggtaaaaccacatattattaggagttattaattgtagttaaaaggctgacacgtgggagcatcgtctagcgacaatgttttaagctagggagtggactatattttttcttattgccaccaactttatatataattttgatagcaatgtctaacatatgaagtaattttttgttcttgttgctaacgattttatacatgaactagaaatgtggagttagatttatgttgcttcacgactccactccagatccaacttcttaagttaaatttagaagttggagttttagcaaacgagttctcggaagggctacaaatctacaataaatcccatccaatccaagggacaatttgaatcatgccacacaaaatttgcaaaatttgtgatatgccaccctgacccacatgtcattgactcatatgggtcatacatgtcattgagatacgggtgacatatctcaaattttacaaatatagggtggcatggttccaacaaaccctaaatccaaatgcagcacgagataaaaatcccccttttcttactctgttccagaaaaatatcccttttttttttctgtttcattcctcatgtggctttttatccacaatttattccatgtgtatttgaaaaggttatgtttctctgttcctccacattcctctctacctcctcattcatttgtggagtggagtcccactcctaccactcctctccctgtgactctccacaaccatctcatctccttcaccttcaccttcagttacccccatccaattccatccagattgcaattgcacaggtaaattatccatatactaactttcattcgtttgcaagcaagatttcctttgcttatcccacatataaataaatctggaagggagccgaacaggtgggatacaggtagagagaggtgagaaggcagtggtgggagatccatctgcgaggtgcctcca

SEQ ID NO: 13011 - DNA, 1501 bp, Oryza sativa
gcggatgccgccggcgccgacgacgaggaaggcgaaggaggcgaggagcgcggcgagctggcggtgcgtggggccctggcacgacgtggacgaggaggaggcacaaggtggggggtggagagatgggatggcggcggtgagggtgagcacaagcatgccgaggaaggaggcgatggaggcggcggcgagggtggcgtagcggccgaggtaggcgtcgcagaggaaggcgccgaggagaggggcgaggttggaggtaccggagaagacgttgaggagggtggcggcggcggcgctggggatgtggaagacggtggtgaggtacaccagcaggttcgccgtcgtgccgatcgtccccagcctttcgcatgtctcgttccctgatccatcgtctcgtgtcaaactccatcccttttttttaagagaaaagtaagaattaccccctaactattgggtgagtacgaataacacctctaaagttgaaaaccacacatcgctcacctcaaactttcaaaaccgaacaagaaacccccctcccccaccctccccgggaacaatgttgcgagcggtttggagttcgaatattacacgtggcacagtccactcagcaatatttttctaaaaaatagcatgccaacttgacagaatccacaccctctttctcttccccctctccttcagaaacgcgtggccggcccaccgccgccgcgctctttagaacgagagggagaagagagagaaatagatgtggggattctgacaagtgggcccgctattttttttagaaaaaaattactaactggactgccacgtgtgctatacgaactctaaactgctcgcaatagtgctagggggtttcttgtccggtattgaaagttcggggtgagcgatgtttgattttcgagtttagtggtgttattcatactcatccaatagttcaggggtaattcgtacttttctctttttttatttacaaattattatttgcaaaatggtattataagatctactagacatggcatcatcttaaaggccccatttgatatagattagtgagtggattaattaattatcgcacattatttacttattatttggatggatgaaatattgtaataaataaacttaacaaaatactcctccgtttagtaataagtggtctaaataatgcagtagaaaaaagtttatagaaaaattgaagtgtgcagcgaataatttatttcataatccggtaaataattttaaaagaatagggagttgtcagtaattcttttatatatgtttgactagaaaaaatgtccgtgcattacaacatgtaaatatttttttaaaattttattattgctatacgttttagttaggataaaatttactttaggaattctcttgatattttttcagaaaatcatgagttgcaattattagtccatatttcatctcaagttagcatgcaagtttttttaaaagatttgttatacgacaccttttatgcttccaaaaggaa

SEQ ID NO: 13012 - DNA, 1501 bp, Oryza sativa
tgtgcgcatctcccagaaaataaaagaagtcctatagcaaatggtattgaaaccgcgtgcgcacgatttcgtttggcggcgcgtatgcgcggaacaggaatctcctacaatatatgttgcatttacagcccttatagtcaaaagaagtcagctgagcatcctcgaatgtcaaatagcaaatcttgaaaccaaataaatttgtgcagctattctttaactggtgtgaaaaaaaaatttacatctcttgaaaatagtcaaaatcaaagtagatggtttggatgtcaaatttgtatagaaagaaacctcaattagttcctttttttggattttggtaattaagaggtaagaaaaaaaaaggactttgcatatataggacgacagaaaaaaaaacagtgaaggggactattagaaaacaaaagagatgaactttgcatatataggagtcaccatcaaggcatactatcatggccgaattgtgtgcaaagggcggaatagcatatcagggcttgcccaattctgtttggagtacaacattacatttccagtgcattgcatcaactttctctaaaaacgcatgccatcaacttgatcaaactgttccatgatggtcgacaaattgccatatgcggatatgcccaatacagaggtcattcttgttcattcagtacgttatatcaaaattctgattcgctatacggctctcaatatcccaatttatcacgcgtatgaattattcagtcagaactgcttttccactcccaggtcccaagtagtagaatgaattgtttcggaatttggactaagatttttttagaaaaattgtgtaacaactgcagttgctgttttattcggcagagcaaaagacaaagggatagccaagctactattctggacagaagaactgtaattccaatattagttgaggcgaggataacgcacgcttacgaatggagataattcgtcaagaaagaatatattatagcaaactccaaacagaaccaagaatatattatactagcaaactccaaacagaaccgaatgattttattaatccatctccctctctagtgtgctaatctgttttgctgttgatgcattcgtactaaatagaattcaggtcgaaatctagaaaaagaaaagtactagtaataaagaaaaaattaagcaggtattttctccgtccacagaaaacgaatctaaaatcggatgcgacatattctaatacgatgaatctgaatagatgtatatctatattcggagtactagaatgtatcatatcctatactgatttggtgaatgtatcatatcctatactgatttggttttttacgtgacagagaaagtaggccgtatcctatactagattggtttagaatgtatcatatcctatactgatttggttttttacgtgacagagaaagtaggccgtatcctatactagattggttttttacgtgacagaggaagtaggccgtaggaaattaagggtagctagttggtg

SEQ ID NO: 13013 - DNA, 1501 bp, Oryza sativa
cccttccctctccgaaaagctcagtgctctcctctcctcttccccttcctattatctagctaaagtctattaaacttcctacaaacgcttctaagttgccacatgacactctaacaaattagagaaatcgaagaaattacaagaaaaaagcaaaacatctaaccctcgattttcacttaatacggtggacccaatattctacattattagaaaaatcccaaaacccatctccaccgccccctcctcttgggccacctcttctcgcggtacgtacatccctccctccctctttccttccttcctttttttaatcttctagctaacaaattaataaaaatcataaaaattctaattttataaaagttgatgaacccattaattttaaccatacgatcttcatttgaaaagaaaatctggtacctgcaccctcaccgccacatccatacgtgcgtgcgcacataaccctcctaactctcccctccttttctatttcttaagctaacttctattttttagctaagactcaatctatcaaaaattaataattggatttctaaatgatcgtaaatctcaagttaatttttttctcattttttgaattattgtgctatatataattaaatacataattcgagatccatatacatagctcaaacttctaatataaatgtttaagagcaaatttttaaacaacatattaaacaaatattaaatttagatcctataaacgctcctaaatcgccacgcggcaatcataccaatgctcctaaatgacatgtgactgctcctaaatgacatgcgaccctctaataaattataaaaaatcacaggaattatatttaaaataatctaaccattgattttttttaatatttacaatcattagatctaatattaatcttaacctacttaaaaacttcaagatgattctatcctccattgcttgatgatgccatccatgagtcagccgcatgtactccgcatatatgtttcgttcacgagggagagagcgcgtgattttgactcaaattgaaaaaaaaaagaaccaaatcattcgactcagctcactgaaagaaaaaagcaaatggaaaaaacatcttacttctaatttaaaattaatttgccatacctgtttttaacaagccaatacatatgcccgcgtattgcgcgggctaccttcctagttggattaattaaaagcagtaacttgtaactttgcaatggatcaaaaaccacggcaatgaaaaggaaaacagaatatatatatattcgctgattattaccactttctacaaaatttggcaaatcgtcaatgcgagtggacatagtatacttgcaaagttatatgcgacgacaatccacctgtctgtctatgatatgaaatgaagctttttccaaagcttcaacagaggggactggaaggaagagcaaacaaagttggctgccacgtcagaaaaccactagtgggccccacaaacccactgggttgaatcgaatcgac

SEQ ID NO: 13014 - DNA, 1501 bp, Oryza sativa
taaattctttgattcaaacgagcccttgctctgattgatctctgtatctactgtatctagctagcattggggtattgctttggctatggtggctatccatccccatcgttgtgcctgcatcgtctctcatgactctcaatctctctctagtgtggtgatgagcaacaacaactagtgtggtgatggggggaggggagatggaggaggaagacagtgcccactgaatgggcacaggccgccattaaagcatgcctgcctgccatctctctcccccctctccgtgccggcctcccccctctgaacccccatttattgtctgcgctacgcccattaatgtcaagacatgtcctctctctctctcttctcctcctcatcggattgattcttgaatcttgattctttgctgccgttgcatctgcatcagcatctctgtgttcttgcaacatttgcttgctttcttggtttggagtagcatggatgagggtgtgttcacgttaaaattgaaagtttgattaaaattggaacgacgtgatgaaaaagttagaagtttttgtgtataagaaagtctcgatgtgatggaaaaattgaaggtttaaaaaaaagtagagaactaaactagacctgagtgtatctactgctgtaataacaactctggttgttggttgaagaagagaggagagaataattaattagggcttttgtgagatcgattaatttgggtttagggatggatgggttgatgatttggacgtgttgtgcgtttgattgcggggggttggcatgtgcaggttcgctcagcagtcaagatcgccataaaacgcagcgtatgagatgcgtacccttcttcttccttgattggttgtctcctcgccaacctcctcttcatgagatgatagtaataattcgttcgtttttaccctgctcacagttgatctctgatctcgccgtaccggattatatatacatgtaattactactgcatcgatcgtcagcagcatggttacatctgattggatttgtgttagtgatgcgattttaatcgattataaagtagtaaataaaagaggaataatgagcagattaagaacaagggaaagaaatgtaatgtgcattctcatgagcttaaaatttttcatgcgacaaagcatggatggatggcttctaatgaagccctaggagatcgatcgatcgagctatattcaactatcttcaatccttcatggtctgcttcttttctgaagatttcagcagcaaagagatgagaagaagaagaaatgctgatcactttgcaacgatttagatatacagggagacttgtgatcaaaattcccctgcaagaagcagagttcatggctacccatcgatctctcatcgtcttcctcgtcgtcgtcttcagatcggagcaggctgcgcgattgattggatactagtttttactactactacgccctcttggatgaggtcgctggatcgtcctccttgcgcggcggcggccgcggcg

SEQ ID NO: 13015 - DNA, 1501 bp, Oryza sativa
gggatttgaggaaggggaggatgcaaaccttgaggccgatgtagcggtcgctgtgcggcctcttgaactgcttcacccgcttcttcacgatcttcttcgtcagcaacggcaccgccatctgcacgcgaaaaacagccgcgttagggatacgggggggggaggagaacgtcaccggaaaaccacgcggcggcgagccggagcgcacgttaccttcgcgaacccctgcggcgggcggcggctgggtggggaatgaaggggttcttatggcggcgcgagaaccctaggcggtgggctcggtgagatgggccgccgcgagtgggccgggaaaatcacggcccacgcgaacgtctcgattgggccgagaacctgcgagactgtaggagtacatgggccgtcgcggtcggttctgtgcagcgagcccaaggccgtcgcctgcgttgcggcttgtgtcgccttcgctatcgtagagagagcatcacacgctcaatgaatctaagagcaagtactgtactagccagtataggtttacacacatgtgaataagagagaagaggtgagaagaaaaacgagttataaatttatatctagctacaacctgagcttcaagatattacgtgagtgtaatacgtagaccaaagtattaatggtgcgatatataatttatataaaactattgagcgtgatcggcagtgctggctgctgcagcagctacggctgcgagagctaaaaatcagctgcagcagcagcagccaaaaagggccatagccgtgatggctgcagcagccagcagttccgatcagccctatgaataagatatttagagagatcatatatgatatattaatttttaaagctagcaattggctatacttaattcctacttcaacgatcattgagcaatggccaccgcgccaataccgctgccacggcgaaataagccgccacaaccgtgtaacaatacaccggaaccttggacaacgtggccgcgaaactgtcgacgaagcgcaaatgctcgtgggtgcctcatcaccaccaaactggcggtgcggacgttcacagccacgcaataagccgtgcagcagacgttgatcgagcaaacatttcagaattagttttttactctgagcaagtgatgcatgtgcgtcaaactcatctatatccatgcagtacaataatatttctttatttcgatatatataatcagaatcaaaagaaaagggaaagaacaacaattaatcagtaatcaccaggaaactactcgaaacttagcgaatgcgtcgttgttcttcttcatccacggctcaaccattatttcgagtcgatttgtttgaatctccggaagatgaaaaataaagataaaaattaaacgtttcacgtaaaacgaggtgatactaacgtatgattaattaagttttaattattacaaaacttgaaaaatggattaatatgatattttatagcaactttcatatagaaagtttttacacaaaacgcaccgttt

SEQ ID NO: 13016 - DNA, 1501 bp, Oryza sativa
ggttgagccacggatgaagaagctgcctattaatctcccgacttctggcagcgttcgtttatccaacaaactgttggatgaaattttggattatcgtggcacgttttttaaactgttaaacggtgcgttttgtgtaaaaactttctatatgaaagttgctataaaatatcatattaatccatttttcaagttttgtaataattaaaacttaattaatcatacgttagtatcacctcgttttacgtgaaacgtttaatttttatctttatttttcatcttccggagattcaaacaaatcgactcgaaataatggttgagccgtggatgaagaagaacaacgacgcattcgctaagtttcgagtagtttcctggtgattactgattaattgttgttctttcccttttcttttgattctgattatatatatcgaaataaagaaatattattgtactgcatggatatagatgagtttgacgcacatgcatcacttgctcagagtaaaaaactaattctgaaatgtttgctcgatcaacgtctgctgcacggcttattgcgtggctgtgaacgtccgcaccgccagtttggtggtgatgaggcacccacgagcatttgcgcttcgtcgacagtttcgcggccacgttgtccaaggttccggtgtattgttacacggttgtggcggcttatttcgccgtggcagcggtattggcgcggtggccattgctcaatgatcgttgaagtaggaattaagtatagccaattgctagctttaaaaattaatatatcatatatgatctctctaaatatcttattcatagggctgatcggaactgctggctgctgcagccatcacggctatggccctttttggctgctgctgctgcagctgatttttagctctcgcagccgtagctgctgcagcagccagcactgccgatcacgctcaatagttttatataaattatatatcgcaccattaatactttggtctacgtattacactcacgtaatatcttgaagctcaggttgtagctagatataaatttataactcgtttttcttctcacctcttctctcttattcacatgtgtgtaaacctatactggctagtacagtacttgctcttagattcattgagcgtgtgatgctctctctacgatagcgaaggcgacacaagccgcaacgcaggcgacggccttgggctcgctgcacagaaccgaccgcgacggcccatgtactcctacagtctcgcaggttctcggcccaatcgagacgttcgcgtgggccgtgattttcccggcccactcgcggcggcccatctcaccgagcccaccgcctagggttctcgcgccgccataagaaccccttcattccccacccagccgccgcccgccgcaggggttcgcgaaggtaacgtgcgctccggctcgccgccgcgtggttttccggtgacgttctcctcccccccccgtatccctaacgcggctgtttttcgcgtgcaga

SEQ ID NO: 13017 - DNA, 1501 bp, Oryza sativa
ggactctgtgacaatctaatatctaacaagaaactgataagtctttgaggctatatatttgctctcataactatatatcacaagattaacgaagcataaaatccaacattaatcagtcaaaaaatgaggaaccaattcaacttattcagtggaagcaggttattgtaatgaatctaataaaatatggaactcaatatgtggaactgcttaacaagagaggatttaggacaaatgcaacgcatcaataggattggattctatgagcttcaacacttatatatggtagatgaacacctaatatgaaaacctgtgagcggtggcaaatacaaggcttatcctgtttgatgtgatggcaaatacaatgtcttatgttgatcagccctagttccagtgaatctaactacagaataattacattcagcaggcaataatatgcaatactgataggaaaatgatttcagagatccaagttcacattgcactagtgaaacgtgatcccgtaggatcatagtcatgccactactaagtggttaggctcaatccttcctcaaatattgtgggaaaatggacaaaatctagtagcatgttaactgaaaattttcagatgctcccaaggttccactactcaatgtcagtagatgacactgttctaaaactcagccctaggctaggtaccagtgtaccacctaggtgactattgggcgctaggtgcccggtggccgcaccaattaggcattatatggtgctttagtcaaccgaactatccttgagggctcttgtgctcatattttagtgttctattgtcttaacttttatgtgatatgctcactaattgcttggtttcactagtcgcgttggacctaggtactggacatgccgaccatctagtgcctaccgccttattgaatgttccctacaagtaccattaagctccattggtatcagtacattgttcgccgcataaggacttcttcccgtcttcaaacattacaacacacatctacccatcgagtaaaccaaaaccaaaaaaaaggaacaattccaatgtatggctacaaattcaccacgagcatccagcaacaatcaagtaaagtaataatgcgtttgaaaccacatttcgccgaacacgtcagaatacggacagcggagcgacgtgtgacagcacgggaaggaggcgatcaatggctgcggaaggtgagggtgaaggtgaggcgagcgcatacataccagccttgacgagcgcgtcccagagctcctcggggaggatgcagccgttgtgctcgacgtcgatggcctggaagatgcggtagagctcgagctccttgtcgtccatgtaccgcctgaagtcgtcgtacccgacgcggccgtcgcggtcgcggtcgcaggcgcggagcagctcccgcgcgtacttgcactcggcggggatctgcagcgcggcgagcccggcctcgatctgcgcgtagtccagctgcccgcgcccgtccacgtcgaagaaggcgaa

SEQ ID NO: 13018 - DNA, 1501 bp, Oryza sativa
gaggcgcgatggccggaggagggggaggggaggcgtggcactgggaggacaagggagagagaaaaaaaatacttttttatttgtgtggaccccacttgagactaggtaccactgtgaaacttgtgttaaacattattcttaggtgttcttgagcctatgtgacgcatgaggttcagcaaaatgtgttgtcgcactgctaatgcccttagtgatacaagtgtttgggaggtctcagtttccgcagatggattggcaagcaaaacatgatctagaatgatattttgatgaaagcatgtatacagagctagattttctagacagtagtagagctagaaaatttttaaaccccaagcaaatctaactaagacaagtactccctccgattcgaaatgtttgacaccgttgactttttagcacatgtttaaccgttcgtcttattcaaaaacttttgtgaaatatttaaaattatatgcctacataaaaatatatttaacaatgaatcaaatgataggaaaagaatcaataattacttaaattttttgaataagacgaacggtcaaacatgtgctaaaaagtcaatggtgtcaaacatttcgaaacggagggagtacagttctatattatatcatattttacttcatgttcactgccacgagtgcccggggtcgcccggcggtgggcggtggctccgccactgcttctagagcatctcatccggccgctatccgaagaaggaaaaacaggcaaaaaaaagtttttttttaaaaaatgtatcggcaaggagattaccggcttacaccaacttccgcgccggccgtggccggctgtagtactgcacaccgtggccacgcgggcgggcggcgcgcgcagcaccagcaggttggatgccggccggactaggccggtcgccactcactgcgccagcgaagcggcacgttgtcctctcctctcaggctttcgctgcgtcggcgccgcgccgtccgtctcccgtctcccccgcgcgcgcgagactgccccgtcaacgcagccaccacccacccgtccgtgtgatccatgacccgcgcgcggggcgcggtacaccgatccgtcgtgggccggcatggattgcagcgggattccgcgggaataagatcactttgactctctcaactgactatcgaatctaaatcatatctctcaaccgcaataccagaaatcttgactactcaaacttacaaaaccggtgcaatttgactccctgggcggttttaggaggcggttttgctgacgtggcgccacgtggtgcctacgtggcaatattgaccgagtcttcgttccacgtgatgatgacgtggcatctacgtagcggtagaattaaaaaatatgcatgggacccattagtcattcacacaagaaaaaaagtgggcccactgacatgtggggcccacatatcagtccttcctcctctctctcccttctctctctttctgtcccattcttcccttcggccggtggcacctct

SEQ ID NO: 13019 - DNA, 1501 bp, Oryza sativa
caggataccaaacaaattaaagcaaatctcaccacagaatttttcacctaaccctttatatttttggtctttggaggcgcactcatttcatgctatgtggaaagaagagatatgcaaaaggagtctactaacactgagtagcagggacattaattaatttgaatatccaccgccaaaccaaattgatgctggattaatgttttgatttatcatgtgccgtttacctctaggcacctgcatgcatggtattaaacaaaaattaatatgtcttatatatccactccattattgatccccggccgtacttttgccagaaaagaaagattggaaggcgaataaaagacggtgtggaccattattaattgtccatttctaagtaaatccaagcgcatgctggctggtggactatatatttcactcatcttctgctatacatttgcgatcaaaattcacaactttattattcagaaaccagtcttatagagagaaagacagaccgacatgcatcagttgtagttgttcagaaagatcaggggcgccgttgcatgcacatcgacgctgggaccaaaaaaaatatacaacatcatcgctgactcagatgttctgaaagtagctaagaatgtacacatgtaaaataagtatgatcatttctttgcttagtggacaaagattaccttaattatatatatatctcgttaatgcatgcatgtttgataaggaaaagatttctttgctgaatgctcaccatcaacttttcgtggcctaagttgcatgtgaatctcatcatttttacaattgatacacggaataatctttttggtacatgtttggtgcgatactgtggtggacttgtagatagagaggtgtgtcggtcaccagaaaccagcactctagctaccacgaatcaccttttaattttccctgtttgcttttcgttagccaaacgaggcacagtatgaacatgataattaagcagcaagggaggatctactgtagatgatttcgcaaattcagggcacagtacatgtagcagagggaccaacattcacatgcagagccatttcagtttcagtactatctaaaaaggctaacctgctctcatgctttgccatgaataatgatggagttgttgcatgtgctgagatgatgaatgtttcagatgaatatataagtttcaccaccacattccaaacaaacacacaaccattccaattctattctaacccatttataagctccttcattggaggttagcccaagggtcagtgttgcttgagaggtactcaccctgtgcaggtgccagtggactcaggccatttagctagctagccaaagccaattgccatgtggagtgctctcttctcccatctgagagaggttcacaagagaagcggagttaaggaggagaagttgataatgaagtcgccaccagcagcaggtgaggccggctgccacaagccacaggcgactgccaccaacaagatgacggtgctgcagtccc

SEQ ID NO: 13020 - DNA, 1160 bp, Oryza sativa
gtaatgttttatgatgcactgtatggctgtatcgtgcgcgggagcgcagaatctgttactgagtttagtgtaccatgtacctatatatatggtcacattgtattattgttgattgtttcttccaccgtaactggtgaagtttctcaaaaagaacattggaatttgtattgcctggtttgtggacaaaacatcaacaaaaaaaagagagaagaaaaaacctggtgactttgagtagtacgttatcgaattatgatattttaccatcgtcgtcgtctcatagtagtataccgtagtggtagtatactactagtagtgtgagtgtgtattattttacagagagtccgtgcttggattgcataggcgctgtttttggcttcgtctcgagctgcattgcctgcatcctcttcaaatcttcaaagatgagagaggcaacggcgcagagcagccaagcatggacggagccagtcggtggtgtatacgtccaagtgtccaagccgaaagctgcctcaccatctccctatactgctttgattttttgtttttggttaattgtttgtttttgggatgcaagtcatgcaacctgcactgtggcagtggcagtggctagcaggcgagtgtgccgctagcgcgcacttcccacttaactatctctattagttaacattaataacagtaattaggaatttttttaaagattttatcttttttttagatttttttattaacagattgacaaaaatttaaactaaatttgaaacttttgatttaagattcaaattttaaagtcaaattttgaaaacttttaactcagatttgaaactttcaacttgacaagttgatattcgaaaactttaaagtccaggtttgaaaattttgaaaactttcagcttaagatttgaaaatttttaactcgagattcgaaaactttcaactcgagatttgaaaactttcaagttcagatttgaaaattttgaaaactttcaacttgagatttaaaaatttttaactcgaggtttgaaaactttcaactcgagatttgaaaactttcaagaccaaatctgaaaatttttaagttaagatttaaaaattactagtaaactaattatgattttttctcctacccgtgcgacatcgaactgtgaaaaaaaaaggaagaaaca

SEQ ID NO: 13021 - DNA, 1501 bp, Oryza sativa
cttcatcgtttggcttattcatatatttacataaaaaaaataatttgtgaatacaacttttatatacgtattcttaacgatccaaaagtagaggctaaaaaataaacttaggtgaaaaaaatcccaaaaccaactctaaattaaatgttaaaaatttaaattttggctgataagcaaaagatggggctggaagtgcgaccatgtcgcacacacgggccacggcctcctgacctcaacaagggaaagcggagatgggccgatggctactcgtcacggcccataaaagctcgcttgttttgggccccatatattgggccgggcatcctcagatttctttttctcagagaaaattctgaccggagaatctctcgatcaacagccaacgtggtaactcaccgtgcaggccggaccgccagcagaattcctaattcccgcgtatgcgccgtcaacgcgtacttccggcccacacacgtgtttctttttctcttttttttttggcgcagttaatgtttgcagtgtcataattgtaaatcccccatttgctaccgccatgtttcttcctttttttttcacagttcgatgtcgcacgggtaggagaaaaaatcataattagtttactagtaatttttaaatcttaacttaaaaattttcagatttggtcttgaaagttttcaaatctcgagttgaaagttttcaaacctcgagttaaaaatttttaaatctcaagttgaaagttttcaaaattttcaaatctgaacttgaaagttttcaaatctcgagttgaaagttttcgaatctcgagttaaaaattttcaaatcttaagctgaaagttttcaaaattttcaaacctggactttaaagttttcgaatatcaacttgtcaagttgaaagtttcaaatctgagttaaaagttttcaaaatttgactttaaaatttgaatcttaaatcaaaagtttcaaatttagtttaaatttttgtcaatctgttaataaaaaaatctaaaaaaaagataaaatctttaaaaaaattcctaattactgttattaatgttaactaatagagatagttaagtgggaagtgcgcgctagcggcacactcgcctgctagccactgccactgccacagtgcaggttgcatgacttgcatcccaaaaacaaacaattaaccaaaaacaaaaaatcaaagcagtatagggagatggtgaggcagctttcggcttggacacttggacgtatacaccaccgactggctccgtccatgcttggctgctctgcgccgttgcctctctcatctttgaagatttgaagaggatgcaggcaatgcagctcgagacgaagccaaaaacagcgcctatgcaatccaagcacggactctctgtaaaataatacacactcacactactagtagtatactaccactacggtatactactatgagacgacgacgatggtaaaatatcataattcgataacgtactactcaaagtcaccaggttttttc

SEQ ID NO: 13022 - DNA, 1501 bp, Oryza sativa
tattcccttattcccaaaacaagcacaactatgagtttctgtgtcccaactttaattgttcgtcttatttattttttttaaaaaaaactaaaaaatataagtcacgcataaagtaatattcgtgttttataatctaataactataaaaatactaaacatgaaaaaatttcaaacaagatggacgattaaggttggacaccgaaatttatggttgcgcttattttgcaatagatcgagtataaaatagccagctctacgttttttctttaaaaaaaaagaaagatgttttttgtgttgaaggaaaattactgggcgcgggagggccggcctggtcagccagccaggccagcggtagcggtaggttgtactttggggcaccggcatatccaacttttcaggacaaagactgaagctgctgctggtgttgattagactttgcatagcagggcaataatttccatatctcccaaagttcctccccacgaattattcaggcagctaccgatacacattttggcagggcgcgaaaaagacaccaatgtacttcagtacttgcagccaacgcagtactccgtctgtggccagtggccagcgcgcgtgtgtgtgcatgcgcaacgcaagagagcgtcgcattgattgtgtgtttctgcgtggcagatggtactacaaggggtacgtggagtccgggtcacgttgctggcctgcccggtccggccggtctcccccacctgcaaaattctcacacacgcgtgcccgttgaggtgacccgtcctccagcagctaccgcgcgccgcgccgatcgactgctccccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagttt

SEQ ID NO: 13023 - DNA, 1501 bp, Oryza sativa; identical to SEQ ID NO: 13022

SEQ ID NO: 13024 - DNA, 1501 bp, Oryza sativa
acctaccatgaatctggcaaaatttcttggtcataaatatagtttgatgctattttttggagatgggtttatagttatatactttgatgatgcactgatcgtacaagagctgatataatattaacactatttgtttttaaaaaatagacattagcaaaatcttaatcatggtgcttaagtactattgtttgactaggtatctatgctattcaaggaccaaaacatcacctccatttgattctttcttgatagatggaaaagttcagaaaggacttaggcccttcaaacttgcaaaaattctatcacatcaaatatttggacacatgcatggagcattaaatgtaaacgaaaaaaaaaccaattgcacagtttgcatgtaaattgcgagacaaatcttttgagcctaattacgccatgatttgataatgtgatgctatagtaaacatttgctaatgacaaattaattaggcttaataaattcgtctcgcagtttacaggcagaatctgtaatttgttttgttattagtctacgtttaatacttcaaatgtgtatccgtatagttgaaaaatttttggcacacgacctaaacacggccttatttcaagttggttgcatttagacatcagcaaccaactttaacaaataaaagcagcaggagaagggaaagaaaaataaaatgttaaagtcttaaagacatcagcaaacacttggtcataggacttgaactacagggacctggattctttggatattatagtagtagtacacacgtcatacattaatttaacatactaaagttccatttgaaatggaagaatcaattattccaccccaaaacaaaaggattcagtttattggagagcctgtcgatctgtcccattggttggattagcaaatataaaagcaacaaaaggaaatgttttctaaaactcagtagctacattatctagatgatatagtacacacgtcatgcaatatatattaattatgggccccatttgaaaaactagagaatttgttttttttgtgggggttcataatttggcatttcgctcttattggggcctaattttcaaatgagaattcctcataaacattactagtctaatttcgcgcttaattttcacaggaaaagatcagaaagaattaattggtcgtaatgtgtcaaagccagagacagtagcagcccggaaatggacaagttgatctatgggcatttggataaccacacatgtaatgcagcgtatgtgatgtatttaaactagaattgacaaaagcaattgggcttttcctatcgatggattgatcacttgatccctatcaagtaacagttccagttgacaaaataaattgcgtgcctgttttgaattaggccgtgtttagttccctcctattcccaactttccatcacatcatatcatatcaaaaacttttctatacacataaacttttaacttttttaaactcccaactttctttaaactttcaacttttttcagg

SEQ ID NO: 13025 - DNA, 1501 bp, Oryza sativa
gtagcaagttccgaagtatttcttccataatgcgaaggcagcatcaaaaaggacaggatgtctaacttacgatccgtcttgtgtcacttttgctgtcaacaaaagttggggtgaagccttttggcactcgattaactctttgcatttattttcaaaccattcgctctttccatcatcatcaaacataaaagtgacagcaaatgtttgaagagagcctgctttggacagtaaaaacttcataaagcacatttgattttcgcggtgcttggcaccagtcagggacacatgtttgaggcttgcaaacaagtcactgcttatctctgaatttagggagtcttcatcaatcttttctttatccaattctgtatcaagagtctacaaaacaaggccaagtttcaattaactcaattgaccaagagatgtctttaaattgaacatagcagttgaaggtgtgaatctaacattacctgaatttcaaggtgctcaatatgcggagcaaacttcagtaaagaatctattgatagaacacttgagagttggccaaaatctatgttcaggctggcttccctcagattctcaaacttgcatgtaattccctccagcatattaatgctgaactgaaagtcataagaacattgttaggcctgacatatgtccatgacgcaagtttacattgagccactaaccaaagaaatatgcaaatattaggacaccatgatcttgtagttacgaaggttcttcttggaccttcattttcagaacctaagaagccatattgtcataaatgttggcatttgcatcagagtacatgtgtttaaatcacatctgccaaaacacgacataccatctctacaagctaactagtttcacattcatcaattcagtcaaattgtaattaagttgctcgcaatgaccaatctattatctatctatctattatatactaaaagtccattaaactccctataaacgctctcaagctgccacgtggctccctcaaaacgctctcatattgccacgtggcactctaatataatagagaaatctgaccatcgattttcatttaaatcggtggacccattattttacatcgttagatctattttaaaaaccaaaaacctcccaccggccccaccacctctgtgcagtacgcacgtactgctccatctgtttagtactttttttttcgtttgttcctttcttttctttttccaatcctaattaaaattgaacctatctttatagaaaagaatacccccacaaatagacatcaaatgcgttaaaatccattaaatatcatataaatgtttctaaccgttgtgtgccactcttaaattagagaaacgtccaaccattggttttcactagaatcgatggacacattattttacgtcgttattagatctgtatattaactaaaagtccataaaactttctatgaacactcctaagtcgccacgtggcatcctagaaacgctcttaagccgccacatgccactcc

SEQ ID NO: 13026 - DNA, 1501 bp, Oryza sativa
gtgcggaccgtccatggacggcctgtacaagtagtacgagtcgtcctcgtccctgaccgggccgtgctcgccgcggccgccgtgggcgtcgatggccgcccgcgcgatccggcgccacgaacgcgcggtcatgtcggcgcgcagcgccgcggcgtgcgcgttcacggcggcgatcatcgcgaagtgcttgacgccctcgaagagctccgcggcgatggcgaccagctccggccgatcctccgggtcggcgccgccgaacgcgaggacgcggaacatgtaccagagctcaggccggcgcaggttgtccagtgtgaccggccgcggcgccgtgcccaggcgcgccgcgtgctccgccgtcctgcagatgatgaccaccttgccgtccccgttctcccggcgaacggacgagcacaacctcctccatggctcctcttccacgtcgccgacgacgtcgaccacgacaagggaccttgcgctaggatcgatgccgaatctccggtgctcgtcgtcgtcgccggccgccatcagatcatcgctgctgagacggtggatcttggcgaagtactgcctaatccgctcgtcgatgcagacgtgttcgaccagcgtccgcttcccgacctccggaccaccgacgacggggaggacgccgggattcgggtcaccggccgacgagcacgccgggcgcagcaggaagtcgacgatctgctccttctccatctgccgcccaaacatgcaccgctccatgaacaggtaggcgctgtacggctgccggctcaggcgagggcagccggccaggagcacgacgagctccttggcgccgcccagcgcggcctccaggctctccatgaccgtggcgtcgccgtcgccgcccaagctgagcagcagcggctggcaccggcgacgacgacggcggctcgccgccgccgccgcggcgttccgtatcctcagcgcgtcgagcgcgtacgcggcgcggcacatctcccacctcagctgcctgcgctgccgcagcatggccgggctggtgacccgcctcccctcggcctcctccatgacgacgcgtgctcgcagcagcgctcgctgcagcctgcttgcgccgtcgtcgtcgccggcgcgatgctcctgccacttgctgatgaggaaggagatgagccgaccgacgaggtcgctggccgccgccgcgagcagagcgtcctttgctgctgcgtgcgtcctctgcaacttcgtctctcggctgtgatttgttaaggttggagggaggagatttttgttcttctaaacaaatcgacgagggtacaggagaaaactgtacaaagaaaacaaatttataagtaaacacccggagacctgtggactcggtcttgagtcttgactaaaggtagccagtccgcgagcttccttgcgcccgcgagggcctagtttttgctgagggacgagattctcaggtggtgtttacgtccagggactccctgtctctagacattaatttagagtattaaatata

SEQ ID NO: 13027 - DNA, 1501 bp, Oryza sativa
  unsure (1)..(1501): unsure at all n locations
ggcgagtgacatttcccattagccgattctagaactctgaagccgatacggttcctaggccgatgatgacctcggggcttaccaaattttggcgttaacaatttgtttctatattttcctataagctgggttaaacttacagaaagtttaatacaggataaaaccaaaacaccttatgttctaaaatggagggaatattaaactgataagaaacaacttaggtggtaaaatagaatttagttttcttttaatgtgtcaaatcatatcttactataaagttgatgcccactaactactaaagctccacatgcaagtgtaacacattatcatccactagcaattattatctagagtattttaaatcacatgcaagtgtgacagatcatcacccactagcaattattatctagagtattttaaatcacatgcaagtttgacacatcatcacccactagtaattattatctagaatattttaaatatcatgccaacataacatatcatttacaattttgttatatttttagaactcaatatgcaagcaatgtcaaattattatctccacatcattttcatattatttaaacatatacatctatcattcctataacgtataacatgcattcatctacatatcctgcagcaaagcatggggcataaactaattacacggctacagaacattacataggttagcatacggcacctatgcgaaaattagaactggcacctatagattagcatgagccagaaaagaaaaagagagccagctcgaatcgagccgaactcaccaacgtttgacaccgcgccatccccaaatcaaattgaaatccccaaatcaaaattaaattgtgaccatgatctattgacatcacagaatgaacatactcaacaacaaaataattcacaaaaacatttacaaaagagactggggattggaggggaggggagggcgagggctggccaccgggcttctttgctccaccttctgccccctcgccagcggacaagggagggcgctgcgccgccaccacggccgcctagtggggagcccactcccccggccgcgccctcccctcccgttggatctggcggaggggaagacgctgcagccgcccacgaccggatctgccgaatggggcgctgccgccgcccactccctcccctcccgctggatctggcggaggggagggcatngccactgtgtgcatacagagaggaagaggatagataaagaaggaaggggggttgtaggaaggaggaggaggaaagggattatagcacgccgggtagagaataagatttgggcgagtttttttatgtggttggcgcactgatcgatcgtctgggctgggtcaattttacaaaacggtcacctacagtttagtgccggtttttcctctagaaccggtacatatagtttttaaaggcacatgttttttatttttctcagcgtgtggcggtaaaaaacggcccttaggtgatggttttaaattaaggg

SEQ ID NO: 13028 - DNA, 1501 bp, Oryza sativa
tgaacttgaccgccgcggcggcgggcggcgacgacgacgcgaaggcgagagctaggatgagtccggcggcggcggcgacggcggccatggttgctgtgctctccgcggcggaggaggccgtcgtgcacgtggagatagtgaaattgggaagggaaggaacgtgagggctaaactgggggtgtacgtacgtgcatgggagtggattgcatgcatgcatgggcgcgccaaaaaggttagacgttgttgacgtacggtccatgacactttgaccgagtctctggtgggtccatgtcatgaagccatgaagaacgttgtgcacatgggctgatgataaggctgataaactttctcatgctccaagtccaaggctttttgttgtcattaaatcagttttctctcccttgtctatttatatgtatcctgtttattatatgtccatggtttttttattatgaaaactattatatctcttaaaatatagagttttagctatactagtaattacctatgcattaactatgcacatgctcatcatttaaacattatctagtctgtctctttccaacccctgtaactatatgaattccttcactacatgtaagaccataccaaataaaatggacattattttgtgtagacattatttttttatgaaacgtttaaatttattgagcatgtgagtttcaccgacaaggagaccatacgctagtgctaaaggtagtggtagcagattcactactactacctttaaattagtatagaaatctaggcacttgctatatttcgagaccgaggtattaacttcaaaattaacttctatcatttgagcttttagatggtctgtttggtgtaccttcaactctcaaatccacttctgatcaagttagagcacaaccaaatgtttcatgagagattgccggattgctccacaaaaatgaactagcagcgtggagtggcattctcgccactgcactactccaaagacaacaagatttcaggagttaaagtggcaatcccgcttagtatatactagtataaaaattaagaaaataaattgctagtataaaatttgagagaaaaaaaataactagagtggcgaattcgaagcgaggggaaaaaaccgtttatccgctctaattgcatccctagccgacatcaggaagagaatcaaagaaacctgtttgtcttagaacttggaagtatatttaatttgtcgtcccattaaaggaggacttggaataataagagatattcaagctgttaacaaattaacctcatcctcaacactgcttggagagtatccacctcagatgattgagttgccaaaatcactaaagccaatgctatattaagaacgaatgtatggtgggaggggaagcagtacaagatgaaatccttgatgcccacgtctgaattcttcaaaattttaaattttgagccaaagattttaaattgcatcatgtcaattcttcactttctatttttaacttttttttatgat

SEQ ID NO: 13029 - DNA, 1501 bp, Oryza sativa; identical to SEQ ID NO: 13028

SEQ ID NO: 13030 - DNA, 1501 bp, Oryza sativa
gcgtttcactacgctacaaggagcacactacgataatctaccacgccaatcgcgtacacggggatcaccgggaacaccaccatcaccggcacaagcaccaccggaccgaactgcaccgccgccgccgctgccgtggaagatgtcatcgccggtgtgtcgctgtctcctgatgaaccggatgttgcaccaccggacgtcgaggcagtcgccgcgtccgagctcgatgacgtcgtcgccagcgccggcgacgaggcgctccgccgcatgcccacggtggcggtgacacggctagtgctcgtctgagttgcagccgccgtgtccgtgttgccgtcgttgtcgtcgtcgtcctcgtcttcctccaccaatgtcggcaagaacggcgacgacgcgctcctcctgagcggcgccgcggtgggcgacgtcgacgacgtcgccggggcgtcgtgggcggcgaagaggaacacgcggatgcggccttgcttgggcttgctggaggccatcaccgcctcgtggaagaagagcagcgacacgaggctccacaggtcgccgtcgctcgccacgtcgtggaggtggaggccctcctctcccgggagcgcgtactggatgcggacgtcgtcggagtcggagaagccggcgagcgccgccagcctcgcgcggaggccggcgaggcgctccgacaggccgaccctgacgatccggtgaactcccccggcgtagtagcacgacgccgccgctgatccgccgcgctgctgctggatgatctccccgccgtagctcaccttcatcctcacggcggtgcccgagcccgacgtcgccagcgacggtgaagacgcgctgcgtggcaaccccagtgtaacgggaggagcagcagaggcacttccagataccagcaccggtaacgacggcgccgacgcggttcggtgcggcggcgcgtcgtgatcggcggcgaacaggaagaccctgatgcggccgggcttggacgacacgggcacctccttgtagtagaagagcagcgacacgaggccccacaggtcgccgtcgtccgccacgtcgcggatgacgccgaggccctccccggggagcgcgtagcggatgaacacgtcggcgcagccggcgagcgccgcgagccgcgcgcggaggccgggcagccgctcggacatgccgaccttgacgatgcggtggactccgccggcgtagtacgccgccttggccttgccgtcggcctggacgatcgcgccgccgtagctgatcatcatgctcaccgaggcgccgtagtcgccggcgggagccatggtcgcgacgggaaagcagcaatcgaagaggacggaatggatgcgttggatggtctctagctggtgagcgccgccgtgcttttaaggagcggcgacgtactccgactccgaatccgagtcgaactcgaacgctgagtccgagtccgatttggagttggaggcggtatatgtccataattggaaaggattgagagggagggctccaatgt

SEQ ID NO: 13031 - DNA, 1501 bp, Oryza sativa
acacgacggtaacaacggcaatagtgacaacaatggcttaggtggcgtttggatccaggaacttaactttagtctctatgtttagacactaatttagagtattaaatatacactacttacaaaactaactacataaatgaaaactaatttgtgagacaatttttttaagcctaattaatctataattagagaatgtttactgtagcatcacataggctaatcatggattaattaggctcaatagattcgtctcgctaattagtccaagattatggatgggttttattaatagtctatgtttaatatttataattaatgtccaaacatccgatgtgatagggaattaaaagttttagtcccatctaaacagggtcttagccgttcatgtcctccagctcactagacagccaggctaggcttctctggggaacaaatccaatttgtggctcctactaaccgcccgaggtcagcatcccaccttttatcctcctcgtacgtatcctcatctctctcttgctattcttgttgtcgacggggatacccgtagaccggatatagagggtattggggtacgctggtacgaggatctacgtaatacgacatcaagcaaataaaagacaacgattatactggttcaggccccttgataggtaatagccctaatacagttggtacgggattatatgatggaaaccacagattacaaagggaatagtagaactcgatgataccgacaagaccgtagtcgagttggttcgactagatcacccggcgacttggctcctgtaggctccgacttcataggctgtggcggttgtgttggcggtgagattcgatcactttggtcttcccggggggtcccttttataccacgggtcagtcgatctccaagtagaactcggagatatcggacccacacaatatagtaacgacccaattctgtccgagtaggactccttccatccgtggactccgtttcttttacgtgatggatttccttaacatgtacaggaaacatcagtatatgcgcaggtataccgtatcggtatacaacatgcatccaagggtagagtgtataccttatccgtaaccctaacagtaacccccgaattctgcttaaatgaactcatgtgaccgatcgcgacttcggatgtcggaatcgttatcgctctcaactggtcgatctcggtatgagaaccgtagagacatagagttatcgataacattgtacgaagttcaacggtcatgagtaaatttaaattgtagtccgaaaactgctgcgcgtaacggacccagaaattttcggcggccatctctctcctttccttggaattcgcaccgtcggtagtgcgcttatttaaaggggttttagggatccattttgaagtccgtttgccgcaaaactttctagccttcaagctcccctcgtcttctccgctcccgcaaaaaaaaccctagtttgctcatctcggtcttattctccggcgatcttcggcggtga

SEQ ID NO: 13032 - DNA, 1501 bp, Oryza sativa
gatcggagaagagcagaaaaacaattttgtgctactacttggcttcacactggcatatgcagtatcttctggaagaaattcggttgtcatgcacaaaacttgcgtagtactactagtactagctgtggaagcttaggaaacgaggaaagagatcaatgctgagtacagcttgcagttttctttgaaagatccggaatagaaggaagcgtgtcttcggtttgtctctctacatgctccgcgtgtcacatactcacatggcctaaaccgatgacgtggtaataaaccggtagtaataatactggtagcatttctgtctgtctgtacactcccaacttgcatcctatcctcgtgttaaaagtcacagtcaccatgcggtactacaggaagcacagcctgatgactctgatcaatagccgtcactactcactacaaccacaatatggttgaaaagtaggtaataagacataaatacatctctattatcgggtaataaacattgtggcaaggggtaacaactgctatccggttttagtactactaccggtagcaagaaaataaaaaaataatagatgtgcaacattttcatggggtaagcaattatgttatatagaaaatgtatagttttttcagtggccccaccttactacctctggcagacaaaatatacatagtgaactctctatgtcactgctacctcctgttacatgggcctatgctaatgcccacttgagccagatacatttggcatgccctaacgaataaaaagggtcattaccgagcccattcctggcctcctgatgctgtcaacctcacttccccatcacgatcatgaggcaaagatcggatcgcattacgaatctctccccaaacccaaatgtccaccaccacccacgcgaggatagaaagataatccgactagttccatactcccaatcttgaacattagaccttccattccgttcattcccacatcaatcaatctatcccgactcccgtgctggattggcgtgccgcgcgcccaccggccgcaccacatcagagagaccagaaaaatccgaatccccggtcagcgacggccaaagccaaagccaaaccataatccgcgccgcgccgcgcctgaaacgcgcacgaaaaaacttctgggaatccgagcgcgaccgattaggggaggtcaccagtccaccaccagcgcgcggccactagcgccgcgctcggaccggcacccacgcggccacgcacgcgcgcgcgcggggtcacgcgccggacacatgccgtgcggcgccccttccccctccgctccggctcgccacctcctcctctccgccgccgccgccgccgccgcctcggtgttgtctcgctctcccgccgcgtggcggcgcggcgcgcgatcgatcgcgcgggagaaaccctagctctacagtggaggggggggggggtattaactaacggctttaatattgggaggggctcgatgcagaaccacgcgtacaaccggctgggg

SEQ ID NO: 13033 - DNA, 1501 bp, Oryza sativa
acgaggctggagtaggacaccaggaacggccactgcacggcgcgcgaccgcggcggcacgccggtgagcagcgccagcgtgagcagcatcgagctcccgaacccggcccagctcgccgccatgaacagccagtaccgccgccggtgcttgtcccgcatgatcgggtcgccggcgccgtcgtcctgccagtaccctcccgggatgttcgtccccagctggtacgtcagcgccgtgatcagcgtcgccaccaccagcagcgtgtcgttcttgttcgccccgaaccccggcgcgtgactgcggccgccgcccgccgccgccggcggcgacactgccgttctcccgccggtggttgtcgcccagctccccgccgacctccgccaggtggccggcgcggccgtcctcaactgctccggcgtccatcttacctcaccacgccggcccctaactcaatgtccagctgcaaagcttaattagatcggagaaagaacagtaaaatttttgcagcaatttagacgaagccaatacttcttgtctactaagatcttcttttctactcctatcttgtgttcttgttttcaaacatgctgagtgcatatgcacacaaacacacgcaccgccatatatagaggagaaatttcatagttaaatcacgtactttcttgatcgctgccaatcggtttgggaggtaatttctctgaaggagatgggaagcacagcacggagttgctagtccactcaagtcttctgtccgacgaccttgagctccgtggatatcgcgcgttcaggtaaaaaggacctggagctctggtccgatcgggcgaagactgaactattcagtctctcctcgtcaacgccaagtccacgtggagtctactacatgctgggttctgcttatcatattaatccatttttaaagtattttaaatcataccgaatgcaagttccgttttccactctacctcctcccgaacacactcgtacggctgcgtttgttgcaccagactgagagaggaaaaaatatatctgttttctgttttcccgcactgacgcttatgctaaacgatgtgtttttttataaaattcttttaagagaattagtttaaaaaaggagaacagctactttagtccctaaaatttctttatagaatcagtttagtcctaaccttttaaatagtctaaagaaatccttaaactttgtcataaggcctagaatactccttaggtccaccaaaatcatcatatggatatgccatgtcatcattcatgcaaaatctatgatgaattgtctaatttaaccttatgtatatcatagaaaaataaatataaaagtgaattagacatagccataggaaaaaaatactctttttttcaccctttagaggtatatttttgctcttacatataccatgtattttttttaactttttccttttgttttttattttcctgtgcgtaagggtaaattggacaaatcatatagattttgcataggaatgtgaca

SEQ ID NO: 13034 - DNA, 1501 bp, Oryza sativa
ttggacttggagttgtaataggtgttaggggtagagttagagtcggactctgtaacctgtcatctctcttaaatagagagggggcaccacaatgtaatcatggcgactacaatgtagcgtagacacgcagggagatgatggcggcatggccatggactcgtagcggctaggagctatattggttggggaggagcgcccataatcagagccccggggatgtaggcttcggctgaacctcgttaacaaatatcgtgtgttcctgtgtcgtcatctggcatgtcttgggtgattaatgattgaagcgatcgagaaggttagtcgtcgttccgctatatcggctaacttttataacaagtggtatcagagcagaaggtttcaacattggatcaagaagacatgtggaggaggaaacacgaggtgggggtcgcgcatcgacaggagatcgtcagccgtggcgatgagatcgatggcgacaacgaggacgttgcggaggtgacaacctcgctcgcgatcagaccggcgatggcggaacttgaccggaagacggggccgagcgtggccgaaggcgaccggagagatcggaggggtagcgccatggacggcgcgcccgacgcacgcggcgaacgcggcagggaggccagtgacggaagggcgaagccggcgagcgtggcacggcgcggcggacgtgcaaggccgatgacgacgggatcgtggacggaaaacatgagggctgcgactgcggtgcgtgcagaggcacgaacgacacgtatgtgtacgtgtcacatgcatacagtacgcgtacagatggtggccaagagcaagagatatgcacgagttgttgcaagcatgcaggatattaattccatgcatggattaattagttgcatcttaatgcatgagtgcatacgatttcaattggatttgtgtgggacacgtacaagctgcgtgcatgcatgggcatgcagaacagacgacgtggattgctgccgtgagagaagatgtgaggagaagtcaaacatcaaaggcctaattccgtgtgggagctggtcaggagaccgtttctgataaggcacgaaattatgtcatcgacgcggactcggcttgacgtgtccatccggactcgaagtcgatctggactcggtatcccggtggctgatgctatttaaggagcggtcaggacgtgaacctatggcagaaaaggcgacgggcaattgatcgagacactcgtaagcttaccacggaaggcacaaatctgggctcaaggcaagatcgtacagcaggcgtacaggtgtgtgcaaaccggacagaaccaaaagcaggacggagaaaaaccgtgaagcagattagttggatcggtgcggcggcggacaggtggtttgctgttgaatgtctgagatcggatcacaagacgggattgtgaagacgaatacggacggttctgagaagggcgagtattctggtggcgacagaccagtcaggtcgcgggttggcaagatggcgc

SEQ ID NO: 13035 - DNA, 1501 bp, Oryza sativa
catcttctctcacggcagcaatccacgtcgtctgttctgcatgcccatgcatgcacgcagcttgtacgtgtcccacacaaatccaattgaaatcgtatgcactcatgcattaagatgcaactaattaatccatgcatggaattaatatcctgcatgcttgcaacaactcgtgcatatctcttgctcttggccaccatctgtacgcgtactgtatgcatgtgacacgtacacatacgtgtcgttcgtgcctctgcacgcaccgcagtcgcagccctcatgttttccgtccacgatcccgtcgtcatcggccttgcacgtccgccgcgccgtgccacgctcgccggcttcgcccttccgtcactggcctccctgccgcgttcgccgcgtgcgtcgggcgcgccgtccatggcgctacccctccgatctctccggtcgccttcggccacgctcggccccgtcttccggtcaagttccgccatcgccggtctgatcgcgagcgaggttgtcacctccgcaacgtcctcgttgtcgccatcgatctcatcgccacggctgacgatctcctgtcgatgcgcgacccccacctcgtgtttcctcctccacatgtcttcttgatccaatgttgaaaccttctgctctgataccacttgttataaaagttagccgatatagcggaacgacgactaaccttctcgatcgcttcaatcattaatcacccaagacatgccagatgacgacacaggaacacacgatatttgttaacgaggttcagccgaagcctacatccccggggctctgattatgggcgctcctccccaaccaatatagctcctagccgctacgagtccatggccatgccgccatcatctccctgcgtgtctacgctacattgtagtcgccatgattacattgtggtgccccctctctatttaagagagatgacaggttacagagtccgactctaactctacccctaacacctattacaactccaagtccaaccgtaaccaaataggactagtatattcgacacctattctaacaattcttaatctttgtgccctcaaaataagccttatattttgaaacagttggggggggggtactagctaaatgcaggtggctttgcaacagataaaaataaatgcatgtcttattggtacaaaatgtagttcatagttggtgggtggcagattcactgtcaccaccgctacactgtcttccttcagaaggagtacagatttgtgggttagtttcaaggtttgactgcatgaccaatgtgcgtacccgcattattatttcttgcactgcactgtactctctgatgatgacatatgccactgaactataatatttctctgaacacttctctgtaaggaaacgtagcaaaaaagttcatgccacattctgcagaattttacgaacttcacttttgcttgcactcctgactcctctgtttactttaaaaataactatacactatccatttattcaaaacagg

SEQ ID NO: 13036 - DNA, 1501 bp, Oryza sativa
ttccaatgatggtttggacggcggtttcagctgacgtgatgtctatgtggctaatttgactcggtcttcatctgacgtggcattgacatggcgcttacgtggcagtttggtttggcaaataatataatcgtgaccctacatgttagtgtcgatggggatactcgtagaccagatgaatagagtattggggtacgttggtacaaggatttatacgatatgacatcaagcaaacaagaaaacaaggattatactaattcgggccttcgtaaggtagaagccttaatctagtttatatgagatagatatggaaataccacatattacaataaagaaccgacgatcctgatattaccggcgagatcccttgtcgagatggtttcgatgagatctcccggcaagtaggcttcacgtcctccggattgtaggctatggcgattgtgtttggcactatgattcaatgatctgaacccctctaagtggtgtgccttttataccctgagtcatcttagtctcaaagtagaactcgaagacaacagaccctacactatatagtatcaacccaatcctctttgagtaggactctaacattcctcttcttgtgaggataatttccataacagcttgtgaatttccttattgtatacggaaatacatcatatatacaaaggtatgccgtatccgcatattcgataagtcgtaggatttgaggaatactttatttttaaccatgatagttagttacacccaaaaaaaaataaaaatggtggggcccacgggggctccctctttcctcctctcccctctcttcatcggtgatggtgagtctacgacattcgaccggtgcgtgaggccctcggcttgcccgagtgagtcgaacccgccgatgaacgctgcggctggcgggaaaggaatggcgcgtaacggccatcggtggcagagcgtcggaggaggatcacgtcgacgtcggatgccgcgacgtcggggctccaggttaggtcgacgaagggcagcgactcccagcagccccaccatgcacatgagagcaccgaggtgcgaaccacctcgtagatgtgaaggcggtcgatgatgttgtcgaggacttcgacgtggagcgcacccagcgcatccggcggcaactccgccttcaccgccgctagctgcctcttctaggtgggcagggaggctaccatttcttagtgcttttcccaaattcgcgtgcgtgcgtccccgtcttaccctgcgtgctttgcttcctcccttccagaaaccctcttccgcctccatcaccacgaagcctgcaatccatggaggtcgacggcgtagcccgccccttcctcctcttctccaagcccaagtccagcaagaagaaacccaagcaagaagctgagccccagctagaacccctaaaccctagctccgcgtcatggagcccgaacattgtgactccaactaggccctactgtcgtggccaccaccgccgccgcggaatccgctatggtgc

SEQ ID NO: 13037 - DNA, 1423 bp, Oryza sativa
aattgataatcaaagattttaaagtttgacctcacccttgtccaaaacgacaagtattatcagcccagagggagtagcttctgatagataatttgactagaccacagaatcagtaacaagaaaaatttgattgtattaaatatgcaggaactgtaggacgtagctcatggcagttgcccagcagcccaggtagttatagcaaagtgtaattgaacatataaactgtcccatattcatgaatcatgattcaagttacgactttagtgaaatacatgcaggcaatagaaatgaggctcttttaatatacgaagaactaatttacaggatgaatatatctgaagaaaccatgtaattgccatatcatttgtgaagatgaccgtggaacaattctgaaaacaatctttcaaacccaccaactacagctacaattgacacagattgggcaacaaaactagaaaccacatggacacttctttattccaatcatggcatttagataataaacgccaaaagaacatggttcagtatttgcagaataaaggactcccttaaatgcacggcttacctgaagatgcataagatctactattctactctattagtaagtgagatcagatgggattcatttgccagctgaatatgtcaacttctacaagattcagtcataatctcacagcaaaacatgcgtttaaacacattaaaagtgcaaattacaaaagtctggtcatctatgcgtaccagaagtcccctagccgagtcaagaagaatgaatgccagttgatctcaaaggacacagccgtcatgtagttgaaccagcgtttccaatcgtccacactggtaatcgacccagatgggaggtcgagcacatatgcgctgttagggtccgaaaggtagagggtgagcatggtgccactctcctcccctatgcacacagtggaaagcgactccgttccaaacaaccccatcttcacgccaacacaaatcgattgggtgcaattccagagcaaacgaccactctcctgtgtttctagcttggtccaaatatgaagtttgttgtcacaaagataaagaagcgaaagcctctcgtcgacgcttacgtacaaccaagattggtggaagacagtggggggaggatcaattgggatattggttgcgccgatgttgtctgtgtcaatgctcacatcaagggtgtagaggctttcttctccccaactgaagagccagtgtgcgccgccatggctgacagctgcaactctgtttccagagggaccccagacatagccccggatttgttcagagcaatttctgggcgtgctccaggatatctcaaaaatgaccgccgccgcggcggcactggcagcggctgaggagaatctgtggaggtatacctgatggttgccatggtggatgctgaggaggagca

SEQ ID NO: 13038 - DNA, 1501 bp, Oryza sativa
cctgcggcgccgccgccgacgtggggtggtggtggaggaggggaggtggtggtggcggagttgatggagtgttgcaggtgcttgaaatcttttgctccctacgtttttaaatatttaatactctttgatttttctaaaaaaaaatatttaaccgctcattttattttttaaaaaattaattattaattttgttcctatcatttcattcatttacttatatttattaaatatacttatatgtatactacatatagttttacatatttcacaaaaatttttaataaaacaaatatttaaacatataattaaaaagttaacggcgttaaatgggggatttcttcatctcattcgtcttctttgacccactatcatcgattggatctcctcttttatgtgtcgtcgcttgactcgcatctattgttgcagggagatggaggaagggcagagggcgtgggcggcgcacaggaaggaggcggcgtggaggatgaagagggtggagatgcagctggagacggagagggcgtgccggcggcgggaggcgacggaggagttcgaggcgaagatgagggcgctgagggaggagcaggcagctgcggtggagcgggtggaggcggagtaccgggagaagatggccggcctccgccgcgacgcggaggccaaggagcagaagatggcggagcagtgggcggccaagcacgcccgcctcgccaagttcctcgaccaggtcgccgcctgccgccgctggccgcccgtagagatcaacggcggcggcggcggcggccccggcggcggccggtgagccgccggacggtggcgctgcatgcatgcgtagttggacacctcgctttcttgcttcttcttctcgtgtcctttttacaactgttggaattcacttctctctagaaatatgtaatcttttgagtctcttttgatcattccaagtttcctactagtagctctattgaataataaatggaccaccaaattgcaaaccaaaatggttacaaaagaatatcttgagcagcagtagattgcaatggaaataagtttttttactctgtggttttgtgttgggatagtgcatgggccaaatgagtcgcatcacgatgaaatggttctgtaggatctttgaaacaaaatttctcgcaacaacactatctgcaacgaattcgaataagattcagtggaattgaaccagacgattgtttttaaagcgcctttggaatacaggaattttttggcatagttgaattctcgtgaaattccagcaaactttcttcattccaacgacggtcttatgtttatttttttacatgcacaagcatatcagggagtaataagcaagagaaaataacaacataagttacaaaatccattttctagttttaatataggtcataataaaacgagttacctgctaggcagggaaataaagaatgggacaaaacatcataatctagtatataggagtataatagaacaacttgaacatggtaaggtg

SEQ ID NO: 13039 - DNA, 1501 bp, Oryza sativa
gggaacaaagcgcggagcagcgggattaggggggacgggttttcaacaccgtcaccgcaacgtgccgccatgtgctgcagcaacgcggcgggacacatcacgtggacatgggcctaaaccgggacgcgacccacgccatcaatcggttggtggctcgcggtttgtcacccggccggttccacccgactcttgaactctccccgctaatcgcgctgcaccaaccagcccgatttaatttgaccgcggtgtcaactatcataccatgttcttttttcataacagctataaatagtactagtatatagtgtccacgtggattaaattaagtgactggagaaattaactaacttgtgcatgcatggtgtgtttggtacgcagggacttgacccgatgctgacggcgagcctgttcgcggacgcggtgtgcatcggcgagaggagcgtggacggcgaggactgcttcgtgctcaaggtggaggcggaggcgtcgagcctgcgggcgcgcaacagcagcagcgtggagatcatccggcacacggtgtgggggtacttcagccagcggacgggcctgctggtgcagctggaggactcgcacctgctgcagatcaagtcgagcggacacggcagcgtcttctgggagaccaccatggagtcgcacctccacgactaccgcgccgtcgacggcgtcaacatcgcgcacgccggccgcaccgccgtctcgctcgtccgcttcggggacagcagcgacggcaacacgcggacgcgaatggaggaggtgtggaacatcgaggaggtcgacttcaacatctggggactctccatggactgcttcctgccgcccagcgacctcaaggatagcaaggaggacaaggacgtctccgccgccgtcaagcccgcgcggccgccgccgataaggataccggcggtggccgtccgcgtcgggccatcgcaggtcgccgccgtcaacatggacgattccgactcgctcattgcgaggtcatgacatacatagcgggcagtgttacaccgtatgagtcgtgtgtgtttacgtgccttatcgccataagttacttatggtaagatctgtaaatatattgcaggttgagatatttttgttttcggggagtggattttacctcagatagatgctcaggggtgagtagtaaagcgagtaatccgggatagatgttctaattagcggtattgtaatttgcttatgacgccccttcactgtaaagttgaaagaatctccagttctgctagtcacacactgggcttcagcatgttttccacttctcctgaacatacttgtgctacaggtggctgcaatccaaaacgcacataacttgctgcaagtgttttcaagagtaaaaacttaagcctcagtcctcagattaacacaatgcagttccaggctttcagcccccagaacatgtacagagagtggcacaaacgtatcacaacatcggtgccatttctgcaaggggttgagtgacagaagc

SEQ ID NO: 13040 - DNA, 1501 bp, Oryza sativa; identical to SEQ ID NO: 13039

SEQ ID NO: 13041 - DNA, 1501 bp, Oryza sativa
gtattgtttgtgtttgccgggccatcatagaaagtgcctggtgatctctgggacttgatggcaaatgttgggcaaattgtgatcgaataagattagtactagagttatcgtgtaataaggacatgcatggactaccatgtatttcatgttatgacgctcctaagagccacagaccacagcgatggtattagaccccttctcagaatggttctgctcattttcggcttcgatcgtggtacgcgttcgtgtcttcgtgtgatcggaaaaaaaatatttgccgtttacaagtgatagtttttcagtggatgtaatttgtgcgaaataccatcgtacaaacgttttgttctttttcatcatagtcattagcctttcatgaatagtactcacatttataaggccgatggtgttgtcctataaagaaaaaaaatgtaccagtaagtagggtggctaacgagccaactcggctcggctcgtaaaaactcgttaaattaacgagctagcttggctcgactcattaacataacaagtaaaaaactgaacttgactcgactcgttaaaaagtctgagttggctcattaaactcactaaactcgttgcaccaaaatacatgatttaaaattcatatacaatataatttgttggcctatgaccaaagattacgattgacatgttatgcatcatgactcataagattgtgctacaatggataattatgaatttacgacctttacacctgtaaatatatagacaattaacttctattttaatgcatcacgagctcaacgagctaaccgagtaagtcacgagctagctcgagttgactcattaagcaaatgagtaaaagtttaaactcaacctgagtcgagccgagttttacaacaagttgagttagctcatgagtttcgagtttttttccaccccgtcagattgaagtgagtaaattcctagaatgaacgttatttattgggaaaaaaagatactttactcaattgtaggaagaaatcggtttgaatagtagatgctatccagccacttttaaaaaacggatagcgtcgataggataattttgagatagttttggagataaaaaaaagaatacagtaaggctactattcaatgaaaatgaaaacaatcagaaacttaggatgataatttcctgaaacaaaaacctagcccatatcatctctaactttaggactatatttttagtccaatttttttttatttttggaaacatggtaacttggtaagtatagcttgtatagtactcctatgttaatatttactagtcgactggtaaggtataaaagaaggataaagcaatgtttgggctgaatccgcaacgaagtgggcttgggcccaaaaatagccgctactggtaaaaaccaaccgacctgagccgcaccgtgtacaaatcgagggaggagagggcacacaccgcatacgagcaggacagcacaggtcgagactcgagaggcggcgagaccgagcggggacgcca

SEQ ID NO: 13042 - DNA, 1501 bp, Oryza sativa
cattattggtgcgggtgagagcgactcggtcgggtgtttttagaatataggcgttgctattatccgtccaattccacttcgttttcatctagaagttgtggtaagttggagatccttgtgttgaacaccgaagaaaagaagaaagctagtgccacggtcccccgtcgtaggggaacatgagactactgatcgacatgccggcgccgggcgtgatcccatcgtgtgctgacttgattgcagagaataaaaatgcggaggattgatttttcccgtcctcatgggttggtgaatggtgacgacagggagctggtccaagacaaaggagcatctggcattcatcatcgtctttatctggaacagcagatcgtgcagtctcgtggctcctacgctgtcctactactacaagctgtagacagacaccatggtcaggatggtacagttgggcccagcggaatgcttccattttaggtgcaacaagcatctccacttctcaaattctcagccaacgacaggcttgcattgagctttcgtagaaatcaagacaaacaaagatcgggtttatattcaggaaatggcgtgcaaggttgcttaaccgcggatgcttgttttctttcggtcgcttttctccgctattgtcgtcgaagcaattctctcgtctccacatcgttccgtgggtggaaaaccagcggtgctaatcaggattcaagatctggagtggagaataaagaaagagactggcgagctgtgttgcaacttgctctagcattttgtactcgttgatgctgctgcatttttttcggtgataattaaacacggatgtcttgcacggttgagcttggctatatgaatcctgcaactgcaactacacagcaatagtctggcaaaatagaagagaagtgatcatagaggcgaacatctgtgtgtgaatacgggtgcctgaaaccctgaatttcccagcaggtatcaagcaatatgaagggacaaaacatggattttgcaacttccccttcaacgacaacgataactgaacaagttgctccgagtccacaagtccacaacgaatcaacactttgtttggtcatttgacaccccgacacaatcaaagaatcgcatgcggtccgagctggaaaactttgtttggtcggttgcgtttttcgcagattcgcagagcatcgccgtagcagcgaaggcgaagtgggactactgcaaatctttgtttcaccattgctgtcagctgatgagctttcggcgtcagatccaaggtacaaactggaaagcccaatctcgccagaatattgagacgtaataagtccacttcgactcccttaatataggtttaatctgattcatatctttgaaactgaactgcataccagatattttgatccataaactccgatgtaatttaactctctcgactgttttgaaagacggttttgctgatgtggcgctttgacttggtccaatccactgagtcatcatgtggagcctacccgccagc

SEQ ID NO: 13043 - DNA, 1501 bp, Oryza sativa
ggttagcaagcctttagataatcatccattggactaatacatgtgttcaacacttaactagctcatttgtactttaattattgctggaggtaggccataagatttttttagctggcatgcatcatcatatggtaatgaagcataatggagcatggcgaagccatgagaagcatagcgagacatggcagagcgaagcgaaatgcaacaaagcagagccaagtaagcctgccaatgggctggattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaacctagcgtcatcagtcgtccacggctccactccttccaccgccgccgctccctccccttgcttcgcctcctccacctctccgccaccgtccgcgaatccgccgccaagccgtcgccggtcagattccctcccccaccaccattgcttttctttttccctggtttttctcggtctttgatctatcctggttgttttgtttgtatttttttttgggtctcttcctgatcttggtggttgcaagtgcaggtgaagcagaagaagaggaaggtgcgtgcgccgccgggcgttggcgaggatgtcctcctccggtggtccggccgcgtcgccaatctccctgagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgaaaattatttaacatatcattacaaattgagtcctgatatgattttgagatgcaaattaattctatggtcaatcgaattttagtgtgcaatttttagattgtagcacgtgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattggcagccaccaaaaagtcaggaacaagtcaccttattaatcacatagccgaatcatgtccagctattgatggtgatgctagaatcaacttccttgcaacaattaagaaacagactggggaaggtttcgtgtttgttcccaaga

SEQ ID NO: 13044 - DNA, 1501 bp, Oryza sativa
ctttgtgcacttgcatatttgctgtgtggcttgctgagtatgtcatatgctcattcttgcaataatcgatcaacctcagttgaagaaaaagaattcagaaggagaagacgtttggcttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcaatttgtgtacctcggttgattcctggacgaggattttatgcacaaataagttcggaaattactagtgaatttccgggcgtgacattcggggcgtgacaaaaccaaaatagaagaaaaccgaacaggacaaggagaacattattccggtctattggtgaatctccatccataattagaaaaaagttgcataaccgtcgtttcaagcctacgatatgcaacaatcaggaactctccatcttcattacatttatgtaattgtgcccactaccggagctaatatattgctctgaaaattacctgcaagctgtcaagccagacccacccgttttcgtagcgtcctccgaacaacagtctcgtgcttgtacaatgcggagctgaccctccccatcaaatccagtcgaatctttcttaatctccaaaatttggttgagtgttttttatccactcgatctcctatttccgtttcccctaatcaacgcgaatcagcaaaaataaaaacaacccgaggaagctcgtcggctccatcttttgctttctagatcgttcaacaccagcgcacgtgcggtgtgcaggattggtcgaggcctcgaggagggagatcgagagggaggaattcttctctctctctctttcatttggagatgtcgatggatttttatccctcgaggggatatcctctcattttgtacatatcatttaaaaaggcattaatttttttaaaaaaaatattaagataaataaatatatgatatatctttcggcaaacatgcaagttaaatctcatcttatacaattcgaaacaaaaataataaatttaactgcgaattacgtgttatattcaatatcaaatttgttgttttttttctaattgtataatttgaatttgaacatgcatatttgtgaagtgatatatcacatattgatctatcttgatttttttaaaaaaaatttgatgactttttaagctacatgaaaaatgaggggatattcccttaagagatgattagtgtttcccttttctgttatacgtgtgttgcatgccgcgtattatgctgctttcttttcgtgtttcctccggacacctcttacttacgacatggaaacaaatctctgttactataaatcatggaatacgtacatgtatattgatgagtttttgcttcagtttcaccagccataccctctatcaggaaaaaaacaccaagaagaggagtaaattgagatcgaattca

SEQ ID NO: 13045 - DNA, 1501 bp, Oryza sativa
aaatcgtgggtccacatgtcagctacacataaaaaataattttaaaatggtggcccccgtgggcccacatgttagctataaaaaaaatatggtggggcccacgtgggccccacattccctctccctctcggctctccctcctcttccctatcctacttctcttttccccacgtggacggagcggtggccagcggcggcacgacagcggtcggagcggcggcgcgcgaagccggcgggggcaacggcggcacgacggcggccggagcggcggcgcgcgaagctggcgggacaacggcggcacgacggcggtcggagcggcggcggagagcccgcgggagtcgaggtcgtccggggaagcagtggcggcgcccttggatctcggcagcgaggacgctcagaatgaggcagccttggatccgaggaagcagctgcggcgggcctcgggcaaagcgtggcgcggcggccgatggcagaggagcggcccgtggcggccgacgggagaggagggagcggcggccggagctgcacgacttcggacccgccgccgccgactcctccttcgcgtgccgccgtctccgcctccgcctccctctccgccggcttcgcgccgctccgccgtcccttcctcttgtggccacagccgccgcgccgctccctcctctttgcgcgcggcgatggaggcggcggcgatggatggcgacgacatcttggcgcgtgttgtggcgacgatggggaagatgagagagagccgagaggagatagggaatgacatgtggggcccacgtggggtttttgttgtgtagctgacatgtgggcccacatgggccccaccatttttaaataattttttatatgcagctgacatgtggggccacgctttttattatttttccgagatataattgccacgtaagcgccacgtcaatgccacgtgcgacggagacctagtcaaacaaaccacgtatgcgccacgtcatccaaaaccgccttcaaaaccgccgagggaccacgtttatccggtttttgtaagttgggggacgggtcatacccggttttacggtcaagggacgaaaatcggactcggcgacaaatagagggacccaaagtgaacttattccgccgggttatgctagttcgaatccctggcctttataggccgggctgtagcccgtacaggcggtacacgtggcttagtggggcccacggcgcgacctgccacgtgtcgcgcctcgattcgcgagatcccagacgccaatcccccatcggacggtccagggacgcacgtaccgttcattcgctgagccgttgggcccacctgtcagaatcatcccctccacctaaatcaccgcctcctcccgaaacccccacgcggtagtatcgcgcatccccaaccccaacccctccccgccttgcgccgccgccgccgccgccaccggcgccggcgatcctccgatgggcgcctcggcctccgtcctctcccttcccacggcggccgccatcc

SEQ ID NO: 13046 - DNA, 1501 bp, Oryza sativa
agcatggcgtcgccgacccgcggctgcccgaaggtgtacacgccggcgagccggtccagcgccgccttctccttgtggtacgccagcaccgtcgcgaacagcaccgccagcgcgccgccggagccatgcccggcgaccagcaccctcgccctgccgttcgcctccagcagccgcttcacggcgtcgcggatggcgtagtaggcgtgcacccgctgcggcttgcccttcacgtgctccacccacttgggccacccgatgttccgctgcgcgcccagcgcgtgcgtgtacgccgcgtgcgcgcgccccagccgcgggatcttgtaccacgacgggtccacgtcggcgcaccaccgcgccacgtccagcgccggcgtgccccggaacgccaccaccaccagctccgcgtccgccgccttgtcgcagaacacgaacgcctgcgccgtgtacgcgttctcgaactctgcacaatacaacaaacaccacacgcataacatcaaacacgttgcgtgcgtgcgccggtgcgcgcatggagctgtacagaacctgtccttgatgctgtgcttaccgttccagcagttgaagaactggacgaactccatctgccagcggcgggtgacgacgtcgcggatgaacgcctcgttctcgtacgccaccttggacgccatgacgcagagcgcggcgtggtaccggctgtccgccggcgtgatgctcctctccagatcaaccctcgggtcgatgagcccggtgattgatcggtacgacgccgacttccgatcaggatactccattctccctgcaccaacacacaattagggttaactatccgagacatccatgcaagctagtgtcaccactgaccatggaggacgttgctggcgaggttgagggcgaactcgagcgcgccgccgaggacggcgacgagggggccgactagcgagaggaggaagagctgcaggaggaggttgaggaagatggagaggcggcgccggaagctgtggagctcggtgctggtgaagcagtcgacggccttgttccggccgaccttgggggagaagaggaggtgcaggagctcgtacgcgccggccctgtcagggcgcagcaccatgtagtcattgctgaagcagtagtcgagcttgctcatggcggcgagaactcgatcgatcgattgctagtagagctcgtcgtcgtcaatggctatggatgacaagtcgacgacgacgacgacgacgactccagatatctatctagcattctcgctacctctccgctatgcaggccgagtaaaataaattaaatggcgttcacaaaataaagctgtggactgtaacattttttcggatgagtagccatgactgattagaagatctctgaaatctgaaaaaaaaatgttcacatatttcattggctctggagcatctcttctcgtatgttcgatggatatcttgcgacaatttgtttgtggtttactgtagactagttttttgtggcagtgagatagtca

SEQ ID NO: 13047 - DNA, 1501 bp, Oryza sativa
gtagatctcgagatttggggagttttggaagttgaacggagtcaaacggatttacggtggggaagatattgaatttctaagattattggatttttggtctaaaggaaaatgatttaattaaatcctttttggaagagataaagagaagaaaaagggagagggagggaatataaacttccctcgggcggctagggcgcggcccgagagaaagggcagctcggccgagcttaacgggccggccggcccaaaaaggcggcccagagcggcccaagacgcgcgcgcgcggaggaaggagagagagtccggtggaccgggctcaccacgcgcggtcccgggtgggacccgcttgtcagcggctcggctcaccgtgcggcgggagcacgcggcgcggcgctagggtggaggatggacgtggtgcacgcacgcggttcgcggtggacgcaggtgcggcgggcccacgcgcaacctcacggctcgcggtggaacgcgcgcacggggagggactgaccggggtcggcccgtcccgacctcggctgagctggcgccgacgtggcgcctacgtggctgccacgtgggctggcgggaggtagacgacgacccagccgcgaatggacggcgtgcggcggcggcgagcggcagagcgaaccacggcgatacgggcgaaagcgagcacaccgggcggttgtttgtgatgaggggagggagagagggagagagggagcgcgccgggggagagagagcgagagagagagagagagagagcgcgccggggagaggagagggccgggggagaggagaagatgggccgagagaatttcggcccatcaaccccgggggaggcaaaatagacttttgcggaggaatttgatttggagggatttggattcggaattgaactcgacgatagatcggggattgagatcttgagatggcacggacactagacaacaagcaaagaaacaaatttcgcaattagggtttttaggagataattttcccgctaggcgccacgacggaacgggcgctacaggtttggtgtgtttcgctttattttagactacactcttttagagtgcttcttttagagtgctagattgtaataattggctgtagctcttttgagcaaatgtcaggatgtttcattccattatcttaaaaaaaatagcgtggtatcactggaaaaaaatacctttacctattgcaatgcacggatatttttttttgtaacatcatatatagaagtcgcatgaaaaaaactggaaatagctagctgtttaagtcttgtgtattgaacatgtctttgagtagtaaatctgtatgggacaccagctgctcgcggacagggtgcgaacacgagatgacttaatttgggtggcacgttagcaccaaatcgatacatatgtaattttgggacttacattgtaaatacactaaaattacatatataatttagggacttacaatgtaaatatatgccgactattttttgatgaaaaatatg

SEQ ID NO: 13048 - DNA, 1501 bp, Oryza sativa
atcgatcgatgcgatgccacctcactccgatggagccaccaccagcaacagctgcagttagccatggatgatatgatccattggaagagtagctagctagctgctgctgctgctactcctagctgaggtgatgaggtcctccgttctgtacgtacctgtccatgagatcacatctcatgaatgggaaccgtccggcccggccggcgcccccggcgtcacggagcgtacgctccatcggcgcaagcgccatgtacgtacaccacacaacacccccccccccccccttctagctacaaccttcttcagttctccatcccccacatgctacaagctactacatgccactagttgcacatacctgcactgcatttgcgcgcgtgcgatcatatttatgatgtacatatgcgtcagatattttgtttaggttcgtactaataagatatgttatattcatattatgttgttttattttggaataaagcgagtatgctactaaggccttgtttaagttcccaaaacaaaaaatttttcacccatcacatcaaatgtttggatacatacatggagtactaaatgtggggaaaaaaccaattacacagtttgcgtgtaaattgcgagacgaatcttttaaatctaattgcgccatgatttgataatatggtgctacagtaaattttgctagtgacggattaattaggcttaataaattcatctcctagttttctggcagaatctataatttactttgttattagactgcgtttaatacttcaaatatgtatccgtatatccgatgtgataaccaaacccaaaaattttcccccaactaagcaaggcctaaccctggccggtcgatatccatatatcatggatcgatcagcctgttgcattgttcaaggcgcacacatgctatagtgacgtaccatacgttgaaacaaccactactactaccactacgcctaatatacggatggaagcaatggaaaaacggtggccaagcataaagcgggagcagcagaggccgcagcagcagcagcagctatcaccccctcaccaactccaattaagatagctcccggccaccccaacccaagcccttctcttctctctccctcttctggtttggtttgttgctggccctagcatcagcgagagaggccagaggcagacaggcagctgctgctagatatagctagccggcaacgcactccacatccagccgccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccattcctagtcctttccgtgtgtgtgcgactgcgtgagtagtgagggatagataaaggagggaggaggagacaggccgcgagga

SEQ ID NO: 13049 - DNA, 1501 bp, Oryza sativa
gagacgaggactagcatgcagtacctctgtttgattgcaatagcctgtacaagcatccagaagtacggagtacttgtgattttcattgacaacttcagtctgcaacaaagagccagacggtagatgtcaccgaagtctctgaaaactaatttgaccagtgttgtcaccttttcctacagctttgggttcagcaatgcatgatagtatgtaccaaaactgtactccctctctttcaaaatataaggccatgtttagatgggactaaaactttaagtccctatcacatcgaatgtttgaacactaattataaatattaaacgtagactattaataaaacccatccataattttggactaattcgccagacgaatctattgagtctaattaatccataattagcctatgtgatgctacagtaaacattctctaattatagattaattaggcttaaaaaatttgtctcgcgaattagcttttatttatgtaattagttttataagtagtctatatttaatactctaaattagtgtctaaatatagagactaaagttaagtccctggatccaaacactacctaagtatttttagctataaataaaaataattgtatgtctagattcatagctaaaagttattatattttgggatggatgtagtatggcaaaagcaacatcttgcaatacgttagccacctagagccacagaaaataaaaggtgaacatttcgagtgtgcaacgaataaagatactgcatgtagaattgtgtttcacaactaaagttatctgagtaaagattttttttttctaaaacgaattcatgtcggttgtgtaacataaactcttttcttctaatatactgacgtacaatatttttacacattcgtgaaaaaaattaaaagtattcatgcagcaactgatgataggtactataaatttaaggattaggattcagagtatgactctgattgagccaacttcagtttaggtcccagcgtcttaaagaagcttccagtgcctggttcatcatatatcaaaaattttctggacttcagcatacccccgtgttgctacgtactattcaaaatagcaacaaatattacgctcttgttgaaaaaagagtaaaatccatcaccggtctctaaacttgtatcgatgtttcctcccggtccctaaactcgcaaatcgaccgtttagatcctcaaacttgttcgaccgtgtcatcccgatccctaaacttgcagatcactcgtttagatcctccaacttgttcagttgtgtcaccccgatctctaaacttggatttgaatatcatctgggttaaatagaacggtctaaagactttatatttaaaaataattcataactttttcatgtgaactctaatgaagataaactttatatcaaacttgtagccctcgacgcgatctacaactttgtagttaatttttttattttaagtcattttttgtcccaaaatgtaattttaaaattaaaatttcaa

SEQ ID NO: 13050 - DNA, 1501 bp, Oryza sativa
aatattaaaaaaataaaattgaaaatgaaaaaaaatccaattctagacgccatttgggccaactttcgcgtgcttggctcgatctaaggccgctgcttcacgtgacgcctaacatgcgagcacgctgcgtctctaactacgcgtactgttgcggcaacggcagctgtggttgcctgttgctgcaacagtggcaggtgcggaaaccgctgagattatgagccggttgatcgccggaacatgcatgttcgtccatgaactttgctggatttagcgtagtgtcagtaaagccgggacgtggggttgttgggcctgaatgggagcgaattgaaatgatttgctggatgatttttttttagggaagccatttggcgcgttttattgatatgaaaacacaattacatctttcactagaacgtttagcaagaagctagtggattacaagaactaattgagatgaaagcatatctagctggatgtttgctgtgttagctttaatctgggactgtcactctgaagatgcgcatcagctaattagtagttgatcatgaatgaatgcatgggccggttaggcaggtcgtccagtcctccttccaattagcatggcccaatttggatcggttctctaatttatgatgggcctaatttggctctgaataatattcacaatcaaattgctacggcccagacaagatctaaggaaagacctaatttggtgggagtgtgacattttgaatttaggatctctcattagagttggctatcctaattttggaataagttcactttagatccctctatttgtcgcccagtctgattttcgtccctgaaccgcaaaaccggatacgacccgtcccccaacttacgaaaaccgggcaaacgaggtccctcggcggttttgatatcggttttggctgacgtggcacctacatggctaatttgactcggtgtacatctgacgtggcgcttacgtgacaattcgatcccaaaaataataaaaactggacgtccacgtgtcagttaaaagaaactaaagatggtgggacccacgtgggtcctgcatgtcattctcaccctcctatcttccttctctctccccgcctcccggtacgacacggacacctcggcggcggcggcggtgccgccaacctgcacggctgcacctccaggtacgccactacgcctccagccaggctccagcacggccaccgtgtcctccagcaccttcacctggtccactgccgcctccacgatctcctccctgcccgctgcatccaaccattgacaagatcaaacgacgatctccctcgcagccattcgccaagaaacccgaggaagacgacgaggcgaccatcgcctccggttggcaagaaaccaacgaataagacaatgcgaccggccatcgccgccgttggccaagaagccagaggaagaaggcgacgacgatgacgagacattccctatcactgtcatgtttggcatgtgttctatgtttgtcttcatg

SEQ ID NO: 13051 - DNA, 1501 bp, Oryza sativa
ggctgcaggtgagctagccaacaaaagaaaaattcagctcgcggcgcgcgagaagcatctgcgaccgagtggtgcagcacgcaagaacgagtgttcgttcgtgtcagtgtcagtgatcatagcaaatctgaagtgtatgcggaggatgcatctgtcgtctccgtggacgcagcatatcccggtggcttttagcctcagattttgatgcggccgatcgctacatcagccataaaaaaaaatgcagctcttttttttctgaatattgagaagagactacttcaggttttgatcaggcttcagatttcagagttcaggtgaacgaacgtgtcatcctttctcattctcggctccaatcaatccatgccatgaatttatatttttcaaaattgaattcagttataattctgatcagctagtattttatttcactgtttccatcaaatttcccccttttgtagtatagaacatctctgaataatcctgaacgtttgtagtatataggacttctgaatactgaaccttcaaacatatatgggtgctatatatgactcatagcagcgaagcatctaggtagcgttatccttttcgggcattcgctacatcacataatcaaagcaacaaagttccaaaagcatataataattcaagtacgagcacggcgccaatctttctacgcttggcaaccacttcaaaagtagttagtgtcaccaatctgaatcagaattattcgaatcgtttcatacaaaactactcgagtcaattttgcaatcgttttcagtcattgtaaatgcccggcattgacccgtttttgagcttatactgcgaggtttttttactgttctttaggttgtgcagtaccaaattctaactgttgatctggcatcattcaacggtcagaaatcatccgtacctcatggtactgcacctccccattgaagcggtaccatgggcgggagggtatttctgtccttttgtttgtttcacgagagaaaaaaactcctcaggagagcagcagcgtgacggcaggctcgagggggacggcggtggcgcctggatgagcgacggcggcggtgggcggctggatgcgcgacaacagcggcggggtcgatgtgtgacggcggcggcggggtcgatgcgtgacggcggcggccggctggatgcacgacggcggcggcggcctcgatgggcgacgatggcaacgggctggatgcgcggcggcggcggcggcctcgatgcgcaacgacgtggctacctcgatgcgtgacgtccctggccggcacggatgatgaagagagaccttatttttgttagtccgatcgtaccgtgctaaatcaacggttagattacattggtacctcatgatatctcgtacctcatgataccttctcaaggataggaaagatgctcgtatattgcaagatgaaagtaatagcactacaactgtacaccggatagctcgatcggttatcctgaatcttggaacaaaaacaagtgactatct

SEQ ID NO: 13052 - DNA, 1501 bp, Oryza sativa
ctagctggacagggtggttacgtacgtaattatatatagggttagatcgtacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaaatcagtgtattgaaagcagttttggcttacgtggtactaaagttttcatctaaaaatgttcagattggagaccacatagccttgcaaaaacattataaagcaagaaattgtgtactacttctacttgattaggacttttgcctctactgaccaaggtttttgtttcttcgcgaggaggcgcagtagaataactggagaagcatcacaaatctgtatatacagcttgctcttttttgttcttttgcaaaatcttgatttacattatctacacttagatcatggttaaagctggactactggagttgagaacaaaggtaatcttgtcatggatatttatattttgcattagaacagaggcaatcttaccatttgggtgaaaaaaaagtgaatatacattttctaaatttatatttatatacatgtttgtggggggaattatgaaaatatacatgtttataaatgcagacgtgaaaatattacgcggcataatattgaacagattgaatccggttttaacaattgaggaattctctatatttgattttgcggttgaagaatacgaattaaaatgtgtctatatatgaggcatgtaaaatgaactttttttctggaaacaaatactgtcgttggacaaaacaaaggttgccgcacgtggatggcaatcacgtccacaccgcaagagccgtgggaaatcgtttcaaatgaagagctgtcatagatagacaatcatctgtgagactgtgatggctcttgatcctaatatatctcttacggtagatttaagcacccgtcacagatataattatttgtaacaactctctaagagagccatcattgataactctttttttttcatttttgttacatcaaataagttgatcatgcataatatccaaagacaaacccgttatgaaatgatcttacctcatcattttttatgc

SEQ ID NO: 13053 - DNA, 1501 bp, Oryza sativa
ctccctcggattcgtccggattcactcccgcgatcttcgccggcgcatcaatggcggccgagatttccgcggccgattccttcccctccggccgctctctctcactcccgacgctatataaacgttccccgtgcctccctcctccgtttccgccactcgccactctctctccccgttggattcgagcccgcgtcgtcgcaccttctctccgccgtcgccgccgagctccggttcgccgccgtcgtcgccccggacctcctcccgcttcggcatcgcctccttcggcttcgccgcgttctcgtcgacctcgtccacccctccgtttcgcccgccgaccgacggaacgccgccgtcctcgtcgacccgagccgcgccgccgccttcctccgctccggtcgtcgtttccgccgtcctcgtcgacccggggtgagccgtggaccgctcctttcgcttcccccttccccttctctctcgggcgccgctccgccgcgtcggtggtcgccggcggcgaccatcggggcgcgggcgcgccgcctcccgtcggccgtgccggcgaggccgcttccgggcgcgccccgcggctgccaggtgggcccggccgtcagccgcccgcgcccgcgggtgcggctgacgcgtgggacccatggcaccggccggcgtcagccgcgtgcacccggtccaccgtggaccgtgaggctgccgcgtgggccccactcccgtggacccggtctgcgcgccctctctcccggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttctgctttgtttctgctgttgtatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacccttgttatgaccttattattattgttattgttattattaccttgttcaccctaggataaacaaacctcaactagtggacactctactcatggcaccactagtttacttttaggtagatgcttcgcaatttaattaggtaacactaggtggttttccaactatagactttgggaaatattcatatcacctggatgctttggaatggtctggttattgtggaattggattcacaccgctccttctattcaaaatccccaaaatggttttaggctgggttcggggtgcatggttttgatagtagcacctcggccatataaggaccggt

SEQ ID NO: 13054 - DNA, 1501 bp, Oryza sativa
cctcattaagcttacgagaaatttggtgtactgaccggtattgggagaagccattcggcgttgtgatagtaggacaccggtgataggatcaccgtgcggcagtagtgacaggaccgctgcggtgtggcaatggcgatggaacactacaagaatcctattaatccgtgatgaaaaatttctgtcacatatcactaaaaaaccgtcaccaaacaacatctgtgatggtttcagaaatcatcacggattgagcatcatggattgatctgcgtgacggtttgtcgaaaaccatcacagattaacagaatcggtgatggttttaaaccgtcatgatggagaccatggtctagttagtccaaccaagcccatttcctgtgatgaaaaataaccgtcatggatagctgccacgtaggatatttttctgtcacagattagctgccacataggatatttttccgtcaaggatttgaatcaccacgtatgtgccatgtgttcgccaaggtggacgctgatgtgtcatcgatgccatgtaggacttagcccacgtgttttgtggcccaattctttttccaaggagctttcggcccatttatgacctgatgatttttttttgttttgggccggtttttttttggagtgttttttcggccttttagtcatcattcagcccagttcaaattgggctacagctagattttagcccaactaaaattcagttgctgctaaatttagcaaaatacaaatatttcgtccataattttagcaaaattaattaccgatcaattaacattctctcatcatcagtaacaaaatagttattgatcagcacataaatattctaaaaacacattacaaccttcacatctcatacaacataattttttagcatatctcatacaacataattaaaacctgttcaaaagcacatgacaatacccaacagccaccaaagcattttggccactccatcaaagtcgcatatgtttgagcccagcaacctgatagtacaataccatgtgttagattatttttttatgctctagagaaacaagaagaaacaatctaccgatacgatattagtttttgaatgatagggctactttgcaacaccaatcttatgtcccataatacattgcactaacaaaactcaatgtccccatctacctcatttcattggccaagcaagcaagcaactgatgctatagattgaaggagaaaataaatgtggtccttttgcaggacagagcaagaaatccacagtttctgaagcaaagaaacgcaacaaaacagaactatcaaagatttgtgttatgtacaattaatctttaaacatcttacttcaggaatagctctacatatcacgtactgacaaaaacctctgtacaagaaactaaaaatcaaggcagtgcacaactagttcagagttgttctgagttcagaatgctatttgaatgaacaacttggcattcacggccaagcagataattcccatccaccaaactat

SEQ ID NO: 13055 - DNA, 1501 bp, Oryza sativa
gaatcggattccagcacttggaggacttgatcttgatatcatcttgttcatccataatgtgagctatggttgtatctgtagtagccatggtcacatcatatgggcctgtaatgatctgccaatgaggcatcgcccttctttggcaacagaccgatgtgagcactatttaattcctcaagctagttttgatttaggtcggtaaagaattttattgcattgaacaggtccagcttgatgcgatcccaacatcttttgtaaaaggcgccaatgaaaccatcaggccaggggcttttttagatggcatcaattttaaagcctgttctacctcttccattgtaatgtcatcttcttgatcctgcaagtcaaaactgttcactcccaggttttgctagttgagtgagaaaactctgttatgcaccgttccaagccttttgtagaagtatgagaatattttttcctctttttcctggtttgaggtggcaattccattttcagtttgcaaggattagatgaaattgtcccttcttcttgcactggctttgatatggaaaagcttggtgtttgcgtcccctctcctaatccaagttagtctcaatctttgcctaattttgattttgtttaaggccgctagtcccagcactttgcttttgagagtggaataaaaagttctctcgtctgtggataggtttctactttcctgggccaagtctagttggaagatgacttcatttgcaattgcaagttgaagtttaatgtcaccaacctgcttcgactcccatctttttaggtctcttgctagtctcgagagctttaatctaaagattgccagggggtttgttgagttcagaggcctatagaaggaggggtattgcagccaaaaactctcaaatctaaataccttcactcttgcttgctcgtcctggccgattagaagcataggggtgtgaacaaaacaaaagctggaaaggggcaagagtcttgagtgctgaaacagaatgtcacagtcaggggtgcaaaaacatcgatcaatctttgtttgtgttgggttaggtgcacgtcacgacggctacctcatctgatcaaccccaaggcaaggatgatcaaggcaaagaaccaatatcacacaacgagcagagaaggaagtctgcgcgggagagacagcctaataaattgtataactcgagtgtgtggactcagtgatattgggctgggccactgtaagcgagtgaggcccattagcgcaatgctataagaggccggcatggactggattgaatcgaacaatgtagaaacacttttcctgaaactaattcaaatctctcccaattctattgttgttcttccccaaatccctcttcctctgctgctcttgttccagtctcaattccgattccttcctagctaaaccctaattcttagaagtcgtgacaatttggtatcagagccgtaaacctggagaagccacgctacatatctcgattgcaactccaagtcgaagcta

SEQ ID NO: 13056 - DNA, 1501 bp, Oryza sativa
ccccttaaacggaatctcgaccccgagattcggaaaagctggcaaagaggtgcggatgggcggcgtttaactcgtcttctctttcctaggtgacctcttcctcataatggtggctccactggaccctgcaaacctggtgtccttgtttctggttcttctcacgctggtttcaaggatgcggacttgtttctccacatatgtcaaatcctcttgaatctcgatgtgcttagaactagcctattccttaggtacgctcaaacatttcttcagttgagatacatgaagcacatcgtggatactagccttgctagatgggagctcaagctagtaagcgacttcacctctgcgttccaaaatcctgtatggtcccacaaagcgtggtgccaacttgcctttgggttggaagtggtgcactccccggagtggcgtaactcgaaggtacacatagtcccgggcttcaaagataagctatcttcggctgttgttcgcgtagctcttctgccgagaccgtgaaattcttatcctttccatgaaggttctgacttttttcctctacatcactcaataattcggtcccaaacaattggcgttctcctgtttggtcccaaaatagacggccatttgtaagctggcctgataactattgttgtaggagaactcgctataaggtaggcttttattccaaactccgccaaaatcaagagtgcaagctctcaacatatcctccagtatctgattgaccctctcggtctaaccatcagtctgattgaccctccacaagggtcctgctcaacggctcaccgcgcacacccatcaagcacgacaggggtcttcatcaaggggacccgctatcccctctcctctttatcctggccattgacccattagttgccgtgttggaaaaggccaccgacctcggctatctcacccaactaaatgggagaacaccacgcctacggatgtcactttatgcagaggacgctgcaatgttcgtccggccgacagtcagagacatgagccacttagctcaaatcctacactccttcagggacgtaaccggccttcagacaaatatgaaaaagagccagatcacgcccatccgttgtgttggcatcgacatacaagagatcttacgagtcttccctgcaaacatcactggcttcgcaatgaaatacctgtgtctcccgcttgtggtctccaagctcaagaaagtccacatccagcctctgttggataagtgcaaggccagattggcgccatggcaaggttggatgatgacagcggcaaggagaacaactttaaccaagtccgtcctaagatcgcaaacaatctactatctaatagcttaaaatcccgaacagtatgctccattcaattgataagatgaggaggaaattcctatgagtgggaggagaggatatctcagttgggaaatgcaaagttagttgggacaaagttagtcggtgtgctagacctggactggttcacccgagcgctaagg

SEQ ID NO: 13057 - DNA, 1501 bp, Oryza sativa
gtgagatagccgaggtcggtggccttttccaacacggcaactaatgggtcaatggccaggataaagaggagaggggatagcgggtccccttgatgaagacccctgtcgtgcttgatgggtgtgcgcggtgagccgttgagcaggacccttgtggagggtcaatcagactgatggttagaccgagagggtcaatcagatactggaggatatgttgagagcttgcactcttgattttggcggagtttggaataaaagcctaccttatagcgagttctcctacaacaatagttatcaggccagcttacaaatggccgtctattttgggaccaaacaggagaacgccaattgtttgggaccgaattattgagtgatgtagaggaaaaaagtcagaaccttcatggaaaggataagaatttcacggtctcggcagaagagctacgcgaacaacagccgaagatagcttatctttgaagcccgggactatgtgtaccttcgagttacgccactccggggagtgcaccacttccaacccaaaggcaagttggcaccacgctttgtgggaccatacaggattttggaacgcagaggtgaagtcgcttactagcttgagctcccatctagcaaggctagtatccacgatgtgcttcatgtatctcaactgaagaaatgtttgagcgtacctaaggaataggctagttctaagcacatcgagattcaagaggatttgacatatgtggagaaacaagtccgcatccttgaaaccagcgtgagaagaaccagaaacaaggacaccaggtttgcagggtccagtggagccaccattatgaggaagaggtcacctaggaaagagaagacgagttaaacgccgcccatccgcacctctttgccagcttttccgaatctcggggtcgagattccgtttaagggggctaggtttgtcacatcctgaagtcctccttcctttagctttgaatttcatcaagcctagagctaatcattaattaataaatgcgattaataatgggaatcgacatggtgggatttttgttggattctccatgtcaaaatacattaataggatttttagcggaatttttcagagccctggagataatttaaaccaattaaaatcagtctatgttattaaagaaatccctagaaatcctttttccttttcctttttcctttcccctccctttttcctctttcttgggccgcaggccccaatcctccttgctgcctgcgccccctcccgaagtccgcccttcatcactctctctctcttggggcaccgacaggctcacccctgcctccgcgccacatcccccacctccccgcgcatgtcgcccacctcccgcaccccatgcgcaactcccccacgcacccatgcccgcgagatggccaggattcaattttcgaatcccacctctctctctctctctccacctcccccactacgccggcaaaatcggggccgttcctggccacgcccgacctcctc

SEQ ID NO: 13058 - DNA, 677 bp, Oryza sativa
taaccaatgccttaatttggtactgcaagttctacattgggataacaaattagagatcgacgaaaagcggaatatcctttttatttgcgccctgacggatatctttcagtttgtaaccaccggatgacgcacggacggctcggatcatcccgaaaagatcaaccgcggcgcgagcacgagaccaccgtgggccccatggcccaccgacttacacaatctctcccactgccatgcgggcccacacccgcaacagtccagtccagagagccccgaactcctccaaacccgggggggccacaccctgccacgtgtcacccgccgcgcctccctctcatcctctctctcctcgtccagtgcttctccttctcctcctcgcaaccgaacgcctagaagcgcgcgtccaccaagccacggactcctctaattctctctcttgctttctctctcctcgcttcccgggtttgatacgtggtacgtgacgctttgcccttttcctctctctctctctctctctcttgatcagtttgatttgatcggttccgccattagcaaacctcgccgattctctctctcgatcgaacaggggtagggaagcgattaaccggcgatcgatcgatcgatgcaagtgatcgcgctcggttgatccaggaattggagagcatcggctgatcgagaga

SEQ ID NO: 13059 - DNA, 1501 bp, Oryza sativa
ctcggattcgtttggaaactcctcccctaacttcgccggcgcatcaatggcggccggatcttccgcggccgattcccccttatccggccgttctctccccctcccaacactatataaacgctccccgtgcctccctccaccgtttccgccactcgccgctctctctctccgccggaatcgagctcgcgccatcgctctctctctccgccgtcactgccgagctccggtccgccgccgtcgtcgcctcggacctcctcccgcctcggcgtcgcctccttcggctccgccgcgtcctcgccgacctcgtccacccttccgtttcgcccgccgaccgccagaacgccgccgtccccgtcgacccgtgccgcgccgccgccttcttccgctccggtcgccgttcccgtcgtcgccgtcgacccggggtgagccgtggaccgcccatttcgtttccccctcccctcccctctctcggccgccgctccgccgtgcctatggccgccgccggcgaccataggggcgcgggcacgccgcctcccgtcggctgtgccggaaaggccgccttcgggcgcgccccgtggctgccatgtggggcccggccgtcagccgcccgcgccctcaggtgcggctgacgcgtgggacccacggcgccggccggcgtaagccgcgtgctcccggtccaccgtggaccgagaggctgccgcgtgggccccactcccgtggacccggtccgcgcgctcctctctcccggctgacgcaataaatccgattttaaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttctgttggacgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcattatcgctttatttaaattcccgcgtaatcactgttttatttagccatgcctatttatctttgttatgaccttattattgttgttattgttattatttccttgttcaccctagaataaacaaaaccccaactagtggacactctactcatggtatcactagtatgattttaggtagatgcttcgctttaattaggtaacattaggcggtttcacaactctagactttgggaatattcatatcacctagatattatggaattgttggagtattgtggaattggattcacaccgccccctctactcaaaatccccaaaaaatggttttaggctgggctcggggtgcatggttttgatagtagcacctcggccatataaggaccggt

SEQ ID NO: 13060 - DNA, 1501 bp, Oryza sativa
attgttttcaatttctttttttctcaatcctgtgattgaaatgaacggttcaaagggaaattcctccattcaaaagaagtaaagccttactgtgcagtatgcactattactaggccccattgtctccatattttttgcttatcaatagctgctgctagagagattattatactgtcaccctcacctcctgctatttggttggtgatgttcttcttttcatcagcctgttagtgggaccccccaacctacaacattttctacttatacatagtactactacttcgtcacttccatcagagatgaaaagagaatagaaaaggcaccatcagttaaaaaaaaggcataaaaagggggaaagagaggattggatcggattcgaaatcaaagtttggtgtgatgggtggttgaacaaaatctaactgaaaatccagtgagacccatttgacaggaaggggaataaatttattagtttggaccacgctcacacttgcaggatgacatgaatgttctgttcctttgcaacttggaggaattatatgttcaacagttcaaggcacgcatgtgtgtatagtaatgtattccaggaaaatacaaaccagcagattgagtcatataaattcatatatatcagtcatgtctctatcctgcaatgttgcccttttgtctgtatttttttatagtcccaattggatcacgctctcagagatagtctgtacgtataaaatatttttcttacttattttgatatccttatttagcacgagaacttaaaataataagctactgccaccaaggattgttcacactaaaaaaacagttgtttacattattcgtcatataagcctttgctaaaatttaaaacttaactttacagctgattttagggttttcatccattgcagtttatttctcagcattaggctttaaatcattaaagaaatatatatgacatttttatccacaacttattcaatcggctgtacatgaaatgatagaattaaaaataaatttcgatcaaatttcaataccgaatgtcatctatattaaaaaataattagttgatcaaacgccattagtcgtccggactagactgtgccgctggcgctgttgaccgccgtggggcacacgagtccatgtgacgccctgttcgcacatggaaacaggcgatcgattgcttgactattcatgaatttacaacgctggttggtgtagcatgaaactgatgtaggtaaggtagagcatgaaagaagggaatcgagaacgtgaacacaccctagctatctagtggtgtttgtatcagggacttaactttagtctctatatttagacactaataatttagagtattaaaatatattacttataaaactaattacataaatgaaagctaatttgcgagacaaattttttaagataattagagaatgtttactatagcatcgcataggctaattatggattaattagactcaatagattcgtctcgcgaattagtccaaga

SEQ ID NO: 13061 - DNA, 1501 bp, Oryza sativa
cacgcttaaccctcagcatattcctagtatggctcccagcttgcctgacggtgcccttctgaatgtccaactcaaccatctcaggcaattttgagattgacttggatgcctccagcaaatcatcaacctgcactcaattgagaggaactaaatcagacaacacacaacaaaagctcagaaaagcaagttatagttaaacaggttactcaagggatgcctagtgggggaaccaaggcggcattatcatcaattttgcagaagtacaaggtcctgataaacagaaaaactggtttgctaaatagtaaacttacgagtaactgctatactggataggattctaacacaaactactaagcatccaccaagtcaaagtcatcgcaacacggattaggtgatctgatcctgatgcgtgcagacattcctacctgacacttgatctagccatctaggtgataatttcagatcatttcgacataatcacctagcattaagcagctcagattcaggtgatcccctcaatctagccacaaccatgcagactacttcctccgtttcatattataagactttctagcattgtccacattcatatatatatatatatatatatatatgtgtgtgtgtgtgtgtgtgtgtgtgtgtgtgttaatgaatcatacatgtgtgcctagattcaatctatatgaatgtgggcaatgctagaaagtcttataacctgaaacggaggtagtagcaaacaattaatagccgacctaactcctaagcagcaaaaaaaactcatgtcaatattcagaatttggattgagtcatgtcaattcagatatatctgagttgcttgctctcagcatggaactgtactagatatgattctaacaccaactactaagcatccactaagtcaaagtcatcacaatttgggaggtgatctgatcctgatgcgtgctcacattcctacccttacagttgatctagccacccatctaggtgagaatttcagatcattttgacacaatctcctagcattaaagcagctcaagttgagataatcaatcccctcgaggtctcaacctaaccaaatccacacagactagccaacaattaagccgaggtaagcagcaaaaagaggtcaatctagtcaagcaattccgacgaaacctcgaggacaagggagagcgaagactagagagcgggggtggcggcgggggcttgccttggcgacgtagtccatctcggcgaacttgaaggcgatgccgaggcagccgaagaggacggagacgttggagcaggcgcgggcgaaggagcccacctccatggccgggccgggggcctgctgcttggccaccgcctcgagctcctcgaacgacgccgcgatccgccgcagcggcttgtccccgtcgctcgaccccatccccacctcccgctcccgcttgctccgccgctgcggctcgtcggcggcggcgtcaagctctccgcctccgggatggttggggtgggtgggtct

SEQ ID NO: 13062 - DNA, 1501 bp, Oryza sativa
gttctttgcttgatccaaaacacgggggcgcatttagggaaggcatcactggaggcaggctgctcaagtaatgcattatccatattcgattcaacccaaccaaacctaaacccaaaataaaatgatgcctatatacttctggcagttgaccttccatcctgactagccggcggttcaacttatttttcagaatctgcatcgagacagaacagaggagaaagattcagaaaaaagaaaaagaagaaggatgtaacacatctgtctctgagcaaccattgttcggctctcaagtaccagtcggttggtcagatggaataaggttgctgcagtagcagtccatttctcttgatcttgatttgagtaggtgtgaagcaaaacctcgtgtcaatttggatgactttgtatatatgtagctgtcattgaacttcacttctgaaacctgctaaatttgaagtcggtatctttgcccatgtttacgctgtatctgatcaaaaccatttataagcatctgtggtttcactcaacccggcgaaaaagatgttatttagcgatgaatcagatattcagttgtaaagaagtgctcgctatagtattcataagtaaacaaactattttttggacaatacaagaggtgacttctattcttctagaatgcaaaggaagcaacgatttgcaaacaggtcaagcaagaaaatctcttcttttttttttttgctgggccggccaaaggatggccgaccaatttcattaagagaggggaaaaaaataaatagccaattacgaagtttgttacatcgacatgaaggatgtcgagggcgatcaaggccaggccttagatcaaagttgtctctttttttttttctgggccggccaaaggatgattgaccaatttcattaagagaggggaaaaaataaatagccaattacggagtttgttacatcgacgtgaaggatgtcgagggcgatcaaggccaagccttagatcaaagtcgttgtaatgtgaagcaggagtagtaccgttcaccaaaaaaaaaagtgaaaatagtacttcacatgccaccttgagaaattccttgttctcaaggcactgaaaggactactataattgcaactgaaataaaaccttggcttgcaatgcagaaactggactcgaaactcctcaaaatggccggtatgcttcacacgactttggaatataataaaaaccgtaagagaaatacaacctgtcgaagcaaagtcaaatcccaaacacacacatgattgcattgaccattacaaaccaaacaattcgacagatagtaagctacgcaaggacaaacaaagccacagcaaatcacacacaaactcatcttattttaaacatatttgaatctttttttcaaaaataaaaaaaaccatggccatatgcccatatgccattgacctcgaaaccattgcacaacctcatcgtctccttctctctctgtccaagttgtgtgtttgcaacatgcaaaagcgttga

SEQ ID NO: 13063 - DNA, 1501 bp, Oryza sativa
ttaatcatttaagcacatgctgaaaccacgtgagctggaattcgctgaatctgacccaaatctgtaaattggcatcaccccataattttgtcaaactttccctgcagacaacgtcacacgtgcgcattccgacgagctgtttatcagcggatcggtgaaccaaattgccagccaactcagcaaaatcgtgttaagaaaatcactgtgctgaccatttctgcttgcttacgaataaaatagaattatttcatggatgagatgccttcatgcacgtacatacgcgtacgtgagaaaactattcaaacctaatcatctaggagtatactataaactacatgcatgctcgagtactgatacttaattagattgcttgccttgcatggaattgtcatccccgtgttgattgaacaatataattacgcttagtgcgtgcaaccttgttctttctattaagataacccacaaaccttgtccttcatcatgattgttcggcatgactatttgtcatcacaataaattcaggcaacgacatctgtaaatgactaaatgtaattgggatttttatatgaattaattaatgaacaaagtcctaatcacaattgggaatttggactctctaacctgaagaaggtaagtacatttgaaaaacaatcttactaaaatatgacacgcattttttttattgattccaataaccgttttccttatgtgattgttgtctctatgtacagtatatatatttatacctctcctatcactttacttttaaacataattcacttatatagcttattagaaaatttatgatatacttttgaaatttacataataataattagtgtgcaaatgtagataatttacagtgtaaaaacgaataatttgactgctttttttcttttgaaaatgtggtgccataaattatagcttgtcccctgaaaggctgaaagtctcaaaccttgcagatgacatttgtttttccaaaaaagagctagtgggatggacaatattttttttccatccaaaagataaaaagaaaaaggcataaagtaaatattcgtagtgggcttggagaccattcaaaggcagggaagcccaacaccaccgtggaccacgtgtcgacttgagcatattgggccgtagctctcctcctcgctaaaggcccacagctaatgcttacctagtaaaagcccaaaatgcgcttattacaaaattgccctcgccgtcgtgctctccgcctcacttccttcctccctcgctcgtccggggcggcgccgccgcggccggtggccggcggcgccgacgatctctccttctgcgggttcgcgcgtcctcttcctcggcgttcggagacgcattgcctcttccctcccctaggtaacgcgaggtcctcttccgtctaccattccgattcagtttgtgactaggagttccatacctcgagtgctcagcaaggattagggtttatccaggttccgaacttctgatcggttgtgtttggtga

SEQ ID NO: 13064 - DNA, 1501 bp, Oryza sativa
atggatgtatgtaggcaattaactatgacctcttctccattaaattattacttttttaaattctccactctcatattctctaattctattggatgcatgcattatatttattagcatgatccaaactataagatgataataattattttcttggtctttaggttaggggtgattaaaccttatattttggaatgtagggagtagcagataaaatgtgtctctaatattgcaagatcaggttaaacagggtatcaagacagtatagctccttgtttcgtctgacgtgacgctttgaccgtggtctgctttgctgagtcaacgtagcttactgtggggctgtgtttgaaatcatcttctccccccccccccctcttcctgtttctctatcttcccccacaatggagcgatggtggcgcccggagcagtgcatcagcgaggagagcggcgtcgtgttgggtttagtcccacatcgataattgatgatgggggagcatgacttaaaaggtgaggacagtccttatctctcatactagtcttttgggttatgtaggcccaggacctaaagttgtgactccggttgggcttgtggtggagcaggcccaatgtgacctaggtggcccatggttggtgggccaggctgcacactctaacaaagtggtatcagagcctaggtttggaagccggaacaattaccttgggtcacatggtagggaggccaggtaacaagttttcacggtcatatgggttgaggtgacgggggagattgttggggccaggtaacaagttttcacagtcatatgggttgaggtgacgggtgagattgttgggcccgatgtgtgcaaggaaggcgcaaaaggccttgtcggaggcaacaacgaagtcgtgtgatcaagttcgatggtggacgtggaggccacgcggagcggagtcgcaaaggtggcacggctcactaggtcatgcaaatgtggcgtcgagccaggttcgatggtggacgtgaaggccacgcggagcggagtcgcaagggtggcacggctcgcgccaggtcatgcaaaggtggcgacggttcgatggtcgacatggaggctacgcggagcggagtcgaagggtggcacggctcgccaggtcatgcaaaggtggtgacacctcgacgaaggagccacgacctgggcttggagaaatgattgaatgatttgaattgaaatattatgaaaatgatttgagaatgataatttagtgctagatgtttgttgcggcatatatgttagatattggagaaatgatgaaatgatttgaatagaaagttttagaatgtaataaattgtaatataattaaaatatgcttgtatattaagctttgtatgcttaatgggttaacgtcgcatgcttgcatgtaggttttgaaagtgctactaaatattatgtttgtatgtttagctttagatgtttagtgagtattagctttatctttataataagaaaggattacaagttaaaaggacat

SEQ ID NO: 13065 - DNA, 1501 bp, Oryza sativa
acaccttcccgcgcagcaggacctgatcttcgggattatccggcgtcgagaacttcatggacagcttgcacaggttcttgaacagtgtcaacccatcctccctgatcttgctcatgacaacatcctccttcccatccgtctcggccggctcaaccggggaccccggctcagggacatcgcttccctccatcgtctcgtttatgaagctctgcgccgcatggacaatgctggagtcattcaggttgcggtcagacatgtccatcatgtcggtgatcgacaccgtgcgcacgcgcacatccatggagtccacctccacgcgcgcgaacacgatcaccagcacctgcgccagcgccagcttagcgcagagctggttggcgccgctgctgctactgaggtatatgttgtagcaggtcttgagcatctggccgagcccttccccgcggatggcgacggaggggcaccgcgcggcggccacgaggacgcggagggtggagagctccatggcgtcgtcggcgagcgcgccgcaggagagcacggcggcgagcagcttggaggacggggagtcgtcgtcgccgccgccaccgccgagatcaccgacgaggaggcggtggtagagcaacttggcgacgcagtcgagcgccgggtcggcgaccttgggggacgccgactcgagcgcgaggaggagcgcgtggatgcacgcgtccgcggcggccgccggcaacccgagcagcagcgacggcggcgacggcgccgacgccgacgcgtacgccgacgaggagagcaggtcgagcgccgccttggcggccgccacgaggcccgagtgcttccgccacgccgcgttcttgatgatccggtccagcgcagggcccagcacccgccccgacggcgacgcgccgccgattgcccccgccggcgaggccatagttagccgtccacgcagactctcacgcgctctacgcggtggtcgtcgccgtcgccgtcgcggccattggatctgagacctcgagacgaggaggaggtggaagaaaatgggaattcgagaggaagacgagacgagcgcgtgggggaggaagaggaagaggagaagtcagaggaagggtatgactgaaatttcagattcttccaggggcctagatgcaaaaacgccgcgacccttcgcgcgggggtgaggcattttatcactttacccccctcggtttctcggaattctttcttctcgtctccatcgctgcaggaggaggaggcggcggaggacggcgagcggtcagtggcggagaggggagtgttcggggacgcggggtttgcgaggtggggggagctcttgcgcctcggatcggctcacttcccgacgcctcagcccccgccgcgccgcggattattgctgttaggttaaaggtgggggtgaatttttgttgctgcgaggtagctgttcgacgaaattccgcagcgtggtttcagggtttgtctctcttgcagggattgtggtagcgagaagcggtgg

SEQ ID NO: 13066 - DNA, 1501 bp, Oryza sativa
ttgcaggtgcaatcttttctccttgcagcaaaaacaaagttggaatagatcacagattttaccaccattattccaacttacatcacatcatttgttcacagatgaaagggttgacggtggccatggtcggcgacgggataaacgactcgccggctctagccgctgcagacgtaggcctggcgattggggctggaaccgacgtcgccatcgaagctgccgacattgtcctgatgaggagcagcctcgaggatgtgatcactgccatcgatctctccaggaagaccctctcaagaatccggctcaactacgtctgggctctgggctacaacgtcctgggcatgccggtcgccgcgggcgtcctgttcccgttcaccggcatccggctgccgccatggctcgccggagcttgcatggcggcctcgtcggtgagcgtcgtctgctcgtcgctgctgctccagctctacaagaagccattgcacgtcgaggaggtggctgctggacccaagaatgacccggatttggtgtgaagactgaagaagcgtcggtcttgctgtgctgactgaaactgagcatgaagcaaacgccttgtttgcagtggccctcctgactgatttctgtacagtagtcatgttttgggattctctgtttttttttgggtacttctgattgattcaataataatttggggagcttaattgctatccagtgatatatagatgtgaaattgtgtttaaacagtggagaacagttgttgtattttctggcaagtgaccattgcgacgttgtagcattggactagttagtaactagttgaactgtaaactcattgcaaaagtaatctactctttagttatcctttggaacactgcatgcttatcttgcggaaaccgaactgaatcctctgaaaatcctataacatttcatctcaaatttgtaggaatatgttcgtcgatacgcgctatttcaaacaataaattcaaaagagcactgctacaccaattaaaattttcttactaaactcttaccctcaatgatctcaaccctcaattatctcaaccgattgatttaactatatgggattataaaaaatctaggatatattaatagcatgacacatcaatgctaataagagttcagtaagaaaaacgtagtaggtatagtcttttccaatcaaaaactttctgctctaaaatcatgtgaaaattcgtcgagatgtcaggacgggaacggaaggaaaatgatcggtaggcaacgacgaggaggaagaagcagcagcagcagccgcgcgtcccgttggttcgcgccaaaaatagcagaaaaaacccgcgcgcgcgacacccgcgtcgtcgtccgctcgccgtgtctaaacatagctaagctccccttcccgccgtatatataatccggcggcgcgcccctcctcgacatcgccgtacctacaaagatatcaacatggtttcctccacgagaaggacgacctcgtctctatccgccaccaccg

SEQ ID NO: 13067 - DNA, 1501 bp, Oryza sativa
cagacggctccagcatgtgatgtgaacgtacgggcttacgtgtgcacgcagtagatggaaggaagagctcgtagtagtaggtagattaactaacaaaagggacaaaagcgaaagctcgcgtacgatttgctttggtgatagggaggaacacatgcgtgggcggctgggctcgcgcgcgcgtgctgcctgtacatgcaggatgagcccaaaaaacccttcccctcatgtaacgatctagccgcagggtacctagtactggacgcggagagggatactagcgcagtagaaaaacgtgcttgcgcgcgggcgcggcttgcgacgacgagataaggatggggggacggggcgccgtacacgtccgggcgagtgggattactctcgatcggcgtggtgcagtgcaggagcaggacggccggtgcgcggtgcgccgtgcgccgcgtggtgtttcctttggttggattcggatgagatcggcggggttttagcgcggttctcctcgacctaatggctttagctgtggcctttctcgtacgtgccgtgccgtgcgccgtgcgtctagccacgtttcgctgcacagtggggcgcgcgcgcgcgcggaggaggcgacacctactacgggcctgttcggtgtgactagatagcagccagccgctacagtagcaacatgcaatttctacataaccgctgatccaatgcgaccctcagcccgcaggttgatctgtgtacctaggcgtgaagcgtgataggttggggaacggttgaatcgctagctgccgcggcgcgtgcgtacgtaccgatcgtacgtgatcgatctagctagagctgcgcaagggacattattcaatctagcagtgcgacatcccggcatgcaccatcccccgtgggacactaaaccctcgtaatagagtcccgattgataattcgatatggatgccggctgaccctccgctaacaagttttaattcatatgcctgtttaattttctttcactagtatgaaaaatgttatcgtgctactatatcacaaaataattacatttcaaaataaattaaagacagattagcaacaaatataatttaccatgataatcctatttaatagccgcattgtatgcgcatattccatacgtacacttggttaaaggaaggttgagaccataagccaacttaattgctattcttgattaaaagaaatgcagtatttcacctcaataaaactacattttttagattaaatgatacaaatgtactcctctgttaaaaaaaagttccaattttagaatatatctggacattatatatgtccagatacatctttaagattataatttttttatggaaggagtaattattttaggacaaaggttgcgtatgttaacgactgtcgaggagtgatcctctctagcggaagatcgtgagatctcccttttgtcagttcggccggaggaaggagcttgcctctagaaattgcgtatccgccctgaaggctgctaggtagcgtg

SEQ ID NO: 13068 - DNA, 1501 bp, Oryza sativa
tgtacatacgtccgatgatgtatagacattaattcgatcatattcgattcattataaatttaaattaataggggttgctcctgatgtatgtacatattgatcatatattgcgcatatgttctattgttcggtttaattagagctagctagctagtgccaagagagattaatcttaattagtttgtctctgttgactttgcatccgatgatgagcgacgtccacttgtacttgccttgttactcttaaattaactcattctctgaccgaagattgattgcgaaatgccgatgtgactgctgcaaattaaggggaatttaagttagtgaaatgtttaatcagaaattaatatacataactaataaattaagcacttatgtatcgatacaattgaccaatgcaatatatgcaaaaaagagcactactagctagtagctagagtactagactatactcctaataaacacaactgaatttatatatatatgtcatttagcaaaggagtatatatatatatatgtagttggtcggtatataaaattggtaggtgatgtctagctggtcctgctaattctggtcatcaggtagagatcaaaaattaactgatcatatatccatgtatatattggggtgcacatgcacgtacatgcatggaactgtacatctatatatgcatatgctagcttaatcaaggtgtgcttctatgtatatacacggtacttgaatgcaattaattagccccaaattaaactctcaataattagttggttcaattttcagctggccattatcttatctgatctgattaattagctgctagctacgggtgtaaagtttactacaaggttccatttctaggttagattaaatttccccaactaaagtgaacgcaaatttgcatcgtgtcttgaatgaaagggatcgaggcactgcagtgtacagaatatactatacagagatggaaccaacaaaaggtgacgcgattgaccaccatgacactacacaaactaaagcataaatatatgcccctaaatatatatatgcaacgacgtggctgtcttgtcttgattattagagctaatcttgtttgtatgtgctatgcatacggaagcatggtagtagctaaatgtcggagttaatttcatgacacgtcaaagctagagcttgacaaaagatgactatatgcatgcttatctcgttgatttcgctatagattgttacacgtcaatgcagcactgtgtgtcaatgatctagctagttcctggctattattatctacagtactatatatatgatctctgctcaagctgtatatatatatgtgcatgctttactaaaaaggaaaaaaaacatgcatgcatgtaaaaagaataatccatcattttgaataagtaagctagctagtactgtttttgttgaaatttatgtgttaactaattaactacaagttgcatccatatggggtgtagctagacataaacagattaaggaaaagtgcagaaa

SEQ ID NO: 13069 - DNA, 1501 bp, Oryza sativa
ctgtttgtgatagtaaaaaccagcggcttggaagcaattgagggtttgaagccataaaacagtaaaagactgaagctagtccataacctaaacagctgcatttaatttcagaaactgcctaatgagtaaaccagtgaggcataacaggactcctggaactgcttgggatctgtgagctcttgagatgtcttggaaaagaaagtggcacatgggaaatgaaatcgctcccagagcctcatgagaacgaactacactaaccatttcacatgcctcctgttatgtttctaaagggaagcaagcagggttacaccggtgttgagatttttggatacctgtgcctaacatccaattttgtggattcactgtaaactgacatatccttttctgtcacccctacaaaacaggctgatgacagcactgaacaaattgaaaagtatatgtggactaaagattcctgtaggtgctgtacaaacctcagtgggacagaagacagaaaaatcagacccagtctgtaataaatctttcaactagactcttattcagaattcaaatttcaaagtcctagcttacatcttccctaactctctgataattagcgaatgctggtcctggctatgcaatacagtggttagtttccacaagagcggtcaataggtcgtgtgaattatagcagagatacaactccaacaagcttatagccaccaacaataaggtaaaactagtttttggaaactaaactgcatgacatagcatactcaaacacgcatgctaatttaacagatgaagaccatccagtgttaccaatcaggagctgatcatactaactcagcaagagaggaactacacaacaaatgattcatccatagacagaaaaggagatgtagaagaggttgatagtaccttcatcttggatttcttggcctgcagcttcttggccagtttctccttcgcctccttttcccctgcacacacacacatacaagacagccaccataatcccaaatcagatgcctggttggtgaaatctacaaggagatgagaggaaaatcgacaagggagcagccggatgtatgatctatcggtggtactttggaggtcgaactcgtgctgcttcttccgcttggcgaggttgttcttcttcgacatcttcctcgccgccaaccgccgacgaagcacagcacagcacgcagcaacgaacaaaccctagccgcggcagagcctccatggagatgggagtccttttaactgggctggaattgggcctccactaattcggtcaaggcccaaactgtcgtaaagcaaagcccatcaaaggcccagttaaacagtcattagacctaacccggtgattagtggtcaaagctgtccgtcattacgagacggagacagtgacgtgaggggacacgtggctcgggccgaccactccgatcaatcatgccggacacgtggcgcgtggccaggtgccagcgtgtcattgcgcggccgcatcatttcgttttta

SEQ ID NO: 13070 - DNA, 1501 bp, Oryza sativa
aaatactctctccttcctaaattgagcatcatatatgtttatgcaccaagactaagaataatttcaatcacatcaatcatgacaccatgcacatattctcccacaattaatacatcgattaaaacgccatgccaattactccctctgtcccaaaaaactaacttctagagtttgaattttgtcccataaaaaaacaacttctaccatactacctaccctcagcacgtaaaatgagaagttttatcccttcaataccctttaactacatatcactcttactacttttttcaataatgaagggcattttagttattctccatatccactaatttcacctcgggatgctaggaatgtatttttttttgggacggagggagtataccttagcatgcgtacattctcccatactgtattaattatattctgatgaaatctatgtccacgcggttatatgatgataaatttgagaaattttaaatttcattatatgatgatcaatttgggaagagggagtaataagattggatcgggaccagtgtgtttggtttgtcagtggatccaccaaatttaataaagtggtgggctgtattggctctaccgtctaccacgaggccactggtaccacatccatggaccatcatgcatgggccatgaaaatctatggcccattttcccccgcgcttctccgttcttcggcccacataaacacactggcggcccgcgcgcacggcgcaccgcgagccctcgcaaagcaaagcatggcctcgctcgctcgctcgcccgcgcctccagcgattgtcgtcgagacgtctcgccgtctcgcgatgaagcgaaaggctttttgtccgctgcgcggctgcgcgcgggcgtcggtttcagccgcggtgtcgccgcgcgcgccgcggccggccggtgtgtcggtgcgcggccggatttttccggctcataaaaccccggggttggctatcagctacgtcgtcgtcgccgaggcgatgattgatgtcgggtgtcacgattgatcagcctcagctatagttctcccatcgactctgcagtgtcatcactcgtcagctctcctctcctcctgcccgtttgatgtaagtgtaagtacgtactcggggacgaccgtgacgcgctgccgaatgccactcccaactcccgctagctaggtacgttggtgggtcactctccatccgccctagcgcacttcatttcatttcatttcctctgccttctcttcgctttcgttggatcatctcgtctgtactatactgtacggcgtgagaaaattgcccacgtacgtacctgtatctcatgaagactcttgctctcgtaatttatggtactcgcacaaagtttgaatgaacggcatgtgtctccgttgaaacgcgaacaggtacgctagtgtcgttgtggggatggaaggcaggcagggcaaatactctgtttttttatacattgttgattcttcaaaaggcatgcaaaaacgatcgatcgactg

SEQ ID NO: 13071 - DNA, 1501 bp, Oryza sativa
aatcgagcttgttgcaagcatgcttgcagtgctagcttgcggcagatcttgggcaagtagctagcacaatcgatcgatcagtaagtgaccgaccgatcgagatcgacgtcgaccggaaacatagaggcgaggctacacagccacctcatccagggaatagaacagattttgcctcttttgctgcgatacttgtgagcagctgatgagctcgttgggaataaaggcgaccgcggttttcgaggcagcaaaaccggcctgcaggtttctggagatgcgagaatcgagatcaggttcgtgtcgtgtatgtatgtgctacgtacaaaggtgatcgatcagaagctagaaaaggagacgatatatatgatcaaaatagtcaagcacgatgatgagaaccatatctgcatgagtgcatgggcacggcatggacaaacggagtctaaacattggatggcgtaatatttagacttagtggaggtacaatatagcagactattagctaactacaaacatattataatgagataaaagatgagagagaagagcatcgggctacagatctgtagctagctgcagcacggactccaaagcgcagtgtgtgtatgacaggtgggaccatatattaatagtatagtaagcaactattatatgaattaactattagattggctatagatgaattggagctaatagtgggctatactattaaacttgctcttagggtgtgttcggaacccctggttcccaacactaagtgctcgcaccgaaaacggagcaacgattagcgggtgattaattaagcatttgctttttttcaaaaatggattaaattgattttttaagcaactttcgtatagaaactttttacaaaaacgcaccgtttacccgtttgaaaagcgtgcacgcggaaaacgagggagatgggttgggaagaggggctgccgaacacagccttagacaccccatggacggatttctctgggctgtgcttgtgtacatattttaggctattcccaacccaatgactaggatgatgtccatagcattaaataaactgtcacctagaatgaagaatgatgtggcaagtgaataaatgaggaaagagaaggaaaccatgtcttgtatgagacatggtttctacacaacattcaagatattatgtgagataaatagcattaaatttaagtatggaataatggtgtttgcattaaaagagtaatatctagtactagtttcttaataatggaaagtttatgaaaactatatctagtgtcttggattaggaatgaccttatatatgtttcctagctagatactcctcccgttcccatgttgctagtactagtataaagcagtacggacatgcatggtgtcatggtggtgtatcgtgcgtacatgtgcatcttggtcttggcgaggctcatctgccgctggaatggatgcatccatcgaccatcggcgccggcggcgtggtccagattgtcggccacacgtacgtacgtgt

SEQ ID NO: 13072 - DNA, 1501 bp, Oryza sativa
accctcgtgctcccctctttcgtttcccactccatcccgagctccctgcgcttttccccgctctccccacgccggtccccattgccgccgctcgccagcgttctccagccgcgtgcctcagccaccaccgccgtctccgcgctgcgccgccgccaccgccagctttgccgccgcccgggcaagctcggccaccgctccatttcccctctccacctccgtagcgccgtagccacgcgaaccacctctctccgccgccgccgccgactccagccgcgtcgcgccgccgcttcggtcgacgctgacccgcgccgttgcctccctcagctccgcaaggacgaggaggacctcggtcgccgcccctctttgccggaaatccgccggagctcctccttcctcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagcca

SEQ ID NO: 13073 - DNA, 1501 bp, Oryza sativa
tgtctaattgcgaaaaagatttagccacaacacatatatttgtcctttaaagttttaaggagttgaggagaattacaacagcgtacatccgcaagaggatcaaatcagagccctatacaaaaggaaggatatgcagcgcacacatccgtccgtacagtcaagctaaccaaaagccactgtggattcattcacttgtcgaagtagccctcggtcctgcccttgaacccgatctggccgaaggtgagcgccaggaacagcccaaggtgccacgtcaccaaccacagcctgcaaattaatcacaaaacccacatgaacaattagacacgtagccactgaacgcttttgctactaattatataggagtactatactgcgtgcctgaagaagatagaggtactgaccagaacggcgagtcgagcgccggcggcgaggggaagtgggagagctcctggccgatgctggagaagaagagccccgtgaggctgttgccgttgatcgccgggacgctcgacggcgcgatccacccgatcagcccgaacccgatcacgttcaggtccctcctaagccagtcctgcggaaacctgcaggcccaacacacaacaccacgtacgcaccgtcagaatctcacgccacgtacgcttgctgctctcagaattcttcttgcaggtgatcctactactgctacttacgtcatgcaggtgatcctgccgttcctctccaggttcctcgtcagcagcgggttcctcgccgacacccgggcgcccgtcgtgaagcctgcacaaaaaaatcgagcattccaagatcaaattaaacacacggttatagcgcgtgagaagatgattgtgactgtgacgcacgcaccggtggagaaggccggccggcgggcgagggtggcgccggcgaggccggagacggtggaggcggccatggcagctaagctagcagatggtctctctctgtctctggtcggcgagctgcgtgtgttgtctccgtggtttgtggcagcgtaggttaggccttattttgtggtggtggctgcggttgcggacgtggcgggaggggatgagcgggcgcggatcgttgtgggggctcgcgtgatgtggatcacttgcagcggatgaaatagattcgtcgcccgtgcagcggcctattgggagactccacttggatatgagtggataaggccagtgccacggctgtttctgccgtccagtatgctgagtactcagctagtagttcctaccgaggcaaacttaatttcgtcagtagaagactatggcagttttgtggagattatggataccccatatttacacggcatgtatatccgactggatatggaatgccatatataggtagaatatctttaagggactcgggttacattccttaacttgtatatcaaggaaatactcgggattctagtcggttacgactgtattttatctttatttgcctattccgttaggaatataggctataccttgtaatacggactcct

SEQ ID NO: 13074 - DNA, 1501 bp, Oryza sativa
atgcgttaacaaaagggttgccagcagcgagattggcgacagcacggcacctgctaggtgttcgtgattttgggctgtagcagaattaagggggagtttgttgactgttatttcagctatggccccaaggtgatccaggcgatggcagttgcaacggctggatgaataattcagttttgagtttgttatgcatgcacgagagatgtggcgagctgcaggagtagacgaccgcgtcaggcgtgcgttgtgggcgtgagttttgcacggcattggatccaggagttccggatcgtgggatggcgcgattgtaggcttggattcgttttttctgttattagagtataagtagcagtagctaaaatttccatttgtaagtttttcaattcagttgaatgaaagaacctagaaaattgtcccacaaattccttctctctcgtgattctctaaaactttgaaaaactctgaaatagcagctaacactggcaagccctacccacgtgtgcgaccggccggctagccctcctcgcgtgtgcgaccagccggtgagccctcccgcgcgcgcgatcgactggcgtcgaggccagcaagctcctccccgcgggctcgccgcggccggcgagctcctaatgagcgtgcgactggcccgcgaccgctccccacgcgcgcgccgcttatggcgagttccttcctgcgtgcgcaccgcgccggcgacccctccacccgtgtgcgccgcttctgacgagctcctcccggccggaaacacctccctcccccgcggcccgcgcacgacacggccggcaagctccttcccacgcgcgcgtcgtggtcggctgacgagctctgccccgcgttctgctgtgagaggtgatggaggaggaagaggaacgagagacgggagaggcgaggaagaagatgaagtggtccttgatgggtggggtccacaagctgagtcagctagtcaatagggtcaaagctgccacgttagataaaaccacctttcaaatcacttaaggaggcgatttataccggtttttacaaataagggaggtgttatactcggtttcgattttgctatatatttgtcgacaaatttttccccaaaaatttgacagatgtaattacagtacaatcgtagtgtaattacactgtaacttgtatgtaacttgtatgtaactttcaaaaatctctccgtaacatgttatttcggtaaaatggaggtcgtggaaacaaattctttcacatatgtgtgtgctatgatttgttttcttcctaaccaaaacaaatcgtgtaatagatctaacgattcaaaattatgttaaacttacatataagttatagtgtagttacatgcaagttacagtgtaattacatataagttacagtgtaattacactacgattgtactataattacatctgtcaaatttttggggaaaaatttgtcgacaaatgtataggtagtcccctcggttttatagatggccaaaaggcctgaggcccga

SEQ ID NO: 13075 - DNA, 1501 bp, Oryza sativa
ctgttaatctatggacgagagatggcatccgattccgtgttaattggttttccacgcactccgagtaaagcgagcgctgggcgctggagtgggagttttgcctgatacatacggagtcgatcgagggattcttatcggttggacttggggcgcgaatccgttctgctcccagactcgggcacaagaccactgcaatactaacacccagcgtgaacaagccaacaaaagattggacgcgccgtcgataccaatggacgagccatgagcaggcggccaccgcgacaggttcggtgttggcgcgcgagctcaattccgagcaggagctcgtacgtgcgcttcatggcgcgccggctgcatgctcgggaggatcgacgagccgcggcgagagcgtacgtggttttggagtcggagcgcgcacagggcggtttgcactgcgccaatggatcgaatgtctggatggatgcattatattgcatttctagttttttttttccctttgggtggggggattactgatggtatactgtggagtagttgttaagaacaaaaagacgaaaaactcgtcacactcccaccacccgggcacccgccatctgcgccacaccgctgggccgtcgtactatacgcctttcgctgagagagagatgtgtgtctctgcggccacaaaggctgcccctcctgtgccgatcctgcctcctatcatgcacagctgctcggcaacccgtcctgaaaactagctgctgcttaattattttcacttgttcgtgaatcgtgaccaatgcaacagctaagagaatgaactagctcgttctcgtccctactctacaattatctatgtgactgtgtaggaggaaacgggcgatggagaaaccggattcctggatgccaaccagacaattagacaaacatgccgctgctgcacgagatatggatcgaggcatcgagctgctaaacgcatgcccctgccgagtgaccagctagggtttctcctgagagtcgttctggcttcgttacacggtacgttagaggcaactgttttgatcgtgcagttttcttgagccacttaatggcttccccgaattaaatggtttaactatatattttcaccacattccgcaaaagacactgcctgaaacacaaaagtccgttgtattgcaaacattgcagatagagacagacaaagatatgatggccgccgcctcgccggccaccgcttctaggtctctagacccctccctccgtgcccgtttgtcttgttgatcctttgcaagattgtgtctttgttagttgaaaagcatgctttttgcttcttctttttttttttgctgtttaaaccacttgtttactaaaattagattgtgttgcctcgtctttccctcccccagcacagggtgaggattacccggaggatcagacttgtgaagcaaacaagctggcatcacagttaattgattcttgcgggaatgggtcttctcctgatgttaggtgctgcgagacgatt

SEQ ID NO: 13076 - DNA, 1501 bp, Oryza sativa
cttgcattttgatttataaaattaaataaattatagatgatgttgtttacttgcatgagattaaatatgcaattattgctagttggtgatgatgtggcatggttgcatattgagctttagatttactgggctttaactttatagaaagtatagatgtgagagaaaaaacggggatgagacaagattaaggctcatctgaatagggaaagagcacaagcagaggcatcctctacagttgagagacacatttacccgttttcgctacaaacgatagatctttttcctccgatgtagcacacagctctcatttgttgtaccacaatatcttccacaaactcttctttacagctgcatacaccaatatgtactacgtgaatcccctagtagcagagagacaatcttaatttaaaggtagccacctacttgaaataattaattaaggtggccacgatatacacagccagcatgatatatatttataaaagaaccatcgtgagaatatcggcttaaatttctgtattagcgtgtttctgttcttgttttgttcttccccttccttctgtttccatcattgtttggtgaactttaaatactttctgatcctcttctgaatataacaccagcttagcctagctttggtttcaaaaataatatatttatacaagaacaagaagaaactgatcgattgatgtacacctgtactagcttaagtttgtttctccttcagagcttcactcatggccgtttcctcaaaaggttccatggtttgatttgtcatgcggatgtggttgctagtttcaaatgttcagaacactgatggaaatgggaggcacacgggagtttagtatcaccggcatgcatgggtagcctcactggctcactgcatattactcggttttcaaactcgttgttaggtgcttatgctgatcaaaagcggaggaatgtacatgcctcttcaaaggaagaaccgatatttgactaaacaacttaatttcttttacataataatatttgacttaacaactagcatgttaatttctagtggtaaagtttttgtaagggaacctcgttgtagtatagcttaacgataacatgcccacacaccctttgttttttaatatatcatgaaattgactttttaaaattatttgagtattcgtccttttttagaaatatttgtataaatagactaacatactagacatggtgaaagtaattttgatgatagatctagtggtactattttcaatttagttaactaagtaattggataaatattatagagatactactaggagcgcagtattccgagcgccaaacatgtatcagctcaggtccacctcaccccacgtcccgtcatcccgctcccacagttatcagaataaacgatttactacgataaaaacaatttccatgcttccgatcctacgccacgtcccgtcatcccgctcccaccattatcgaagtaaacgatttactttgataaaaacaacttccctgt

SEQ ID NO: 13077 - DNA, 1501 bp, Oryza sativa
tgcccagttttagttgatgtgacaagttgagtcagcgtgggacccacatgtcagtggctatcactttcttcctctcctcaatctcctcttatccgctacttcttctctcttcctgatcccctccaaggtgaggtgagacggagcgtgagcatcaacaacgcgctgacgtggcaccggggggggggggttagcagttgcaacaattcatgctagtcaccttgagtgatcgaggtacctgacggcctctgttagagtttgtgtcgaatatgtgtacgtagtcggttacaatttagaacttggagttgtaataggtgttagggggtggagttagagtcaaactctgtaacccggcatctctcttaaatagagagaggggcaccacaatgtaaccatagcgactacaatatagcgtagatacgcgggagatgatggcgacgtggccatggactcgtagcggctagaagctatgttggttggggaggagtgcctataatcagagccccggggatgtaggcttcggttgaacctcgttatcaaatatcgtgtgttactatgtcgtcatctggcatgtcttgggtgattaatgattgaaccgatcgggaaggttagtcgtcgttccgctatatcgactaacttttataacaacttcgttgaggacgttggtggcgtcttgctccgacgtgccacctcaccaccattcattatgaggttttcccttatgtggagtgaaacctcatattggtgctgcactccgtctctagtcatgaagatcaacgtgttgtgatctctggtctctgcaagactacaaccgcaaatccaaacaactgttttagatcttggcacgaccttggatgccatcctcacacggccattgcatgactccatctgccaccgagctctgccgggctactgctgtgcttgcgcatgagagagagagaagagaaaagagggcagagagaagagagaagaagaaagggagagaaaggggaaagatagtggcgatgatgtgggtaccactatatttttttaattgaacactcattgacatgtgggtcccatatttttttaactttaagtggaaccgctttgagaccttatttgcactggttttggaagttgagggacgcggtataactggtattacagttcagggatgaattttaaactcggcgacaacttgggagacctcaattgaacttactcctttgaatatggaccataaaccaaaggtaggaatccaaactttaaaattcagcccgtttgaaatatggaccgtaaccgatggtggaggtaaaaaaccttacgtgggcccccagaaaaataatgtgggctgacatcgcgacggcccaaggtatgggcggccacgtcagctgcctcctcggtcctcgcagttcacacccccaacaaatctgtttgtctctgtctgcaacaactccaccaccaccaccaaccggaggcgcctccgcctccacggccactataagagcgcggcggcggcggc

SEQ ID NO: 13078 - DNA, 1501 bp, Oryza sativa
aggcgcgtatgtatcaaatactcctaatatgtacgtgtgctggtttgatgatggaagtttacatggacacaaccaagaacaagtctgtcttgtcttgtgttgttgctcatccaaattcaattccgcggcggctcactgcgcatcgcccggccgaccatggatatttctacgtgtcgcgtcgcatcgcgttagtttcacgcggctcggaattcggaatatgaatgctggtcaacgctgcgaatctaaccaccagttatacaaaaacagatctaagcaatttctttactaatgcggagtatgcctaatacaagtatacaacaccgcaatcaaggattggagaacgatgaaaagattccgaagaatcactggtaagaatcaaggattggagttttgttaggctgtgcttttaagttttaactaaggttcacaacctgtgctactgtgtttttcacgtgcacacttctcaaactactaaatgttatgttttttttgaaaaagtttctatagaaaaattaatgtaaaaaaatcatataatccatttttaattaatcatgcgttaatttgtcactctattttacatgcagaggggaagtattcccaacacctaaaaaaacacggccttaaatatattatttttaaaccatacatccttatgacctacttcggctgtgcaagcgcacgagtcctaaagaataaagtgaaggaatacatagaaataaaaaaaaaagaagaagggagtcaccacaaccttcccaaaggacaaagagacatagtaaaagcaaagtgagcataactcaactggttaggtttcttgctacagaacctgttcatctaggttaagtcctaaacttgacatgagtgctcgcattttagtgttatgcgatgtacccatcaacaataatgtgtccgtatcgacttcgtcaatctcaagatatgtcgggtccagccttttaaaggtgctcacaaggatatgatgtgcgtgtattgaatattaccggagggctttctgctactcggaagctagctcgatatcccggtgatcgaaggttgtgattgcctaacgccaccaacaccaagccatcaagaatcccactttatcatgttattgcttagatcaatgcccaccgatgcacttgtgggtccacactccattaaatgttacttctctaggcctcccacatccaattatcttcgatcaaacttcatcaaattgtcatctagttcaatacactccaacgtcttttcggggaaggaagccccaaaggaggaagggctattgaagtaggatgtagacgaacaggaaactagacaaaaaaaggaggaagagctgttgaaggaagatgtagacaaacaagaagcgtgataaactccaacgcccttttgggaaaaggagccccacaagaggaagagttgttgaaggaggatgtaaactagcagggagctagacaaaaaggagggagggctattgaagaaagatgtagaagaacacggatctggacaa

SEQ ID NO: 13079 - DNA, 1501 bp, Oryza sativa
atattcatctagttatagaaatgataaacgtatatgattaaataatgtgaaaatgatgtggaaataatgatttgacattgcttatatattgagttttaaaaagggttaattggatccatgccactagaattttgccatattagaaaattgccggtactatttgcgaaatctgctgagtgccactggaactttgtaaaattggatccatgccaccgccgtcgcattttccatccatcgccgtcactccagtgtgggacccacacgtcagctccaccctattcctccatcccctctcttctccctttcccatctctctccggcaaacaacagcagcaggtggccggcggcggcaacggcagcagtcggccgacgacggcggcaagggccacgaacgccgccgcggaattcccagaccggcgatgacggcgaggccatcaccgtcgccgccgcgtcgtagcttgtgtcagcttccaccgccgcgatgtcgttccaaagctggtccatggtgtagtccatctgcagctggcttgccggcgtggtggccaccaccagctggtcgacggcctcttcgtcgctgcctcaggaggtgcttctttcttgcagcgccaccctcgtcatcatcgtggtcgtcgtcgccgtggtggctgtcgtcgtcgtgggccaactcgaacagcagagtcaatgatcgtacgattagcaaagaacatccacgtgattgcaaatcatcaaagcaaataagagattggacctggatttcttggcggcggtgagatttaatttttggtgttgggcaaagagctgcggagcacgagtgtttggtgcagacaactatgaagggcgttggaggttgatcgatgctgctgccggccacctgctgctgctgtttgccgaccacatgctgctgctgtttgccgaagagagacggggaagggagaagagaggggatggaggaagaggatggagctaacgtgtgggtcccacactggagtgacggcgatggatggaaaatgcgacggcggtggcatggatccaattttacaaaattccagtggcactcagcagatttcgcaaatagtaccggcaattttctaatatggcaaaattgcagtggcatggatccaattaacccttaaatgcatgatatgtcatattcatttaaaatactccagatagtacacgcgcaaaacaattattgggccaagacatttcccttgatgggatgggccgatgtgccattggcccaaaaggcataaatttgcgtttgccgggagtcgaacccggaccgttggactacacaaggtggtgtttgattggagagattaaagtggggctaaactttatttcccctcataaaaatataagtccttatcacagagttaccaaacacccccttagaatcaacggcccggatttatgccccaacttccgttccaaaccgaccgggttgaccagccaggcaggctcgactcaagcccgaccccgccggccgccgcaatgccgc

SEQ ID NO: 13080 - DNA, 1501 bp, Oryza sativa
tcgatcgcttggtttttactatactgcctgaattactccattcttaatttctcgggacggatgaaacggattggtttaatttgtttgtaataatgtatatcaagctagctagctagcttaatttggtgatgatctggataccacaataagacttttggaactccttgtgatatgatggtgaggtgtgggactgattaagaaatctgtatctatgcatatgtgtataagcaaactcatggatcggtcactttcttgtctgatcaagatccagataattctatctcggctttcgttattacgtgtttttcaaactgataaatatatggttggtttggtttgtgacctaaataggccttaccaaattttgttggtgtcaaattttagcaagttttggcatgactaattttggtaaggcaaagttgtgtttggattgaagccaaaatagtctaagttcactattaaaatggcctattttcttaggcatgtcaaaatttggcttcaaaccaaatagacactaaacactattgaaattgacaaatattggtaagcctaatttaggcctcaaaccaaccagcccatagtgtcttttgtataaaagttttctatgtaaaaattactctaaaatattagacaaattaaaattttgaacttgtaataattacaacttaattaattaagtaataattgttttcaccatgtcttaactttatttttatctttagcagaaaagaaacacctcatcaatcaccaacaattccttcattactgtacaaacgaccagccaatataatattagtccattaatcagtagtgatatttgcaaacttgtttgtcctggtgacggtgccgattgtgacacatatctctcagagttgttaatttgcaattataaaatacaactgacttctaagtattcgaacattatattagttttgtttttcgttttaaacaaagactgcattaattaagcacgcgtacgtttgtgatgctacacttttctcagaggctaattgcatcaacctcatctagctagctttagcacttggtaacaagcagtgtcaagtgatgtaattgcagatgagagatcagcagggagcagcactaagaaccaacaggaaagggcacgttatgattagcaacagggaagaaatgttagctagtggggttaactgtgcaagctagctagcatgggtcgcttttagctagctagttagcatgggaaaagggacaaaaaaaggatgcattattacctgcatatattgctgcttcttacaaaattaatgcttttggttaatttctctgtcagctagcttagctggggaatcagaacattttaatgaggatgatatttccgaatcagaattaaaaatgagattaatttgtacgttatgggagtaatattccagctgaaagctaattaagcaagtaatactactagttgctagtgctggacgaaccgatcgatccatgagattcaggcgtcacctgaggaaagagagag

SEQ ID NO: 13081 - DNA, 1501 bp, Oryza sativa
cacctgtttcctaccgagcgtactctgatcggctaacaagaacacgtacatatgtactggatctcaaaagaaaaaaaagaacacacatactgctagtaggtaaggcgtattataccaagataacaggcaggatacactatttctttttcctgagacgttttcattacacaagacaaacgccacacgtacataagtatataaccaccagtacacactcttccaacacacatatcctaaatcggataaatactttgtaaattaaattaaagtgctcgaaaattttatatttctttcaaaataaaaaaaaatcattcagatactattaatgtaatcacatatctagatttacaaatttgtaaagttagaaatatccctttcaaaaaaaatttgcatttgaaaccgtgtcaaaacaagcctgaaacaatagtctttacatgcctttatttgtctcaaaataaattcatcttttagtaatcattgcattggagattgtgaaatcagctaataatcatattggaagtaggtaaagtaaaaaataatttcattagaatttaataaaataggtttttttttagtttgtactaccgtggttttataccaagttactccctccgtcccataatataagggatttttagtttttgtttgcactacttaaccactcgtcttattcaaaaaaatttgtgtaaatataaaaaacgaaaagttgtgcttaaattactttggataataaagcaagtaaaaaaacaataattttaattttttttaaacaagacaagcgatcaaaaagtacaaataaaaacttaaaatcccttttatcgtgggacggagggagtagtccttaccgtagtactagtattttcacatattgaatttttgtcacgccttttgtggctttgtccttcccaggagcgtgtaatacgtgtcttacccacaacgcctctcttcacaggccagtgagccactgcttccccaaccgtaggagcgggtacatataaaacgctcgccgccgttcgccattcgtttccacgcatcccttccactgactccactgcttctcacccaactcgcgcgcgccattccttgccttctccgccctctcatctcatcaaggaaagctcgcgctcacgcatcgtgtcgctggccatggccgtgcaggcgcagcgcctcgcccaggctttcccttacgacctccacgcggcggcgagcggcggcgccctgttcctggacgagctcgccggcgagtgcgcgccgcccatggcggcggtggaagggatcgggggcgcggtggtgttcggcggcgacaacggcgagtacgggttcgtggagaggaagcggccgcgcgtggcggcgggtctgttggaggaccagcgcgcggtcctggcgcacgcgatggcggcgccgctgcaggggatcttgcccttcggggatgtggcgggcagggcggcgtgcgccggcgcggcgtccaccagcgggaggaggatggacggtgcgggcggaa

SEQ ID NO: 13082 - DNA, 1501 bp, Oryza sativa
acaagaacggtgatcgattaatttccgtaacagagctgaactagcagcatatatagtactcctatacgtaccccgagcaagcagccgtacgtacagttgcagtgcaaaacgatccaaagacaatctgcccaccgtgacagcagcagcagcggcagctatacgtacgtacatcgcacgtacagcgcgcgctgcggcgtacgcagtccgtgcttgtcttggcaccgatgaagcttagcgagatactccgatccaccacgcacgtacactgcaccgcgcgcgcaggctgcagcttgttgttgtacgtcgtcgccacgcgcgccattatattgatggctcgcaccgaccgaccgaccggccggcacggccctgaccgtcgagccggccgccggggaggactggctggtggaccgcgcgcccgcgcgagctgcagctgctgtacccaactagctactacccatgcatgcaattgcatggggacacgcattaagattcgagcagccgtgcacgcgagccgcgtgatcaccctgcctgcaccctgatatactgctgcctctgggcctgcctgcctggccgtgcacacagctgcatgcaaaaacacacagtatatgtcagccgtgctccagtaggcgttagcgttacattacgtacgtaatccatgacattgtcaatatgctaatgcggtaatgccgtattactgtcatctgctaactgcgatgcatcatgcgctgtggcgctaccacgtagtagtacggtgtacgtgcagcgcgagtacgtcagcgcctacgtctccggggggagtcgatcggcgaccgactgatcgatctgatcgcgcgcccgcccgtaatgaattcgatcacacggtcggtggccccgccggcctgggaaagctaccgcaaattaaagcccgcccacatccgatccccctttcgtacatactccctccgtattttaacgtatgacaccattgatttttcgatcaacgtttgatcattcgttttatttaaaatttttgtacaaatatgaaagtatttatatcatgcttaaagaacatttaacatttgatgatgaatcacaataaaataaatgataattgtataattttttttgaataaaacgaacagtcaaacgttagataaaaaattaacggcgtcatacattaaaatatgaaggtagtaatacttatacctgcggctgtccaccagaacacacggactaaccgatcaatataagcatgcacacgcatcatggatggatatatggattggtgtactgcgtgccccgtcgtgcatgcattactgcgtacgcgtacgttcctagtagtcgatcgtagcgcgcaaagcatggccagatctgcgagtctaatggcaacacgcatgcacggccgtcggggtagagagctatagtatagtagctagcttacataagctatagccccatgaccacatcacagtaaacgtaccacatacttccagtgaacagtgtcacatgccgtgtggagtca

SEQ ID NO: 13083 - DNA, 1501 bp, Oryza sativa
actatgcgagaaaggtagcgctgggcaggcaacgccgatgaaccccgcggtttttacctcccggggaaatgcaaccatcataaacggatctgtacgtatcatacccatgcttatactgctctggttggttaagcccgtggtgacacaccagcatatgcggtcgctgggcctgggcccgtacgtggcgcgtgccagtgcatgcctccctcggcgagcaatctgcacggctggccggcacggcacaccagtggctgtcactcgccagtcaccaccactccaccagcgagctactagtccactgttgctacggggagcgcggcggccacgctgcggcggaggcacggcgcgcgctataccggccccatgcacgcgcgacgagtgcgtgatgtgtccctctcctatcctatcctatagcccttgtgtgttcgtttgaccctgactacccgatagcgcggcgtgccggcactcgatcggctgctagctcccaccaccaccgctaagatggtgcccgttgctctcttcgatcgcgcgcgacgagtagcgtagcgacgaatctctagctagctcgatccgatcgatcagtaacatccatcgcgcccctgcaatctcatctcatcgatcagatcgatcgggcatcatccacccaccgccacatgatgcgtgcaccggccggggagagcatcggggaacagtagtgtggatgaaacatgtctgtagctgtgcgcgacaggcatggcctggctgaacgaacggtggtgaacgccgtgctcccgtgctccgggaaacggtggcaaaatcgcctgcagaaaggccaacgtacagtgcgcatcttttgttactgcatgcatgggacctactagtaatttgccagaagaagacctttacataattatggttggagccaaacacttatctaagttagttaaatttgctaaatattaggcgtgaaaaattatgacaaaatatgggtggcaaccaaacaatcctttaaaaattaagaaaagactaaaatgtcccttatctatacattttataaagttacagcccattgtaccttaatgcttaaaattcaaatatgcgactcattacacactaaagccccctttgattcaaaggaaattcataggaattttagaggatttcattcctatagtaatttttcctatatagccctttgaatctaaggaatggatcttatggaatcctatgaaattcctatggaatacctaatgcaatgcaagttttgaaggaattctaacatgaggtagaagctcatgaaaactttcctttgagtctttatctcttttctaattcatgtgtttttcctgcggtccaatcaaacggtcattcctgtgtttttcctgtgttttgcaatcctctattttacacttacattcctatcaaaatcctacgtttttactattcctacgttttcttgttcatgcgattcaaagaggccctaattaatcctatattttttcttattccttagtttttttat

SEQ ID NO: 13084 - DNA, 987 bp, Oryza sativa
ccacgctgccgcctctgtcgccacgccaccgtgccaagcgccggcccgatgccgccacaccgccgttaacaaacacgtgaacgagaacgaacacgtcaacgtacgttgccgcgagaacgtgaacgagaacgagaacgatcgaacgaacgagagtgagaacgaacacgtcaacgtacgttgccgcgagaacgtgaacgagaacgagaacgatcgaacgaacgagagcgagaacgagaacgatcgaacgaattaacgtgaacgagaacgacaacgaacgtgaacgagaacgaacgtgaatgagaacaagcgaacgaacgtgaacgagctagggaacgtgaacgagcgaacgaacgtgaacgaacgtgaacgtgaaatgcaatatatatatatatgctacttcgtatttatcctaatacatattttttgtatcttgcagaaaagacgtgctgtcggagtcgtccctcaagccagagtggaagagctagccctagaaggaattcgtgcaggcaagtgacgtaataatataaatgattgttatatttgtaatgcaattaagaatattagacttgtaattagacttagcatataagattgtgtagtgttctatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtcatattatttgagttttaatgtaagattattttatttgtaattagacttactatataattattgactacggaattggtgcgactcctagcaattgacaattttagtcttaattagacttagcatatacgacagttacacctagcatacatgacttagattgttaaaacataaatgtctcgtgacttagcagatgtttcttgtatcaacaga

SEQ ID NO: 13085 - DNA, 1046 bp, Oryza sativa
cctgcaagaggttagtatacctaatatagtggaattttattattctaagatatatatgcattgcaagcatcactagttctcctctattttggtaatattgacggttgaaactgatcgataatgaccgtcaacacctacgtggcttgtttgactaggtcttcgttccatgtggcattgacgtggcgcttatgtggcaattctatcgcggaaaaataataaaaaccatgggcccacatgtcagttacaaaaaaattatttaaaatggtggggcccacgtggcccgacatgtcagcctcactcatttcatccctctcccttccatctcccctcactccctttcatcacttatttcttcctctccctttcatccctctccattccatctcccctcactcccttccatctccctttcatcactcatttcttcctcatcctcactcctctcttcttccgtctcccctctctctctcttcttcctgttgagcgccggagcggacaggcgggtggacggcgagcaggcgagcgaggagggctgtccgagctccagtggcggcggctgctcgccgtgcgccgcaacagggatccccaagatggtggacaatggcaccagcgacaggagcctcgaccggcggagaggaggcgccgcagtggccggagctgaggcggtgggcgccgtggtgggggccgaggtggcgggggtggtcggcactgcagcgggtaaggtggtggtaagtgcaacggcgggcgcggggtgttgggccccacggccgagtggcgggggtggtcggcgcagcggtgggtgcaggcgtcttgttggaggagactggcggcgtggtggtcggcgcttgttggtatttcttaacgacattcctagaaatataattcccaacaatggcgcataaatacttctggtatattatggttacagagttcatttgcaagcgcacggatatactattgtagcatatcacccgagagtattccaagggtatcgtatttattttatcctgtgggaagatcatgtagagagaactcaactaataatt

SEQ ID NO: 13086 - DNA, 1139 bp, Oryza sativa
ggaacgctgtcgaccccgtcgacccgagccgagtcgccgccttcctccgctccggctgcctttttcgtcgtcgccgtcgacctagggtgagccatggaccgccgcttcttttcccccttcccttcccctctctcggccgccgctccgccgtgcctatggccgccgccggcgaccataggggcgcgggcgccgcctcccgccggctgcgccggcttggccgccctcgggcgcaccgagtggctgccgcgtggggcccggccgtcagccgcccgcgccctcgggtgcggctgacgcgtgggacccacggcgctggtcggtgtgagcccgggtgcacccggtccaccgtggaccgtgaggctgccgcgtgggccccactcccgctgacccggtccgcgcgccccctcccctcggctgacgcaataagcccttttaaaattaaaatttaaatgaagaaattcgcaaatattcatttaaagagcatataaacttcaaatgaccataacttggccatttgaactcggaattggaccgttcaagtctctaattttttcttaagaagtcaagaacccatttttgtgctttgttccagcttgttatatggagtttattagagtaaaagccttttcttttccgttggtcgtgtagacgccgcagcttcggaagatccgctcttcgtggaagttgaagccgacgtttgggaaagcgagcaaggcaagtcacatcatccttgaacatattgaatcccagtttataaaattatgttgatttaaattattgcattatcgctttatttaaattcccgcgttatcactgttttatcaagccatgcctattttcctttgttatgaccttattattgttattgttattatttccttgttccccctagaataaacaaaaccccaactagtggacactctactcatggtaccactagtatgattttaggtagatgcttcgctggttaattaggcaacattaggtggttttacaactctagactttgggaatattctcatcacctggacactttggaatggatggattattgtggaattggattcacacctccccctctattcaaaatcctcaaaatggttttaggctgggctcggggtgcatggttttgatagtagcac

SEQ ID NO: 13087 - DNA, 1501 bp, Oryza sativa
aaagtccagatttgaaaattttgaaaactttcaacttgagatttgaaaatttttaactcaagatttgaaaactttcaactcaagattcgaaaactttcaagtccagatttgaaaactttcaacttgagatttgaaaattttaactcaagatttaaaaaccttgaactcgagatttaaaaactttcaagtccaaatttagaaatttttaagttcagatttaaaaattactagtaaactaatcactagtaaaaaaaaataggaaactaatcactagtaaaactaattacgattttttctcctactcatacggcatcaaactgcgaagaaagcaaaacaagaaaaaaagaaaaacgacggtaggttagcgaaaaaaaatcgcgtgcgcgcgatgcgtgggccgtgtaggccgggagtgcacgctgccggcgcccgcgcacgaattaggattcttgccaagcatgtgggctgaatgaatcatataccgcatatgggatttacttctattgggcttccacctgtgaccgttgagggaataagttcatctgaggtccctttacttgtcaacaaatccgattttcgtccttgaaccctaaaccagatacaacgggtccctcaactatcaaaaccagtgcagataaggtcccacagcagtttagatggcggttttggctgatgtggctattttgactcggtcttcctcttacgtggcactaacgtggcgcttacgtggcaattcgatccggaaaaataataaaacccgtgggacccacatgtcagtttcacacacaaaattaattaaaaaggtgggacccacgtgggccccacatgtcatcctcagtcccctcctcttcttcctcctctcccccctatttcccctctcctcatctcactggcggccactgggaaagaaacggcgcgtgggcgccggccggagggaggagaggagtggcgcatgtgcgggaggcggcgggagagaaaggagccgcgtgcaggcgccggccggagggagggttggagcggcgcgtccgtgtagtcggcggccggcgagaaagggttgcggtagccgacttctccctctacttcctctcccgccgccgctgaagacgacgacgacgatgacagcgacgggtttgacggcgtcctcttcttcctcctctctccccatctccctgaagatgcacttaaatcccctagtgggttttggtgattaatgacaaggtggttaaagggaactaatgtgtttatcaagttttatacacaggagtttagtcccaaagtatgttgtgatggctaagaatacatggagaccccctaatttgaaagatcttcatgcgagaaggaccgaaagtggttagactaggttttacactttcaaaattgagtttaggaaaaaccgtactattaagaggggtttcaagtgtggttctagggtatacaaagtgctcttagtcatatccatgagtcaaaagatttttggaatcatttttgaaaaatgattttc

SEQ ID NO: 13088 - DNA, 1501 bp, Oryza sativa
atgtgggtcccatggttttgttatttttccggatcgaattgtcacgtaagcgtcacgtcagtgccacgtcagatgaaaaccgggtcaaaatagccacgtaggcgccacgtcagccaaaaccgccatctaaaccgctgagggaccttatctgcatcggttttgataattgagggacccgttatatctggttttgaggttcaaggacgaaaatcggattcgttgacgagtcaaagagactagaacgggattgcgggctgcgtgacgagcatcttgggctaaatttgttgataggcttctgatgggtccaatatgcgccgtacaaatattgggctgaaccttcaagtgcggtttagaaaaggccgaaaacgagatggtcatgaatgcgccgggtctgtatctctctctctttctcgaggttgaaaactggagtagtatttttctgtttccagttttctgcttcttcgcttaaattctgtcaagtcctctctgtcaattcaactgtgaattgttctttctgaaaaagaaaaatcgaaatacatcaaaaggaagcgccgtgaggcgcgggcaactactgtgtgtcagtgtcaagcatcctgttagggcaagtactggaagcccctacatattgcccctaaatttgccatacataattagatgatgaggtgtatgagattgagccacccctcatgcaaggggcaacctttacacaatctccaagaaaaaagtgtaagatgatgtgagtgtgagctaatattggagtttgtatattgggagcgtatcttatgcacacatgccctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattacaaccttaaaactgtcagattttttgtttttttttgttacggctaaaatataatgaatttgacgttaagattttaaccctaggtgtaatacaattgaaagtatgtgtatgatttttttctagaatttttggtgacattttttagttgatgtgcacgtgtgtacacgtgagggcctgtgtgcataggatatgttgccttgtatattagatgtgatatattatactccctccatactcataaaggaagtcgtttaggacagcgacacggtctccaaaacacaacttttgacttcttttttctataaaaatacttattgaaaaatgatacatatatacttttatgaaagtatttttttcaagaaaaatctattcatataatttttatattttcgaactcaacaacttgagagttattcatttatattcccaagatttaacttaaacattgtcataaacaacttcctttgtgagtatggaggaagtatgtgttacctcttaattaatgagaagatgacatattctaaattaaatgtgacatctacctc

SEQ ID NO: 13089 - DNA, 1501 bp, Oryza sativa
agatgaaagatgatatggcaagtgaataaatgaggaaagagaaggaaaccaggtcttgcatgagatatggtttctacacaacatccaagacatcatgtgagataagtagcattaaatttaagtatggaaaaatggtatttgcattgaaagagtggtgtctactacagtttcttaattatgtggagtttatggaaactatatctagtgtcttgggttgggactagcctgcattcacttgagacatcaatttgggttaccatttttttttattgtttactgcaaagttattgggttaccattttttttattgtttactgcaaagtgcaaagttatgtgtacgtccaaccaaaaactatcataccagaaagatatttgtcaaggcttccacgctgtaaatattcgaagcagagagctctttcctccacatgaacaacaacatacttgccattgtgcagtacaaccttacgtcttgtgtcatagcagtagccaactaattgaacaatatttttgtgttgggcactcataaggttaacaaattcattcataaacttctcatcatcgagtgactctatgtcatggagcttcttcacagcaatctctttcccattctctagtactccctgttaacactaatgtcttgttaatatgatgttatcaacggaaatatagaaaatatagggtggatagcccatctagtctctcaaattttaccaaaggcttcatttggtcctagcttgaggtttcatttcgtccatacatctacctttaaatcatccttgagaccttaatgtgcaacatatagctatttctagtccacattctatttagaaaatgtccctttacccataatttgcatatactagaactaataaataacattgtaaatatactccccattatttcaacacatgagtgttgagctctaattaattagtggccaacagctggccatagtatacttttgcaagtacatgattattattttttacataaattactacgcaatacctattaggagtacgcaaatcacaatgaaaaaaacatcatataattataagatgtatgtttgataggaagttgggttttttactggaatatgttgggtctttagggggtctcatcagacgatttcactgcctgaatagtactccctccgtttcataatgtaagttattttaacattttccatatttatattgatgttaatgaatctagacatatatatctatctagattcattaacaagaatatgaatgtgagaaatgttagaatgacttacattgtgaaacggaggaagtaaggcatatttttctcattttttccatatatatgtgaatgagtggtagaaaggtcatttatcaagacagatggtgattatgtttacccatgtggcttcctatgtgggctcaagtatgagtttgaactaaaataaaaacatgaaagactaaaatagattaattgaaacatcaaagaactagaagtttggctattcacccaaaat

SEQ ID NO: 13090 - DNA, 1501 bp, Oryza sativa
ctaacctcaggacacgggtagtgcagggtgagagaaaactctacgcgtgggacccacgaatagctatgctgtttgggctggccaagtttggccattgaggggaggaatttagccagctatttggcttagccattctagtagagagactgttggagtgagatttttatgagactgttggagtgagattttttgctaaaatggccaaaatttagcttggagagtctcttggagatgctcttagcactgctttgttgttcgctcttccaaaagttacatgattgcaaggaaactcagggtgtgtttagttcatgctaaaattaaaagtttggttgaaattggaaagatgtgaccggaaaagttagaaatttatgtgtgtaggaaagttttgatgtgatggaaaagttggaagtttgaaacaaaagtttgcaactaaacacggtgtcaatactgatattacattgttttgttcatgggcagtttgtcagacatgttctagggtaggggcagccatgagcccatgacatagttatactccctccatcccaaaataagcataaccataaatttctgtgttaaactttaattatttgtcttatttgaatttttttttaaaaaaacttaaaaacatgagtcacgcataaagtattattcatgttttataatctagtaaaaataaaaatactaatcataaaaaaaatttcaaataagacgaacgatcaaagttgaacacggaaactcatggctgcgcttattttcggacgggtcattggggtcactagggtgatgaagggtcactggggtcataaactcacgcaccgcatgacgaatcgggaaaagaagattcacatattgcgagatttttagtattaatgttaaaaactgccaggcattaatacgtgacaagaagcacctctcttctcaattgccctacattacaaagacgtacagtgtccttggatagccctcatccaagtgtaaccacacgaacaaaaacatttcttgtttggcacaattatcagggacgattgagcattccacactcatatatacacgtggcggtggtgtggtgtggacaactgttaggcctaatgaaatgtggagcatagaaaatagacggcaaaatttgccacaggacacgtaaaatacgtgtaattggccgtaggacaccggtcgtattattttattatttttaggtaaaaaaaaaagtgagatatttatctaaatgcccggattgctctttctctttccttctttaaatactggtgggtcccacatgtcatcgacaacctatctttaatctaatttttaataggtttttaaccacatgggtctacgagtcatggactaatttatttgtaattagtagggtgattactatttggtaatcataagtggagtccacatctctctcctatcctcttcttcctcacgcacgcggcggagcggaggaacggcgcgacggcccgagccgggatggctcggcgcgctgcggaaaaagagg

SEQ ID NO: 13091 - DNA, 1501 bp, Oryza sativa
cttagtatttatacggagtgctctagtattaagattctggataagtaagaaactttaggcagattaaaagttagatatcgttgttttttttctcagaatttctaccatttctgttttttctcctctaatttgaatattagaaaacttacggagcatgaacatgtaaatgatacatgtaactatatggctaacagctgattatgaaatccagtacaattttataacctgaaagtgcggggatgcagaatattccatatatatttacaagaaaataatatatgtcgtctcaattaataatgatatgattacaacaacatatatacccaatgatccaaatatatctttggccattaagattttaatcgatacccaaatagacagatcaacacacgtgtaatacattaatcaaacaatatttgtaactagatccgatcgcaaaagtccggccggttccgctagctgctggtctcaacaacgtatctttcctgtaaagagaaattaaagggatttgatttaagtggagaggcgatagccgatcatttgctgcagtggaggactctactttgaaccgaaaggccgtccgaaatgaagagaaagaaaaaatgggaaaattaattaatcaggaattaattgattaggaacatggggatcttcgctggggtggtgtgtgtggacgtccacaaggcgagcccatcgatgatcgctctagctaatttaagcatgatacttagaataaagtagtgtagcaagtagcatattagacaactcacgttttcctcgcacgaaggcaccagtttagcatcaagcagacgagtagcataaagtatcaaggttagtaccttttttttttttgcggggaaaagttactagctaattgacaggcgaatagcgtgtagcagaatagtatatgtttcactcgatagacacggattaactttgcaaataatctacaggggttcaccggccatcatgatcttggtattgggcatatacaatgcatgatagctttgaactttgcaggtcacgagtcaaatgaggaacagaagaacctacgagtaggtaacaattaattttaaatttacatgtcaggtgaagttgtttgcaagataacgattcccaacgatttccacctggatggccatgcagctgtactccgtagatgataacgagagagtaatagtgtacagtagtacgctactacgctaaacgccacctatatattaacacggttccctgttgagtactaacacggttccatgttgaatactaattgagttgtttgactcgcgtaaaaacaaattcagtagtttcacaagaacagccaaaaaaacctgcaaattgctccctccgctcctgaaaactcaccagctttactcaatctctattagttatctccctcttgctaattactagtagacaaatttaatttaaatttaatactactagacaattaatataatcagttgagttcaattgattacaaatctaatgatatgtatct

SEQ ID NO: 13092 - DNA, 1501 bp, Oryza sativa
gcgcgcgtggattgggagtagctcggtgtcggtgacgagctccggtgatgccgccacctctaccctcaagctcggcggcgtctgcgcatcgccgcccatccacctccctccttgccgatgcattcgaccctgtgggccagcggtcgagcttggcgccacgctcgactgggagggccgggcgcgggggcttggcttcgatgttgaggtgctcaatccactggcgtagccgtcctgtgcctcacgccctcaccaccaccacctccattctccccactgtcgcgcgatgatgacctgtgcaatcaagaaaggtggtagggatgcgactagctcaaaccacaacaacgagaaggaagtagtagaggtgaggtagctctgcttgtcatagtgtccttgaagaaaccaagatgaatggaataggaggctgctgcttgtcgtccaatgtccatccgcaacctgcttgcttggagcagccaccgccgccgctacgatatgctcgctgtgtgtcattaccgccttaccagcaagcagttctgtaaggtagtgtttggttggatggtttcggtgggtcgggtcggggccatccctttttttttttggagctgtttggtttgaggattaggtgggttgggttggttaaaaaaggaagagtaaatttcatagaactacagatactttgcacaatctatcacaaaactacagatttaagaacttgtttcacaaaactacagattcattgtattcatttaacataaaactacatgtactttgcacaatatatcacaaaactacagatttaagaacttgtttcataaaactacagatttaatatcctcatttatcataaaactacaagtttagtgtctctattatcacaaaactacaggttgtagcattgtaaaaatctatagttttgtgataatggatacactaaatttgtagttttatgataaatgaagacactaaatgtatagttctgtgatatacactaaatctatagttttatgaaacaagtttttaaatctatagttttatgatagattgtacaaagtacttgtagttttgtgataaacggagacactaaatctgtagttttgtgaaacaagctcttaattctatagttttgtgataatttgtgtcaaatacctatagttttgtaaaatttacttaaaaaaagaatattccaccaatattcgggatgaactgaccacccaaaaaagaccggaccgatcgaacccacctctctcccgtcgcgcacgtgagttgcacgcgcccgcgcgcacgagcaggcggtggcagctcgcatcctccctccatcctccatcctccatccccctcctctctgaatctctactggtcaacatctcgcccttggctgctgcagcaacaagaggaagaagaaccggcgcccccacctggcctcctgtgtagagtaaggtgatagaggtttcagatgttttgagaatattctctgctcatgaacgcatccagtaactgctggagg

SEQ ID NO: 13093 - DNA, 1501 bp, Oryza sativa
gtgttcagttccaaaatatttcactaaacttttaactttttcatcacatcaaaattttttcacacatataaatttttaactttttcgtcacatcgttttaatttcaattaaacttctaattttggcgtgaacaaaacacagcctatgtatgtggctaggacaagagcgctagttgttgtcactacatgtcacgttaatttagaaaacaaaaaaaaattgggaatggaccgcatgtcatgtgtgatagtatctcattttacgtggttcatattgtggatttgttcaccatcctcattggaaacgattgttattcagatgagtttagattagtttccatgtggatgcatcactttaaatcttatatcttatagtttctaaatatgtagttctctgatcgataatagacaacctcaaaactgtagttttacgtacaacagtttgatatatgtagttgagtaaaatacacggccggtccctaaatttgtgtggtgttgtcacttagatccgtgaacttgaaaattgcacgtttaggttcataaacttggtttaatataccaccccggtccaaacgtcctttgattgcgtttgaccgccaacgtggcatgccacgtagataacacttttgctctcagcccctccgtatcacaacacgtcgcaaatatctccttgtagctatgtactgacaccagaataaaaaaaaatcctcaaattgttcttccatcttatttttctccttgcatgtatagagactgtggtcccaattatcaattgccattgctctgcgctccaaaatgaccttatccttgcacaacgggcacttgatcaacaacacctttttccggtgacttcaagatggggacgagcttggagaatccatggggatgcctagcgtgcaagacgcattgtgctgccttccgctgctaatccgaccgcactgtgccactgctaaccccgctgcaatgcgctgcctcctgttgctaatctcattgccgaggccgccacaaccgctacctctcggcctccttccgctaacctcactgtcgaaacactagccgatctaggaatattttggaggatttgggttgaaatacactggtcaagacaagttatgtgtgaaggtatatgtggagctgtggagggggctgcgcacaaaaatgttgccaacgtggcatgccacgttgacggtcaaatgtggtcaaaggatgataggaccggggtgcaggtacattaaactaagttcacataccaaaacatgcaattttcaagttcgcggacctaagtgacaccacaccacaagtttaaggaccggtcatgtatttcactctacgtagttttactaaatttacacatgtttgatttttcttcctctgtccaaaggttagttttgagtgatgtaccttctttatttacttccgaactgactttctatttaaaacatcttgtgacaaccaccaacccctattattatacttgtatatattattcatttttctcactttcc

SEQ ID NO: 13094 - DNA, 1501 bp, Oryza sativa
gtagacacttgcacatggcaagaattcaatagtaggttcaattcaatccattcctaaaatttttacgggaaaacttgggaaattgcagcaatgatgattgatgagcaccttgttcccctggtctcaagcggccaccggggaggaggaaggaggagttcctgacttgcaggagcagcacgtgcggatgatcaaagagctcaaccagcaggacgccatggacgctggtccggagcccgtgcgccgcgaagctgcacagatcaatcaaaccacacacacaaaattacatgatcgtcacgcatttgatcgagcaggtggcgggtagtgcgcgcgcgcgtgcgtacttggccttgaggcggagggcgcggtcggcggcggtctccaaccccgcacccgcgccaccagcggcaacatccctggcgccgaagtagtagcggcagagcgggtaaatctcgacacgcgccgccgccgcagcgggcgaaggcgcagcagcagcctcgtccgtcatgatctccagccccatgccggtgcagccgcccgccgatcaccgcaacttatatataggcagccgcgcgcgcggggatcagaaggcgacggagatcgacgggcagagcgagggtttgggaagcttctgccttggcctatacgagcctatacagggtttggtttggttatttgggggaggagaggagaagagaagaggagaagggtagagaaaggtcaggagcgggaagaatggcgacgtggcggggaggggagtggggtggttgggcggtgtgggtgtgggcccggactgtggtcgctagtcatgggcccgtacgggctgccgaacttcgataggccgtgatgatgtattgggccgtccaccaaggcaaacggatcggataaactatttaccgtaaccgtaatggaagatcactttgactccctcaactgaccaccgaatctaaatcgtatccctcaaccgcaataccagaaatcttgaacccccaacttacaaaatcggtacgatttgactcccttggtggttttggagagtggttttgctgatgtggcatatacgtggcagcgttgatttggtctttgtcccacgtggcattgacgtggcgcttacatggcattaaaatttaaaatatatgtgggtccatttgtcattcacacaaaaataattgtaggccccgctgacatgtgggtcccacgtgtcatcctctctttatcccttcttcctcctccctctcctcccttctctatctctccctctttctctttgtgcgtggggagcggcgtccgaatcggcggtggcgacggcctagatccagagctccgaatggcggtggcggacgggccgctggacccatcaaaccgggaagccatggcgaccacgccgcccgcctcgtcccagccgccgccgccgctgcctcgcgcgcttccttctccaccttctaccctcccgcgatctccctatccctctcccgctccgccgccgccagctgccgcggccgcc

SEQ ID NO: 13095 - DNA, 1501 bp, Oryza sativa
tagaattaatagaatactcatatcaacaagttgcaacttcttttccggaagccgatttccaaagaactccagggttaagacttcttttccggaagccgatttccaaagaactccagggttaagtgtgcttggcctggagcaatttgggatgagtgaccgaccgggaaattcttcccgggtgcacacgagtgaggacaaagtgtgcagaaaagacatgtgttggtctgtgaggacagtctatgacctataaaagcgggcctggcctaggggaaggcaggatgttacacatatcttctacaaagtgtgcagaaaagacatgtgttggtctgtgagggtagtctatgacctataaaagctgccatatgtaagcgggcctagcctgggggaaggcgggattgttacacatatcttctgtggactaaccctgtaggaaagttttcgaattaacacaataaattacagacatgcaaaggagtaacacatcatcttagtgtgcagaaaagacatgtgttggtctgtgagggcagtctatgacctatataaaagctgccagatgtaagcgggcctggcctgggggaaggcgggatgttacacatatcttctgtggactaaccctgtaggaaagttttcgaattgacggatgagtcctcacgttcaattcacactagaggtaagtcagggctcgggaaacaaatcaataaattgcggacatgcaaagaagtaacacatcatctttcaaggtgcacggtgagtatactgtcaaatgctcatttgttatgttcgtgcaattttacctcagccatgtatgagttttgcctaaacgaaaatttggtgaacaataaaaaaaattaaaaagggggttttcagaagtatctctaaaaaaagacggcaattgtgtgggatcgatgcttatcaaattttgaacccaatttctctttaacatgaatgtgaacaaataattttgaggctatgataaaatcttttcaattctttgtagtccctcggatatttgttatccactaaccttttgtaagaaataaaatgacaactaaggagcagtgtacgataacttcaacaccaatacctcactccttggtcttaggaaaaatagatgctcagggaaccaaacagaacaaatgcgaaactttgttgcattcaattcgattctaagcttggcgagacctatctagtattttggaaacataagaaatgctgaacaaatgttacagaattgacaagaatgctaaaaataaaaaaaaaaccccgaacagatgatacaaaatccctattatgaaactttaaggagcatcaagaggcgattcatagaaggccagtgtatactgtagtcgtagaagaggtgaagtaacatattaattaccactagcactctaccatccttgtttgaagaaaacaggcaggcaaacaaaaattaaatgtgaacatattaaaagaaagaaataagatagtctgtacatatttgaacattgtaaaagaaccaagc

SEQ ID NO: 13096 - DNA, 1501 bp, Oryza sativa
aggcgaggccgatcccggcggcggcggagaagggggcggcgagccctagctctggacgcggcagcgagccctagctccggacgcgccggcctccgcctggacgacgatgacgacgacatcgccgacgcggcggagacggaggcggcgagccctagcagcaccggcacgcgcggcggcaggcgcacgggcgcgctcctcagcatggctcgatggccggcgcgcacggagtcgcgggcggtgcggagcgaggcggccggcgcccggatccggcggcggcgcccctctcccgccctcccccgctcgacggtgacgacgacgacgttgccggctccgacgatgacgacgatacgttgccacagcagggcggcagcgagcgggttggcgcgcgagtagggcggcggcgcccggtcctgattttcgttttttttattttcgctttttttgggttccgtgcgggcggtataatttgaccgattattccgtgtggtccacttaatccgaccgcctgcccgcccggttgggtcgtccgcccgcgaaaatattaattttcccatacgattggctggagacgggccggacaatcgcacgaaaaaatcgaaatacctgtatggaaaaatgttgtccgtagtagtggctactgatttaactatgtggttatcgataattatatccagttgaaagtaatatgagttaatcgtataagtcgatatggattattaatcattccatcaggtaaaaaaatcaaataggtttgattttcgtttcataagcttccctggtaggcctgtcaactttttatccacgataacttatatatctacttcatgcagtccaagaaatagatagttatcgtggataaaaaaaagagtatgaataccctcttgaactatcacagtcgatcgaattacccccacccccaagctaaaaaagagatattttacaccctaaagtatataaacaggacaaataaccccctaacttaatctgaagtggtttcaatcctatatggtagtccaatcagcaattattttattaaaaaattggtgggccctgcatgtcatactctccctctctctacctctttcccctctcacctctctctctactcttatcatcctctctctctcaccgagcatagcaaggaggaggcgacatctgctgctctagcaattaatcccggtgtatgcattatattgaatgagaaaaggtcgctcgtgcaacaaatggacgtagtggtgtaagtgggctaacccacgaattcccttatagactaatggaataagttcatctgagatcccttaatttgtcaacgaatccgattttcgtccttcaaccggaaaatcagatacaacgggtccttgaactatcaaaaccagtgcagatgaagtccctcagcggtttagatggcggttttggctgatgtggcgcctatgtggctaatttgactcggtcttcaactgacgtggcattcacgtagcgcttacgtgacaattcgatctgg

SEQ ID NO: 13097 - DNA, 1501 bp, Oryza sativa
aggattcggggtggagggagagctagaaaaggggtagttccccagtttagagaaaggtagcataggcttggcagtgagcagtaatgagaagactaaggtggcatggtggcaccggcgtaaccaaagctgcagggatgaaagacggtggtaggcaatggaggtagcagaagcataagaaagcggcagttaggtgctttgtggtagtggtgacggatccaacggcaggagccatcaaaaacatatgtgaaaaacggtgcgaggcaccaactatatgaagaagatgagtgaggaaggttggaagaaatggagggagaaaggcgatggtgttgggggctaaccagaagacattgtcagcatagcctccggcgatagggaggcggacgagtagtggcacatggtgcgggagagagcggtggaccaaaaagatggcagcgacaacggaagttgcgtggttccgaggaagatgagcacgtgaagccaatggaggtggactagtgaagatcagcaaatcgtcaaatttgatagaggaattctttttgcaaatccaatgggtatataggtagtcccaattataaatgtgtgttgctttctttgaagaaatatctctttggacataagacacacatactatcttgataacgagctttctcgagccgaggctagacatatgagtgtgctctttcgaacccacgctatcgacaacttacagaaacataccaacactattaggatgggttcttttcagattattgaaacggattagttgctccatcctttaaaagatacattttctcaaaaacttttttatactgtataacttagataacttgctttgagttatttatctattaagtttattcagtaaaatgtttaactcattcctgtaatcaagtagaaaatcagctcattaatcttttccaaactgagcccaaaacaagcaaaccaaacaagttcaattaccatcatactcacaaaatccagggtaaagaaagcgtcaactctccaacacttctatgttgtcgtgtgtagacgattattcgggttgggtaaagtagtactctacatagtacatacacccctcgtactgtacaggccgtcctacataataattaaggaaaattggagccatgccattataattttgtaaagtttaagatatgccatcctaactcacatgttattgatttatgtgggtcctacatgtcattgagataccgatggcatatctcaaactttacaaaattataatggcatggttccaaattagcctaattattactacctcccacacgtactcctacaccactacgactactccagttaaatttaacagcagctccatttatatctcgctgaacgaaaccactgtagcccgtgcccggccggtcgtctaccgatgaaaaccacttgttcagatccaccctcgcggtcgtcacggtaaaagtacaaattttcccggccctccgcatgtaacctccgtacgtgtacgtgtgtgcgcggc

SEQ ID NO: 13098 - DNA, 1501 bp, Oryza sativa
cgtatctcgtcgaccaccgcgagtcactccctcctctcccactggtgccgcgcgccgctgccaactcttccgtctcccgccggcgccgcgcgtcgctccctcctcacccgtcggccgccgcgcgccgcccctcctcactcgcgcctggagagaggacaaaggagaggggagagagatgaaggggagtcggggagagaggaagaagaagaggaggggcgaggatgacatgtgggtcccacgtgggcccccaccattttttattaatttgtgtgtgaaactgacatgtgggtcccatgggttttattattttttttctagatcgaattgccatgtaagcaccacgtcagatgaagaccgagtcaaattagccacgtaggcgccacgtcagccaaaaccaccctcaaacccatcgagggacttaatttacaccggttttgatagttgagggacccgttgtgtctggtttttcggttgagggacaaaagtcgaattcgttgacaagttaagggacctcagataaacttattcctttgggaggccattaccaagctcagagtgttaatgtacaggggattgctatttagcacacacattttttactactttttttgtgaaagcttttatatgtaaaaatttcatctggaaacttcatttgaaaatttttcttctcaaacttttcataagaaactttggcgcgggctttatggattgcttataagcaaatgttataaaataaacaatgattaaaaaataccacaaaaactaacttcaaaattagtttttaaaatagattttggctaaaaaaatcacaatgaagaaaaacacaaatcaacttaaaaataaattttaaaatttaaatttaggcttataaatatgagcctaagcgaaacaatggggctagtagtatttttatgatatggaagggaggaagaagaataacgtgtgttgaactattgatcaccagatggtttcatagaaaaactactcctacctgatactattaccatgtactctctccccccaatccagatttgtagtactgagtggtttgatatatattaggacggaggtaggtagtactacgtgtcatgttcactatagaatcagtagttaattgtctaagtttgttgtagctaaacaaacgatcaattatatgtagtattattgtgtatagatatggcatgacgagattatatcgacagtaaccgtctaaacagcttttccctcaaaaaaaaaaccgtctaaacagctattcgtatcatacgggagaaaatcctataaaatccgatcgagctttgaaacagacgcacatgtcaccagcttgtggctgtgtctgcttacagatggcgatttgttgatgcatatggaatggaagccgccgtctgtttcatggcagccaacagtatacggctaaatatagcttgcagattcctaagctgatttgtgcctttatcactcgattaattaagcagagataattgtaccatgagagagcagttgc

SEQ ID NO: 13099 - DNA, 1501 bp, Oryza sativa
gggtagtgacctttgttatggtcaggaaaattgtttagcgacaattcaaggtgtcttggtggtgctaaaataatcatgcattggttattttggatgtttgcttcttggtcgatggcaaccgctggtggtattactaccacttatgtttatggttgtggccgttagcatggtgttctattggtaactttgatccagttagttggatctgacaatatcatatcgatgttcatttgtcatttctttatttaatgtgttgccacatagaaatctatggatgaaaatctagtggtgaccgttaagttggttctgacgattatgacttgggtcattgatgtcggacccgaaaccggcacctatgagggtctccgaacacctatgaccttttctgcagtagtccgtattgtttagtgtcatagacattatgttatagttctggatgtaggagcataagtcaacatgatatattcacgttgtatttattactcccttcatttcaaattgatctacatatttcataagtacatcaagaccaagaaaagttaataactccctcatactatatttactctatcaacaaactctatgcattcaccatccccaatatttcctagccaatagcaaatcaagatattgcatgtggattataaatagttgtgtgcatggatgcatgcatcaatgtccatttactctaatacacaaataacgaatagacttaataaatgaacacaaatatatagatcatttaggaataacctaaaaaaactatatgtagatcaatttggaatagagggagtattttttttccaagtcgtgtgcatcccttaccattaatgtgcaaaggccagaagtaatttcatttcttattgtactaaatattattaaaaaaaatcatgtgccgaccgttttcatgcaaatcctgaaatcgaaaatgtggatattattgggcggacatttcgacatccccgtcactgtaaccccgaccagaaaccctgtatccctcctgcgacgtaacccggtgatgttggcagccggccgggggcaaaggaatgatgtgcgctagctcgcaggtcgctcgctcgctcgatcgatccagctgcttcttctgtccattcgtgcgtgcgcgcgcgcatgattgaattgaccccccccccccccccctccggcggcgtggggacggcgcgcgcgcgcgcgatcggtgacagcgagtgtttcgggcgggtcggcgcccagccgggcgcacttcggttgatcgatcgctcgcgctcgcgcgcgcggcatggcggtgtgtgacgcctcggcgcactcagctcagctcagtcagctataggctatagctagctcctttgtctgggacgatgaatggttggctacgcatggggccatccagtactgcaggtgcaggtgcaggtgcaggtgggagctatttgtgacttgtgagggagcctagctgtgttcgttgggacactttctcaatttctactcacttgttttctgcacgtac

SEQ ID NO: 13100 - DNA, 1501 bp, Oryza sativa
acatggttgaagagcactggattttattttattttataacgaaagtgagacaacacaacttttgattgaagtgttcccatctattgaaacaatggtacagtaattctaatatgtgagttgcggtacaaatattatgtttggagaacaggttgggtatgataaataccagaaacaagccgagagagtgagttggtgtgatatccccttgtggttcagataattgtctgcaagcgtgtagtaaacaaatcgttagagaaaaaacatgaatccagtagaaaacaagtttcttaaccacattctaataccaatataatataaagaactgttgatttgtttattcggcaaactgcaacacattaattaatctgaaagtttcatattcaccccttccagcccatatggcagaagaatacatgcaaaagagtagccagattgcaaaatagaagatgattttgggcattttcaccttacctgttggtacttctgcttttttgtccagaagacggtggtcgagggaaggtagaggccaatcattgcattggcggagcctgtggacgacagcgagaagggaaacatggatgtactccggcggcagggacgggaggggccgacctcggcggcggcggatggggctgaggtcggatctggccgcgacggtagggaagaagccggatttggcggcggcagcagaagatgtcggcgtgggcagcggctccggtgaggatgcggcagcagtacgcgcggggaggagctccggcgacggcgaggatgcggcggcgctacatgcggggaggaggaggagcgagcgaggaggagaagcgaagtccgtgcgtggaggaggagcgaagtcttcgcgtgtggaggaggaggagtgaagtttgggcgtggaatcgtgcggtggtgaattcgtgcgcgcggatggacggtagggattaatccgagtgatttggctcgtaggattggaggggtacaactcctttttatattagtatagatatagatatagatggtggtaatcaatacaaattgtactctgtttgcaaaacactatatcattattgttacttcactgtcttcctttaccatccttttaaatctgctgctacacttattcctgagtaaggcaggttatatagaagtaaaggccctatcttttcatatactctttcaaataaacaaaaatcatgggaaaccagctatcaggcaaacgtaaactacaatgcatagatagttgctgtgcgaaatactgcgggattttgaagtcatgtcaggaataacgaacacttgaacattcatactctgtacaatttacaatcatgaaagcctggttacctgactgtcatagcctcttcgcttcaagaagcaagagatgataattcaagtttgtaaaaaaaaaaattaatcctaccaacataatgaactatggcaactggtgcccttgtaggcatttcactagcaatccggaccaaacgtgatcaaattgatcaaacatatagcaatt

SEQ ID NO: 13101 - DNA, 217 bp, Oryza sativa
gttgttacggtacagcggtcggtaccggtaccgccaggtaccaaaatcctagccgttggatctggcccgatccaacggctggtagagtttggtaccgggcggtaccaattctgtctctgtgcagtaccacgcggagaactgagatggaagggcaaaaacgtaacttcgcgtgcaataaccggatcgggagggatggacgggcagctcgaaccctaga

SEQ ID NO: 13102 - DNA, 1501 bp, Oryza sativa
cagcccagccgttgctagttctacttcgacacacgcctccagccgacatctattcttatctcccagccaaaccctagcatcgttgccacgtcgatccgtctccctgtgtgcttcctcatcctccaaccgattgcaaaaatcgattccccactcctcccttgtcattccccatgattttccctttcaattcggctttaatttgccggatttaatctccgtctaactgctaatgatggccggtcggcgagcttccttgccgcttttatcccgagttttgcggaattgggttgtgacatttgcatgtggattctctctgatttttgggaaacgaaaagagcaaattgagtggatcaaaagctcttaaccaattttgggagatcgagaaagattcggcatatttgatggggaggatcagctctagcatcatacaaggtacgtgactgtcgttcagaggttgaagacgctactatagcgcaacgagaggagacagctgacagtgctagctagacgctccacttgtgagccgagccaaagagataaaggtcaagccgaatgaggtaggagatagcgaaccagactagggctaaacatagagaaaggaatgaattttacctaaaactaaggtaggattgtacttactttttttcaattataatgtatagtgatatcaatattttaatttattgtttagctcttaacagttgtttaacatatatctctactacttaaaaaagtgtagtggtggtcttgaatccccatccaagcagccccatggaatatgaactattggatcgcgaaatccaacgcctcgatcgcctatcttttcttttcctcgagctctcggggttttggactatttgccactctcccgaatgaattcgctattttgccatcggggagagaagattcttgcttgtgtgccatttttgagcccgcaaggcgccacgtcacccgatctaatgacaaaataaccatcttacccttcttcttcatttctcctccggtctttttcatccccttcctttcccagggcgccaaggttattgggctccggtgagctccccgcctcgcacttctccctcctttgcttgctccttacctccacggcccctgctctttcttttgtgtcatcgccggtgccttgcttcatcgtcaccgtcgtcgccttctttctcctctcggctcttttccactctccccgatgtcggcggttgtgtcaagtccaacctcgaggcttcccctaccttgtcattcgccacctagcgccaggaggtcggtccggcggtggtggtggcggtgtcaccagctcacacgcaaggaggaaggttggaggagagagaccccgagctagaggaagaagataggcaagacggttattttgccctcggatcaggtgacgtggcactttgcaggctcaaaaataatactttgcaggctcaaaaatgacacacgatcaagaaatcttctctccgatgacaaaatagcgaagccaaccttgaga

SEQ ID NO: 13103 - DNA, 1501 bp, Oryza sativa
gagtgaatattcttaacatccaccaagtctgaacccaaagtgtccgtctccggatcatataaccgcatcacccgcctcgtgtattgcccttcgaagttggctaagtgcacagttatgtagatgagtatcctgccatcatctagaatcagtgagggatgtgcatgagggaaaatgtgttcagtgtcccaggtatccatctccaaaacaatcctatacttcttctcccaaatctgcttctccgagtccatcagataccagaggtctacgtaggatttgatctccgcgcttcgataatccgtgtactgagctacaaccaatgcaccactcagctcggacaatgacagattctggtacaccgacatctcaaggggctcagggaggatctcatcgatgttgttcatctccggatgggtcgccattggtccctccaggtatgatatccacctctcggagcagagatcgaacagggccatgtgatccatctcgtaggattcgcgatgcgcgttcttgacgccattgggacggccatccagcaagaagtagacgacgccattgatgacgacgccgccgatggcgtccctccggacgcacatcggcagcgccttcttggccctccaccgcatatggtatctgctgctctcgtccagactcaagatctcgaacagctgttcggggaattgcttgttgtggcaatccgtgaggacgcggagcaccttgtaatcgccattgctgtccctgccgtacttgaaggagccgtcgaagtcgctcagagatcttccccggagggagtgcggcgtcgacagcggctccggcaggtggacggcggcgccggtgatcgggttgaggagggtggccctgcaggtgtagacctcggtgacgcagaggaggtcgaggttggtggtggggaggacgaggtgggtggcggcttggcgaatgcacttgaccacgctgccggagaggtccatgaggaggacgtcgacggaggggaacacgtcgaagtcgagcacgccgccggcgaggagcgggccgcggtggcgcgcggcgtgcgcggcgacgaacgtcgcgtcggtggtgagcgcccgccacgacctgcacacgccgcggaggcggcacacgtccttgggccccagccgcagcagcacctcgaacagcacgtccgccggcagcgccgcgcgccgccttcgccgccgccggcggcggagggggaagccgtcgtccccgcctcgccgctcaccttggcgcactggctccgcgacgccattgctgacaaacacacaccaaatcagcaagacactttactacctcgagcacataaatatctttaaaccgataatctttccgacttacgtgtagactattcttttatgataatcttctcaacttacgtgtagactatgtagatgtcgctggagaagtgatttgagatgatccaaaagtgcaacaacgataatcttatctggtccaaaatgaaagtattagctagagaattatccaaagtgaa

SEQ ID NO: 13104 - DNA, 1501 bp, Oryza sativa
aagccaactagtacaatagattagctcttatatatagactgcacctcagtgatcaaataattaattatgtgtgccaagataaatgtgtatgatcaaaactaaactatatctgtgtagccatctgtatgatgtgaacttgtgatatcaacaagaattcgtaaaaaaatgattagtctttagataattactgctagtgaagtgttgatggaaagatccaaatcttatcacaattgcatcgctcctaaaaaaatcatctactttgtgtaaataaacaacaggtatatatcgagagaagatgtaaaaagaaacagaaaaaaagatccccaaatccactgacacaacagaactcagaaccacttcttctagctgcttgtttgctcaatcaacagaacagccacaaggcggcatgagatatggcatggcaacaacggcttcttcttcttcataaggacaacatcgatctagcgcgcagcaaccatcgatctgatggttcagcatgagaggaacatgatatatgaggtgcgtgggctttgatttggcaacagtggcggagcttcgcggcgtacgtggtttccaacggcggtggaaattgactccgaatctctgatgaacggcggtggggctcatgtggagtaggagtaggcgatttgtgcggacggaaaaagtgatctagagcaggagaggtgagagctgatgtagggaaaaaagtcacacgggatcgatggggttcggtgtggcccaattttttatcgcggaatcgtgtgtatcggcgggcgatagaagtcgcccgtttcagtgagctataggcttactataaagttaggtggaggagagaggtagtgaaaaattaggaattttggctctcatgcaagagttatttatcacaaattccaagacaaatacattaaatgtataagtgagagatagagtgaggagaaaaaaattgtagcaaaccttatagctaatctattactatatatatgttttggctttaagatgggctaatagtaggaagtgtgctatattattatccttgctctcattctctctctttgattctctctcatgaatttaatgatataaattttttttaagcctgctaagtagaactattgtacctgctcaagaactcacccttctagcttctgttcggcccatctggaacacactggacaacccgaaccgaaccatcaaccaaccgtccacgcaaaccaactcgccacgtagacttctataaaacccacgagcccgaatgcgcccgcgctcgaacccacccaaaaccggccatacataggcacgtagccgcatcgaaccggatccgatccgatccgacccaaccgcgaataccttctcgtcgaagaagcatcgaatcgatcgagagagaccgcgtgaccatccgcggagttcgtcgtcgtcttcgccttcgtcttctccatccaccaccgcgctcggcgaggcgatccaccggcggcgaggagaggcgcgcgggagcggccggaga

SEQ ID NO: 13105 - DNA, 1501 bp, Oryza sativa
acttgttctattcagccttcttctacggtccatttggccgctccgagtggtgcgtcaaagagagacgattttttttcatttttaatttttttaatatttacaaaaatattatatcggtgaaaatatttgcaaaaatataccctgccacccaagtggagggcagcaaggtgatgtggcacgcgacgctgtttgtgcattttgcacggaggtctctcggtgaaatgcaattttcgccgtatgtaaagttaagccctccgtgaccggcgaagaaaagttgtccgttgaatacttgaatgccttcggcgaaatggtcacctacgtctcgctcccactcccagactcgagtagtctggatgaactgccaatccgcgcggcgcgtctgtgcattagcgaagacaggagtggcaaactggaagcgcgtgcgcgcgagcgattcgtccagagtatcagtttcaaccccggcccaaaagtttattagctgcgtcgctcagggccatgcgcggcagggctgtgagggagagagacgtgacgagaagcccggatccgcctggcacgttttgggcccgaaatttcccctgcctcacactcgtatgtcagtcacacactcacaccacacacctgccggggtccggtgtgacacaggcgcacgtccagccaggcttatcctcctcacggtggcaaccaaacagcctcagaatccctgcaacgattgtgatttatgaacttgcgttttcatagctcgaccgccttgtaatttgttggccactcgagctcaagttagatcaccaactatggccagttgcatgcgtaaccgtgtagcgagcagatccagcggagaagaagagagaatatatgtctcaagatgctgatcatgttgcaacaaaaatttcagcttaatttcttatgatcggttcgatttgtaatatgtgagtatttttcagttgttcctatatcgatcacttgttcatccagtagctgcagactgcaagttctgatgaactcgatgcatttatgcatgtatgagaatattctgtcccccagcgtggaataggattcactcgcattgatcattaatttgatccacatctttgacgattagaccttactgagtacctgaagatacgtatgtgatagttgagctaatgatatttgacacatggaactcaatagaaaatacttgaacctgaaaattcctttttggcacgataagactccaggaaaatctagccaaatatttgtgtaggttctacagatgctaaacgaagaaaaatcttcccacgaagtatggttaccatacatgttgttttcatctcgtccataattatctggggccaagcactatttttcccccttcctcgtttttattgagaatcatatcactccacttggttagtgcaatcttttcctgttattatgtgattttctttagtttttttgtgtgccatggcttctcgctttgtgacaccactaggtacagtggactgggcaaagttgtttgttt

SEQ ID NO: 13106 - DNA, 1501 bp, Oryza sativa
attacgacagagtccacaccagatggtggaaaagatgccggagtcttcggggtggctacgacggcggatgggacggggtggaggcggcgatgttgatgcgcctgcgacggcggatgcagcgggtggaggcggcgacgtctatgcggcggcgttgaagccacggcggccgtggcggggttgatgcgacggctgctcggcggcctcgatgcgacggcggccgcggcggcctcgatacgacggcggcagacgcgtgtgcgacgcacagccgcggcggcctcgatgcgacggaggctgaagcttgtgtgacgcgtggccgcggcggccatgatgcgacggcggccggagatgaggtagaaggtaggagacgggaacagggtatcgctattggttgagtgggcggtgatttgcggcgccttaactttatttagtccgatcataccccttctaaatcaacggttagattagattgttaccttatggtccctcgtacttcatagtacctcatggtactcccttaaagatgggaaagatgctcttaggatttaagacaattttgtagctcctgcggcagatcacaagattgtgttcgcgccagtatctaatctaggatgttctgctcagattagttaactcttgattgatgtaagctgcagatcacttggatttgtagtacgttgtgttgcaaatctatctatgtaatggaataactatctcacttaacctttgcagtatgcaaaacttggtgattgagatatcatcagttgctttcttttctgaggaattacgtgctggttaactggtttctttcttcacacaatcgatgctcgagtcgagagtacgcccacgtgctcaattgcagaattgctcataatctctctcttttttttttttgaacggagaattgctcataatctgcaggaataagttcactttgggtctctttattttttatccagtccgattttcgtccttgactgcaaaaccgggtatgatccgtcccccaacttacgaaaaccgggcaaacgtggtccctcagcggttttggctgacgtggcgcatacgtggcttgtttgactaggtctccgtcccacgtggcattgacgtggcgtttacgtgacaattatatctcagaaaaataataaaaaacgtggctgcaaaaaaaataattttaaaatagtgtgggccatgtgggccccacatgtcagtctcactcctctcttcttccctctcccttctctctcttcttccctttccctctctctttctctttctcaggcagaggacggcgcgggtgggcggcggagcaggcgagctccggcggcggcggcgggcgtggtcggcgccgccgctccgcgtgaaggcgagcagcgcggcggcgccctggaagacgccatcgacgtcgccatccatgtcgccgccgccgaccacccggacgccctccgcgcgcgccggtacggcattgccaagcgcctctacaccgcgctcgtcatccttccgccgc

SEQ ID NO: 13107 - DNA, 1501 bp, Oryza sativa
ggatctgactagctctcccactgctgcaattgtagctgccgcctcactcgttgttgccctagccattgctgcacttttcaacgccctagctgatacttagagggtatcatgtctgatatcccaagtaccaaatccgatacctacctatggtatcatgctaatatcagcatggtacctatggatattatgtcttgtactggaggtaccggattaggtacctatctgatacctacgatatcgtgctgacatcagcatgcaatatttatttcgttggaaaggtataccgttctatagtatttcctgttcagtcattgatataacataaatatattatattcttttagagataataaattttatatcatttagaaggtatggattttataatataccagtggaaaaaccgagttatattatataacatcgaataacttgttttcttgcttatataccatccattaagggcgagaaaatatccattttacccatagggtataatgggtacccatgaatttcatttgccatgatccactattttttctcatcgatgaaaaataggaccacttgtttttctgttatccaagaaaatttagtgcgacatggcattgtgcaaaatctcaattttatccacgtcgcacgataaaatctcaattttatccattttacccatagggtataataggtacccatgaatttcatttgccatgatccactattttttctcatcgatgaaaaataggaccacttgtttttctatcatccaagacagtttagtgcgatatggcattgtgcaaaattgagatttgtgaaaagtaatctttttttctcccttaacggttgagtaattgttgacttaatgatgatggcatataagaaaaagagacaagttgttcgaaggtattgtaagaatcaagctttgttgatgatatattatagaacacgcactttgttggtaccattttataaaacccgctttcagaagtgcctgagccaatataaaatttctcgctgagtctcattggctaacttgtctgccaaaaacggatgcatctagcaaaaggttcctcaaacagtccttgtatgcactgaacgtactggtgcggcttgcttgggcaatcgtcaacggtcaagacgtactaaagagtggattaacaaaatgaatgttttactaactgtatagtgaacacaagcgggcacctatagtcgtaacgaccgccgccaaattgcccagttgcgtacgcgagaatcgatcgatcgagccgatccgatcagctagaatattcgaacggaataaagagaacatctccatgtcctgatacgtgtgtacacacacgtacgtacgtgtatacgtatacgcgcgtgtgtatgtgtacatatgtatatgtatatatatatatatatatacatatacatatgtatgtatgtatatatatatatacatatgtatgtatgtatgtatatatatatacatatgtatgtatgtatgtatatatatatatac

SEQ ID NO: 13108 - DNA, 1501 bp, Oryza sativa
ctacagccagcagggtgccccaggagcaggacctaccccaggagctgatgctgccgctggctctgctggcccatccgagaagccaggaggcgaggaaggtgatgtcatcgatgctgattttacagacagccaatgagcaggagagtagttaggtccgaaattttaaggaacgtttcgcgacgagtttgaaatttgttccacaagattgtaggatctggggtgtatctttttgttagatgggcacctttgcttcctatttgtggagttttgggcggcggagtttttgagttctgggaatttcacttccaaatagatgatgctttcgttgctcatacatacatattcttatgccctgtagattcgagttggcaactgcatggttctcaaaaaagaaaaaaaaggagttggcaactgcaccagcacaagaaggaattaccaaacttctggcaaattggtagcattgtcaaattttggtaggatagacttaatatttgccatattctctaggcatgatcaatttagtaacaaactaaatattatcatatatttatcaataccaaagtcatatatttatcaataccaaacaatacaacgatatagtttaaaatgacattaatgttcaattgtgattatcaaatcaataacaaactcctttacgattgtgccgcccagtccacacctgtttatgatatgctgccgtttactgagtttactgtagtaccttaatgcttgtcgataacgtccgatttgactcgcgggttttacagcgcttctccaaagtaacatgaccctataacggtacctgtctgttctaaaaatttatatctttcttatcttcgatatgtaaatcgttgagctttgttctatcaataccccttaccaacctcaattatccattcactaatactacttttcggtatatgtgattcttttgttacctcgttttgtatatctaagattaaaaataaagttattttgggacgaagaaagtaaaacttttacttattgtgattgttattgtgattgccaggacttgcgttacttttaatatagaaaatcatgaccaatgtgttcattatagatggtgtgataatatgtgcttcatgattgacaacttgaagcactattagagcgagtacgatagagagggattagctagcaacaaggtaagacacgtaggttcgaaagctagactggagcatagaggcgaggagagagatggcgagccggcgactaaattgtcactcgctgcacgcgtgctccaagagcgttgaagctttcctgtcgccggcccgcagccgatgccagcagcaccccaggcggtttgtgggcccgttcaactgtcgatgcggcgcgacccctagagaagtggcggcgtgaccatctcaaaacgggaacatcgagccagaatcagaacgtcgagtttaataagtatagccaattactcgctccaaatcatctgtagtcgatctggtagctaattcatacaatagataactac

SEQ ID NO: 13109 - DNA, 1501 bp, Oryza sativa
gtgccaacttcatcatcaccggcccgagagggtttcgattggcttggaaattcgccggtataaacatggttcacccggccgtcggcttggcgctgtagcaagcgggcgaactcggccgtggttagagctctgatcatcttcgatgcctctatttcggcgtcttccaaagcccgcactgcgaaaagataggaacacaaccgtttagtctaaaaagcgcctccataaaggaaatatgcggcctagagcaaaaacaaaaatcttactttcaaccccggcagggagaacaaggcggggaagcccaagaacttcttcgccctcgatcacggaaacgtcccacacacgagcgagaggggaaatccgaagcagacaaaactcctcacaaaggtcccgggtgcttagccgccgggcaaccttacgaaggagtatgagccgggactcgagagtcccattgatttccatgtttggcttcgcgttgatggaaacggcagaacgctaaaaaaggagccagttcgcctgggcatcttctgcgaagtagggactgctgacgtagaaccatttctgcatccagttcctgtcccacttcgccatcgatgcaggtactagccaagcatctgaacgctccggccgcagcatgaaattcacacagccgaaaacggttttcctcggacccgccggcgtctgcacgtctttggtcgaggcgcatgcagtaaacagagcggcaaatagctcagcggtagggacgaacccacaggttcggcacatccaagcgaaaaccgccagcttcaggaacaccgacgggctaagctggggaagcctaacctcatacgtcgagagcatcgaaggcaagaagttgtcgcatgtgaggcgaagcccagcggcgaagaatgcgcgcgaagacaaccgttcgcccatccccaagcgagggaacaacggcttcgcccccgcatgatccttggccctccgtgagagaaccggatgataccagttcgcccaagtcggcctctttgacaagtgatttgccaaggaagcacgaccatccttcgccaaggttgccaggatcttcgccagttgacccggccttggtaggcttgcgaggagccatcgggctcgtagctcaggaaagaaagggaaagagccgataggctaggggcacgatgatggcgaaaagctaaaaagcaagagaatgaagagagcacgaagcgtgtcaaacggtaaaaaagggagaacgtggggggagtgaaaaaatagcaggccagcttgggggtatatataaccccgtcgcgagaccgttcgcctgccaaccaatcgagccctgacacgtgtccaaggacagacgaaacggtaaattcccattgggacggagccaaacagtaaaaagcccgattacggagaaggaaaagtccatggggcccattactattcatagtaataaaagagactaaatagcccccttcgacgctttgcaacggatgcgaagaggagattttctcaagaaattttt

SEQ ID NO: 13110 - DNA, 1501 bp, Oryza sativa
ttcacaaaaggcaaaacataacaggtaagggctaatgaaactactattcctgattatcactatacctgctaccactatgagcaggtcagaaaatggaagaggtacttgtagtaaactgaacattctttcgcttgtaccttaggggagtaacacattatagacgaatcatgatgcgcagagcacattccaagcaagcaaacaatagaattctagttgggtaactttcagtaaccaatcaccttgttgttgatagcctaaaacaactagcaaaccgaaatgtaacaactagtgacatatacagggcaagtgactccaatctcccgcaagccgtatccaattgagcacaaggtaagactcaagtgacttgcaggaaaacgaggcatcacctactgaaagttaagcctgtttttaagcaccaattgctactatctgtttcacatcatacgagcgagcaaggacgattgagaagaacaggaggaaggttgcggggggtggattacgagtgagccgatatcggtgtcgatgtcggtggactcgacggcggagtcgaggtcctcgggcgagaaggagacgccctccatgggcgcggtgcggcagcgctcggaggcctcgtcgaacagctggcacatccgctcccgctcccgctcctccttggtgagcgcgtacgtcccgcacaccagcgccgacggccgcgtgggcgccgcggggcggcgccgcggcgcgccggagagcggcgggctcgccagccccgcgacgtgctgcgccagggacgccattcgcgctctcggcctacccgctgtggtgtgttgtggttgtggtgtggtgcttcggggcgacgagacgaggcgacggcagcttttcgggttgagggagggtggctgtgttatccggtggccgtgggggtttagccgtttaggataggcgatgggtggttttgggccagcccaggtaagaattccctcgcaaactgtgtgtgttagtattccgtctcggttaattcagctattaatgaggaaaggaccggtctagggtgtgttaggataatagaaaatagaagtaggattgagattagaaaataaacgaagggttaggattaaatagaaaagagggaatgaatggttagaacttaacgatgtcttttagtaggtgaaaaattatttcctattcctattagccaaacactgcctagggagtgacggattcggattaatagaatttgcgcatggccacttaataataacgagaggaaactactgatcaagtggtttcatcgaggatagttataactctaatatattgtaatcatatgaattaagaaaaagcgattatcagtgtttcaaggatgtaggcttcgactagacgccgttcataaatatcatgcttagtgtcttttatgctatatcataaagtagtcgatgaacagtacgaagtatatattcaactgttgtgacggtgtatggacggatgttttatcagtaacaacagaaaaaaaattgcattg

SEQ ID NO: 13111 - DNA, 1501 bp, Oryza sativa
ggagagggatagagagaagagggagtagtgaggatgacatgtggggccacatgggccccaccattttttaatttgtttgtgtgtgaaactgacatgtggaccccacatattttattatttttctagatgaattgccacataagcgccacgtcaatgtcatgtgggatgaaaacctagtcaaagaagccacgtaggccaaaaccaaggacaatactgctgagagaccttgtttgcacggttttataggttgagggatgcgttgtacccgttttgtgtttcagggatgaattttagacacgacaacaaattgagggacctaaagtgaacttattcaaggatgagacaccaccacggggaatggcccaaataccacctgcctgggccccgtctctctcctcttgtgtgcgtgcaggcccaaacccaaagaattccttgatgccggagcgaatgaatttgtggtcagggaaactatctttgatcactgcatgggatatcctatttgcatgttacttaactgttatgaaaaaatttgagaagatatatcaatatgtgatataacactccacaagcttacaagttcaaattcatatctatatctcataacgaaaaaacaaattaaaccgcagcttgttaacgtatatttacaattaaatttgttttttccgttacaagatatagaagttaaatttgaacttacggagtgatatatcacatgttaatatatcttttcaaatttttttataaccatttgactgacataaagacaagacaacgagggttatcccctcacgaatcaaaatcaacatcctttgtggtcatgtaatagttgaaagttgaaaggtgtgacgccaggtgtctgtcgtggatcatttaaccggtgccttgacagagaagagactacccacccggtgaccccgtgggggcaacggggacttggctgcggaaacgacaagtttctcaaattttctttcctaaaaaatatcacattgaatatttagacatatgtatgaagtattaaatatagataaataaaaaaactaattgcacagttagagaggaaatcgcgagacaaatcttttaagtctaattagtccatgattagccataagtgctacagtaacccacataagttaatgacgggttaattaggctcaaaagattcgtctcgcggtttccaggcgagttatgaaattagttttttcattcgtatccaaaaaacccttccgttattcggtcaaacatccgatgtaacactaaaaaatttcttttcgcgaactaaacaggccctatgtactccagaagatgacatgacacgacacggtgggtgtggtctcatcgatcggcaccacgtacgcggcctcggtctcaacgaacgaacgtctcgccggccggcctccagcttaatttgttctatataacccgggaggtgccatttgcaacgatcgaataccagcgagacaaccagacgccggcccttggaagctagctagcatgttcagcc

SEQ ID NO: 13112 - DNA, 1501 bp, Oryza sativa
cgaatggtcaaacgtgtgataaaaagtcaacggcgtcatctattgaaaaacggaggtagtatatgacaatagaggttgatggcaaaaaagtgtttggaaaagaaataattgtactagttgccttcattgttttcacttgctacgatcggtaggcactgatgagtttggtttgctggtaaagagggccagtgcattctttcgtctgtgacgtgaattggtgaatgtatgatgcacccttgatttttattttatataaaaaatagtagtactactctagtgtcaaatcccaatcagggtatcaaactatttttatcctagttaattctagtataaaagaaagcatacgatcagctaaaatggccatacagaaatatagtggttccccgaaagaagaaaaccaaaaactggactgacaaccttacatatactatatgagcagccaaaaagtgattataaaaagaccttatggtgaccatatacattatggaggtaagccacaatacactaaatggttgtttggatgctatattaacattttcattctttaatatatgagaaacgattttttatcctaagtcccaaaacataaatatctcgactagattaagaactagtaccaaagatgttttagtactagttaaagtcgaagtacctagaaacatctttattctcggttggtgttaccaaccgatactaaagatgcctccagggttagtttaaaaagaaagcagggctgaggtgagagctcttgagttcgaattccacatctcactttttttttgtcttagtatgcatcttgagatcgagatatttagtctcgatttactggatcggttgctacaaccggtattaaagatcgtttctcctgtagtttttaaccggtacaaatttataatacttttgtaccacactttagctaagttatgaccaacaaaatgtaaaccacactttagctagcaaaagaaaagtgtgccatacacttttgagttgatgacatatgggaccatgagaaatgaaagagaatcttatcacaagtgtggtcatgaaccaaacaatgagctaacttgatcaaacttgcctaacatgaggtgtaacaatgtttggcaaagtttaggaggtaaccaaacaacctctaaatgcaaaggataactccaaacttatggctcaaccacaagcaataaagtaatatgtaaaactaagatggttgataaaggtaataaactttacacttgtgaggtccatcttagtatacactcttgttttaagcattgtggcaataaccaagaaatagtgagacctaccttaatgttattaaggccataaatattggagatggagatgcctacttttttttctctctttatggatttggtgattatcgtgtgtatgtttttcaatctcctaaacgatatttttttaaaaaaaatctttttaatatgtaattcatttgtttgggcctcaaataattctaataaactcagttcaatccgatcatgtattg

SEQ ID NO: 13113 - DNA, 1501 bp, Oryza sativa
gtcactctgagaggcaagccggcgtgcggaggaccggcacgggtgcgacggccttgcgggtggcacggcgaggcgaggtggcgagcgccagcggggtgcggcggctgtgcgggcggtgcggcagtggcagcggctcgtggcgacaccatgcaaggtgcgtccggcggcgaggtgtagtggcgcggcgaccgtgcagacggtgtgccgtgcgagcacggcggcggacgttgtcgtggaggcgcgcaagtgcccctgctagcgcgcggagaagttcgtggtccaggcgagcgctacggtgcggagacgttcacggtccgcatggccgccgcgccactgcacctcgccgccggagcaccccgcaaggtgtcaccgcgagccaccgccgctgccgcaccactacacctcaccgcgccgcccgcacagccgccgcaccccactggcgctcgccgcctcgcctcgccgtgccacccgcaaggtcgtcgcgcctatgccggtcctctgcacgccggctcgcctatcagagtgacgctggaaggaggaagatagggagagattaaaagaagagagatatgagtgctgacatgtgggccgaagggtatttttgatatttcatgtgacttttctctcctcttctaccagatattattattttaattggggcggtgtccactggcaaattactatgtttatagagtgttttcccccaaaagtgagtttgggcagtgtcctagggttaaaaccacacataagcagtgtcctgtagcaaaatttgcctttaaaaaatggtggggctcacatatcatagtctctctcctctctatcccctctcacctctctatctctctctgatgtcgctcactcgccgctgagaacgagcagcgcatgcgccgacggtggctggcccgacgcagttggttggctgcaaaggccggcgaccgcggaaacgaaggtagcgtgatcgaggactagcggcgcgccagcggttgcgagtctcctcgaggcagaggccgaggatgtggcgtgccggcggtggccggcccatcaggctcaccaggcctcgtcctcctgtggttaggggagtagtggctcgcgccggacttacgcgagaaggcagccatggcgggggagaggggtgacgcggcggggcggctgcaaaggctgacgaccatagaggcgagggcagcgcggtcggtggcgaggctaaggcaactcggggtcacgggtgaggcagctcagggtcgcgggtgagcagtagggagaagagtagacgagtggttcatcgtcgccatcgccgtcgacgtcattggccggcgctgaggcaaaagcgccagcgctgttgctgctcccttccctggagacggcggtgaggcctctctctctctctctcaactcaggcaggcggcgagcgatgagtctgtcgatgtttaagatcgcgactagggtatttggatggtatggggatcgttggtaccaggtatatgcgagattgaggtaaaagaga

SEQ ID NO: 13114 - DNA, 1501 bp, Oryza sativa
gaaggattgatactcaaacaagcatcccaaacataacagataaggcgcagagcgattctgtccgcctcctacatgaaaactagggccacagttacccccacaaccacgaaccactgagacgagagaaggctcacccatggccgatgccgagctggaggcggcgcgggagccgccggaatccttggacggcggcggaggcgcgcggaccggcagcgcgggcgcctcgagcgcggcggcctgcgcggcgagtttggccgcctccttcttgtcgtagaagggctgcgcgatctcccgccgcagcgtgcgcagccgcttctcccgcttcgaccgcagcgacttcgccatctcgccgcccgccgccgccgcagaggtggggggaagaagggagcgctcgagctagggttttggggggtcagcgaagcgaaagaggaggagacctagccaccctcgcaaattggttttgtagcggccgccgcgttgctaacttgggccgggctttagtattgctggttccaaattgggccagcccaataggaagactactctttgagccttgttttgatgggcctaaatctcggcccatctacctggatgggccaagattgtgacccatctaaacggggccttttgcaaataataaaaggtgtctaataattttccgaaaaatgtgtaaaattcaagcatatttgtggagcccaaaagctagggcacttggtcacgacggcacactgtcacaggcgtccatgtccgaccagttggcaggcgttagtacatggtttgcaactttgcattgcctccatggcaggtcagttattaggagtacgtgttttctgcaggcaatattaatcacgtactggtagtctacattgatttcgatttatcgacccacagccataattgaatgagtactcaggaataacgtcatcagacggaggacatgcatgtgcaaaaactgtttctgccagataaaatactgtgtgcaattcaccagagtattaaattaccgtatgcaatactactagcagtagcaaatgcttgatctgaattctaccggtataaatctcatctgaattcaaccgtagtaacaatgcttgatcccagtgaattacccagtctaaaaaataataatgcttgatctgaattaccgtacgcccaaaagtacttacaataatgtattctgaatttctgacaagtatactgtggtatataacactgcatttccattctggcactcgaacaacttattacggtacatcatgatacagtacagacttcgtaaattccagagaaaaaagaggcgccaagattgtcctacgctcgtcgaaatttcataccagccggatcgccggtcgccggcgccgcgtgttaagacgacgcgcggcacggcggcgctccgggctcaggcgtcttgcagcagcaggagcgtgctcccgagcgcggcgcggaggctgtcgacctcgtccctggggatcaccaccgtgacgacgcggccgcggccgcc

SEQ ID NO: 13115 - DNA, 1501 bp, Oryza sativa
gcgggcacgttcgagctcgtctcggcgctcctatggcaggccgtggcgaagatcagggcggcggcgtccaaggaggtgaccacggtgaccgtggtgaggacggacatggccgccaggagcggcaagtcgctggcgaacgagcagagggtcgggtacgtggaggcggcctcgtcgccggcgaagaccgacgtcgccgagctggcggcgatgctggccggggacaaggtcgtcgacgagaccggcgcggtcgccgcgttcccgggcgacgtcgtcgtctacggcggcgccaacctgacgttcgtcgacatggagcaggtggcgccctacgagctggagctgaaggggcagcggcccgtccacgtggagtacggcctcgacggcgtcggcgaggagggcgccgtgctggtgcagccggacgccggcggccgcggccgcgtcgtcacggtggtgatccccagggacgaggtcgacagcctccgcgccgcgctcgggagcacgctcctgctgctgcaagacgcctgagcccggagcgccgccgtgccgcgcgtcgtcttaacacgcggcgccggcgaccggcgatccggctggtatgaaatttcgacgagcgtaggacaatcttggcgcctcttttttctctggaatttacgaagtctgtactgtatcatgatgtaccgtaataagttgttcgagtgccagaatggaaatgcagtgttatataccacagtatacttgtcagaaattcagaatacattattgtaagtacttttgggcgtacggtaattcagatcaagcattattattttttagactgggtaattcactgggatcaagcattgttactacggttgaattcagatgagatttataccggtagaattcagatcaagcatttgctactgctagtagtattgcatacggtaatttaatactctggtgaattgcacacagtattttatctggcagaaacagtttttgcacatgcatgtcctccgtctgatgacgttattcctgagtactcattcaattatggctgtgggtcgataaatcgaaatcaatgtagactaccagtacgtgattaatattgcctgcagaaaacacgtactcctaataactgacctgccatggaggcaatgcaaagttgcaaaccatgtactaacgcctgccaactggtcggacatggacgcctgtgacagtgtgccgtcgtgaccaagtgccctagcttttgggctccacaaatatgcttgaattttacacatttttcggaaaattattagacaccttttattatttgcaaaaggccccgtttagatgggtcacaatcttggcccatccaggtagatgggccgagatttaggcccatcaaaacaaggctcaaagagtagtcttcctattgggctggcccaatttggaaccagcaatactaaagcccggcccaagttagcaacgcggcggccgctacaaaaccaatttgcgagggtggctaggtctcctcctctttcgc

SEQ ID NO: 13116 - DNA, 1501 bp, Oryza sativa
gcgatccaattaattcggcagccactagctagccacatgcacgaagctaactgccacacaaaaataatgctaacagttgtccagctctccgtcttccaggccatcgtctggttcacgctgctgctgttcgtgctcgaggtcaggaaggccgccatcggaatgtacgtcgacggcgcctcgtcctccgaagagtcgtcggcggcgccggcggccagcaaagggcgtcacgaggccagcgctggcaccgccgcatccacgcctccacggtcattgtcgtcaccgcggcgagcggcgccggcaagccgtcgctgtggggcgctggtgaaagtggtggcgccgctccctcctcaccggtcgacgccgccgcgcgccgctccctcctctcccgccggcggtcatcgaggagaagggtggcggacggcggccatcggggacaagggcgacgagcggtgggaaggagctaggcgagctccctggtctaccggcgagcgcgtgcaagagcgagttggccggtggccactcttctccatttccgccgccgccgtcgtcgcaagagagataaaaagaggggatggggagagaggaagcagaagaggaggggtgagttagactgacatgtggggcccacgtgggcccgccattcttttattaatttgtgtgtgaaactgacatataggtcccacggggtttattattttttcggatcaaattgccagtaagcgcccacgtcagtgccatgtcagatcgagaccgagtaaaattagccacgtaggcgccacgtcagtcaaaaccgccatcgaaaccaccgagggacctaatctgcaccggttttgatagttgagggacccgttgtatctggttttgcggttgaaggacgtaaatcggattcgttcataagttaagggaccttagatgaacttattccttttactaaccacgagccagcatgaaatgctttcacttgaggttccatcggtccagcctattacgtgattacgtccgactcactatgcccaattaaagcccagcagcccagctaactctcctgcccataatacggcccatgcgattcggaactcttgcgaaaaggaccctgtttagtgcttactccctccatccaaaaatatttgatgccgtcgaatttctttaaatacgtttgatcgttcgtcttattaaaaaatctaagtaattattaattcctttcctatcatttgatttattattaaatatacttttatgcatatatatagttttacatattccataaaagttttcgaataagacgaacggtcaaatatatatttaaaaacgtcaacggcgacaaatatttagggaatgagggagtactaagttgcagattttgcagttacaaccctgccagctgcgttcgggagaacccctcctccctggcacgcaaaacggagcacgcattattgcatgattaattaagtattagcttttttttttcaaaaatggattaatttgattttttaagcaactt

SEQ ID NO: 13117 - DNA, 1501 bp, Oryza sativa
gcttctcgtgagacgttaaaaaactattttggcaaaatcctattcgcgaaaattttcgttctttgtgtgtgagtctaagttgtgccaaggatctcaattcaatcccattgttccctctcatcgaaatcaaaatcctctgcctcaaatttcctcttccaattcaagtctccaaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctctctcacggcccatcccctcctctcggcccagctctctcgagcgtgcgtcgcacgtgttcgggagcgagagacagcgccgtctcctttctctctctctcggcgtcgcttcccgccgacgccgccccaaaattccggccgcgtcaccgtttcccgcgtgctcgcgcatggtcgaccggcaaggacgccgctcccaccgccttcgcccttcccgcgcgggttcgcgtgtggccaacgccccggtcgccgctgcgacaaaccctggcgccgccagcgtcgtgccctgccgcgctgccgctccgccgctccacgccgctagcttccaaggccgagagaggcagcccctgtctcactcccctctccctcctccttttcccgtttcggcaagggtcaaaccctcctttccctcttcctttcccctttttcccgaccaccgccgatgtcatccatggtcctagccgctcgctccggttcgccgccgctcgccggaacgcctcgcgcgtcgtcggccgtccgatcccgggcgcctcctcctcctcctcctcctcccctttcgcccctgcccacatggccgaccacgtggcagccacctcagccccgggcccgcttgaccgggtcaagtcgcgcccagtcagcatcctccctccgtcttccctcccgtgcacgcggtccacggcaagccgtgcggctgcacgtgggcccgccgccatccgtccacccggcgcgccgcgcccgaaccacgcgcacctgaaaccctagcacccgcccccgcgtgcgccctccccaccgtgaacccgaccaccgccatgtgggtcccgcgcggtggaccgcgtccacccgcgtcggcctctctctccccgcgccccctctcctgggccgcccctcccgcgcccgcgccggcccattaggtccggcccagccgcataaacccctcgggctgcacctaagccgccctaggaagtctatatggcatccctcccttctttttcaagggatttaataaaccctttttcccctattccataaatcaattccttattcccaaaattccataaatcatttccttggtcccgcacgtcagtgacggtcaataatatttttgagaatatt

SEQ ID NO: 13118 - DNA, 1501 bp, Oryza sativa
tgtcccattaattgctgaacatattacatcctccgtcggcagaagcttccaagctagctgcagtaggttacatcgtcccaactgtctgtttgccactctgccgtgttgaaatactttgcatgctcgatcttgatccgaccaacactctcagcaggtagtcgtcgagattcatctgctgctgcatgctattagctctgaacgtctgaatctcctgactttcctctctgcctgggtcgcgatgcaacgacgacgacgtacgacgcgcaattgcgtcggccggctaatgcatggccaggtgcctgtcgctggcggccgaatcgcggcgatttccggttggacgcagaggctaggtcgtcgtgcatgcaggtgtcgggcggcgcttggcttgccggccggcgacgtacgtgaggcggccggccaggatgttataagcagcatatgcagctgggagacaattcgagtgacagtcaaactgtcgataagattcagaagaaaaaactttttgagattgtatcggataaacactctttacttttggtttgctgacgttgaaacggtcactttgtcgtcctaactaaccaactattttacctgcggttgctggtatatatttttcacggtcaatggctcaatgcgataagtgtaacttgcagtgtacacgtctgacatataagatgggcgttgatttttttttcccttttgtttttcacccgcaacaaagctaagtcaatagaacgatatggagcactgcaccttatccagttatccttgactccgtctttatacaatttcgatatgatcgatataatggcacgctgcgatatactcattctattccaaaataaactaaccttgtattataacataatgcattttaatgcaacaaatttaaacatcacatcctaatattttgtacttgtgtacgcacgacatactacctccgttccaaaaaacacttaacgtaggaggggttaatttttttttataatggaataaaacatcccggcctttgctcatcagagctacagccaattattataaaagtaacacccaaacactgagtgtagttcaaatgaattaaacacacccaacaaaataaaagatcaaactaagataaggagagcatatttattcaagtctatttgtgaatctccatccatagtttgcaaggagttgcatgaccgttgtctcaagcctacgacatgcaaccttcataagctctcgatcatcttcacacatttgcaactgtgcccaaaatcggaaccaatatgttgccctgaaaatcacctgcatatatgagatagatagtgatttgtcaaaaaccatattattcctagtcaaccacagagcacaacatatggcagaagctcctacaagtatgagtttactcttcttcttgtctacccccaagagccaaccatcaaacatattagatatggtagtaggaaggtataaaccaagagagaactgtactgctctccaaacaaattttgcataatga

SEQ ID NO: 13119 - DNA, 1501 bp, Oryza sativa
gccggcggaatcgggggtggccggatcggcgccagcggccaaaagcagcttgacaacagcgacggcgttgcgcgagccaccggaggcggcgcagtggagcgcggtggcgccgtcggctccagggcgacggttgacgtcgacgcaaccgccgaggcccaccagcagcgagaccaccccggcgctgccgtacgtcgccgccaccatcagcggcgtgcgcgcctcgtacgccttgctccgaccataccacagcccgaccccatcagccaactccgccgcctcctcgcctccctccgcgagcgcccccctgagcccatcaacatcatccgccgccgcgagctccagcagcgccgccagcctgtcccgccggccgccggcgagcggcggctgcgacggcacgacaacgagatcagcaagctcgcccattatctctcgccggatagattaaccaaagctcaacgcatctgtagcaaccgctagaagaagaagaaggaaagctatataagattcagcaaccagctctcgccacgaaatcgagatcaagaaaccttccaatatggaaacccgaatccagaaaaagggaaagcaaaaggagcacaaaaccaactcgacgcatccgagctcccggttctcggaaggagatcagcccatccccccacacccaatcgggattccgcggcgagcaatcgccgatttcggccggatcgaccggagaaaggaaaggaaagcaataaatgagtagtagcgtttttacctcccgccctccggggttgatccaaaatcgaatccgacccaatccaatcaagcccggatccaccgctcctccctcccttccctcccctcccccgcgacgctcgccggcggcggctgcttctcgccttggggaacaagtgagagagagagagagagaaagcgagagtagcacggcgacgagaagaggaggaggactcgcagtttactggtggtggtggcgacgagttaaatggtctaattcctcgggcgccacgtccctcgcatcccccaccgcaaaccgacccgcctccctccgctgtcgctgacacgagggcccggggcattacgtgggacccacctgtcagtgggcgcggaggctcaggcggtcgggggatttttttgctctcgggggggtggggggagggaatttactgcgcgcgggtggggcccacgagtgggattcaaacaggtgcgcgacggtggtgaccgaccgctcgcgtcgcggtggggttgggttggggggttgggtttttgcccccgcgaccgcgatctcgccacgcgggggcgcatccggccgtcggtgaggtggatggacggcgggggatcgggacgggggcaggtggtggacgggagattcggcgccgaaagcctcggttgtatctccgctacgccgtacggaaggtcggcgcgcgggcgggggcgagaaaggtcgtcggtggcgagcccgtgggctcggtccactgcgcccgcacgcacgccgccgccgcggaat

SEQ ID NO: 13120 - DNA, 1501 bp, Oryza sativa
aagtcattctagcatttctcacattcgtattgatgttaatgaatctagacacgaatgtgaaaaatactagaatgacttacattgtgaaacggagggagtactcgtgtattactttcgtccacaaatatttttttagctacatacattcacaaagtaacgagagctacattaggtttcatgtggtgaaacctattcatctaagttaaagttctaaatttaatatagacaagaaaaaactacccatacgttacaataagtgaaggctattttaatatattattgttagaatttttgtctaaaaaatatatgggatttttattttgatagtattgatatctaatttggaacccttattaagatgatggtcatatcatgtacgcctgacgagaattctaaagcaattaagaatcagactcccatcctaggtttgcatgtgagtttttttaaaaaagatttcttatatgactccttatatattttcaaaagcgaacaaacttagaaaccaagtcaaatacgaataacatgctaaagtatcagcgaaaatatttttaatttttataataatggagaagagatagagataccaataccgaaagagaaaatgaggggaaaagagaagagattgaaagaagagggagagaattaggattatcgggaaaaagaaaaagagaaaagagtaaaaaaaaagacagtcaagggaagagcacatgacttcgagtggatgcacgcgggatggtacgggtcgattgggttgtgttgggctaggagagggatgggtgggattaggctggggaggaggtgtacagtactccatccatctacttttgataggtatatttccaaatctgaaaaatttacttttgaaatgcatattttaatccaaccacctatcatcttaatgactttctcggatttaatgcgtgactttccattctttcacataagactggttacatgggcatcaagaaatataaatattaatgaatcgattgtttacgatgaataactagtaacatgtttaaatggatgataagtagaattacttatccttggtcattgtgtgaaatatgactataaaaagtagatggatggagtagttattttaggctcgagctgaactggatgcggacgacgtacaacctagacaccgataacgaaataaaattccgacaaaaacatcttcaaattttataatagtagatatatgatatgctctcatttacacataaacttttaagtaattttaagtttagataacatatctgttaatatctgttaacagtgaggtgtttatggtaatttcgtcaaatttaaaatatatccatttagtttcttacaagtgctaataatgtgtccctgtattcacaggggattagtatgcacacatgtatatgaatttgaatatctattgtattgtgcttgtatgagaaaaagacgcatggtcgtgtcgcttgtatgagtatacgtcttttaccctttccacgcgcggagcttcgctagc

SEQ ID NO: 13121 - DNA, 1501 bp, Oryza sativa
tgaagccggcgaggtggtgcagcggcgacggcagcttgacgacgctccggcggaaggagtgcgtggccagcgtgaaggagaaggacatgatgatgatcatgaggatgccggtgacgccgggggcgctctccagcaggtcggcgtacgtcggctgcctgtacccgaagttcggccccagcgtcgccatgaacttgtcgctggggcagttgatcagcctcgggaagtcgcaggtgacgtgcgccagcgtgtggacggcggtggcggcggcgatggtcgccgcgatcaccttgtggaagttgatgttgtcgtcgaaggggatgacgtggctgagcgccgtggacctgagcgtggtgagcgtgttccggcacacggggaggaggatgagcgccatgttgagcttgagcacctcggcggcgcccttggccacgcacacgcagtggcccatcacctggaacgcggcgcgccgctcgtactgctcgaacttgtaggcgaagaggccgacgttgacggcgagccacagcgcgacgagccagatccgcttccagttctcgtgcacgaagtccaccgtcctggacacgtgccgcttcagcgggctccggtaccgcgacgggatcatcgtcctcgcgaggctcgacgtcgtccgcttcatcttctccggcgccgcctgcgcgctcaccatgccgcgcagcagcgtctccagctgccagatctcgatgtacccgcggtcgtccgggtccagctcctccatgatcagcgacgcgtacgtcgccgcgtgtcccttcagcttcgccagcttgttcgccgacgcactcagtataataacctgcaaatccattccagccaaacaagaaaacgatatttaatcctctctctccatgttccagaatggcagatgagatccaatccagaagaattctttcgtcctcacctccttgacctcatcttccgtgagcatcccatcgccattcttgtcgcacctggatgcatcagagagagggggaaggaaaaaaaaaatccatttcgtcagttggcgatcgatttatcgtgttcatcttggaaattataactgggacggtgaaccattacatgtcaaagaaaatgcgaagccgcgagtcgaagttctggtcggtcatctcctcccagaactccttgagctgctccttggtgatgccgtcctccggctccaggttcctccgccgcgccagcgccacgaacagctcgccggcgaactccttggagtcccccatgccttttgatgccaagcagatccaccatggattaatttttcttagttcaattaaaagatcatgaatcatgggcattgttagacatccaaactatctaaaaagagaaatgattcgcttagcgctacacgattattattccatcgatcgcctaactgcctccagcatgaaccggtcgctataactccattttctccgtaagcatgtgcaataacaaaagagaagtacagagtactcgtttcttttgctgtaccgat

SEQ ID NO: 13122 - DNA, 1501 bp, Oryza sativa
cgcaggttacgcggcatgagagcacacatgcatggacggtgatgagccccaaccatgcagaaaatgcgcggattgtgatcgatcgctagctccataaatgcatacgagttttctgtgcgtcggtttgaagcttactactctctacctcggacagacatgtgcatgttacggcgaatcataccacgaaccgcccaagtacccaactgcactcaatgcatggccaacgaatccatatacgagtatatatcaatattccatgatgcatgtgcattgatatatgagcataagcatgaatatggtcgtatgtatctggctagctagctagctacgtacaaaatacacacatatatacagcttgcgttgctatagtactctagctagctagctagttgcatcaataatgtttcaagctgttcttctattttaatttctcaggaactaatatcttcttgtactgtgcatggatggaattcatggacggacgacgtacagatcttgagcaactcgatgtacaagagcgtggagcaccgcgtgatcgtgaacgccgaggaggagcgcatctcgctcgcactcttctacaacccgagaggcgacgtcccggtggcgccggcgccggagctggtgacgccggagcggccgtcgctctactaccgtccgatgaccttcgacgagtacagggtgtacgtcaggaagaatggccccaagggcaaggcacagcttgaggctctcaagggccagtcaatcacccaaaacaacgaataataaataattagtaattaattaactaattaagctacaccgatcgatccaacagcgacggcatgctaatccatggatcgaactagcaagctagctagctagcagtcagcattaattatcccatgtatgatctgaatcggaataacacatgcatgagtgtgtgtacatggcctacttaatttacgcaacatatatagttataggccttaattataataagcacatatatattgcacgcatgcgtgctcactatctgaagtatatatgcattatatgtaattcagggacgcgatgctaattagtaattaagtgcatgtaatcttctaccatatatattcaagcaagaaatttagtttgatgtttacgtatatttaccaatggatggatggagaactaaactactgctccctccgtcccataaaaattgcttttctagctctaaggctttatcccacaaaaattgtatttctagccatgtggggtccaaccaattgattcatctatataagtttccttccatcccacataatttggactgctaatgcttgtaattttattaagtatactaattatatgggttaattctctcaaacttcattttaatcatttgtatatatggaatgtatgcatgcagtgggttcattaaataaggttattgtggtcattttctaatcctactattttatcctaaattagctagaaatgtaatttttatgggacagaggtagtagtaaaatatcat

SEQ ID NO: 13123 - DNA, 1501 bp, Oryza sativa
aataaataaattgttgaaattagaaaaaagaaaaaagaaagttcaagtaggaatacaaatttgaaattactaaaagaataatggtctagatttgttgtacacaagataatcatatcaatctaattatagatcatacaatccgtactaggagtccttgtccgtttagaaaaatcaattgcaaaactgtacagtatagagctatgattctaaaccaacatacattgccgcacatatatagggtggagataccagaccagcacgcttaggctgcagcagcagaaaaataatatagtgccctcatttcatacgagtaagaacccaatacgagattaattaaaattcaaaataaaaaataaaataaaatccgaaataagaaataaaaaaagaaaagaagagtttaacttggaatgcaatttaaaaataactgaaattcgtaataaaaaataaatattatttaaagaatacaccatctagaaaaatacgagattaattaaaattcgaaatgaaaaataaaataaaatccgaaataagaaataagaaaagagaagaagagttcaacttggaatgcaatttaaaaataacttaaattcataataaaaattaagactatttaaagaatacaccatcagaacactgtcagggttatggataccacatacctaatagtagttgactaaatctcggcaggatccaccacataccatgtactatacggaaacaacctgcggatataggaggagttccggataaggaaagacaaccagagttctacatggaaacgacaaggactactcggattgtatccatattggtttctttatttttacttggacaaggggacacctataggtataaatacaagcccccctaggaggagaggggagagaacatagacacggacaatcaacacacgaccacctcaatcaacacccaacacaatcgacatagaagcctacatacgccaagacacgccgccggatatcgacttcagggataagcacggctagtaccctgcggtgtctccggatactgtcaggagagacgaaagcgttatctctgatctcgccgggcacggattcgaggaggaaggctaccctgttgtcgactacgagtcagaacttcagaccgccatatcgacaacagttagataggctaccccaaacattgtactggtgtgattatggtgaataaaagcaacgaccggctccggccaacaggatgtagggttattacctgacaattcaggggcccgaacctgtataaaaatcctcgtctccgtctcttttacctcagtctcgcgtataccctagcaccgacgatcctcatatcatgcaaataccagaaccgcgacatcagacgtcgacaaacacataacgagattaattaaaattccgaataattaataaaataaattctgaaaatagaataaaacaactaggaatataatttataataaaatctatcggaacgaaaaatatggaaatttcaaaaaaaaaatcat

SEQ ID NO: 13124 - DNA, 1501 bp, Oryza sativa
gcgactagctgcagcagtagtagtacagcgagggaaaaagtacaccgaaggtccctcaacttgttatcgagataaaaaacgtcctccaaccataaaaccagatatgcgggatccctcaactatacaaatccggtcatccaaggtctcttggtggttttcaacctggttttgtccgacgtggcggctgagtcagcgtgggacccacatgggccccacatgtcagctggccacatcatcaccctctctcctcctctccctttctcctctctctctcactcttctcgtttggtgctctgggtagaccggcgccgccggccgacagggtgatgcgggagaggaggtccggcggccggcgacgtcgcggcggtggcggcgacggcgacgacgacgcgggagcaggggagcaaggcggcggcggcggtgacggcgtgggagcaggggagctctcgccgtcgtcgccgagggcccaaccacgatcttgtagcagcgtcggtgtggcgacgaaggggaacccgccgaggagtgctaggaccacgtcggcgcctggctcgctcagactgccggaactcgcccagcgggtcgtcggactgcttcaccaccgccacgctgccgtcgagccccacaccgacgccatcgtcgccgtcacggcagtctcctggtttgtccgtggcatcgccgttgctgccgttcttctccttcctgtcctcctgtgatggcaacggcgatgacgacggcggcgagtgcttcttgtcgtggttctggtggtggctcttccggccccacgacgcgacgctctgctccagctcgctgagctcgcgcagaaggccggagaagctctccggcccgtagtcgccgccgtcatcgtcgaactccaccacggagcgctcccacaggaaggacgacaacgcggacgttatggtaagagtgtcggtcgtcgtcgaccccgacgggttcatcccagcgctcctgcgccgcgtcgccgttgtcgacggcgtccccaccaccggcgccgagacggacacgctcttcgcgtccttgcagccgcagccgagcgtgaacctcacgccggcgtggcgcttcttggccgaaacaccaggactcatcataccctatgatctcgtcactcactagctaagctgcatgtgcaaactgtgcgtgcgttgcaagctcaaaagagacttccggtttctctcgtgggctcgcgcgctgcaagcatataaagcaacggagatggcatcattgccatttgccatggcaagcgtgcacaagtgcgtggtccacgtcgccgccgccaccgccgacttctcctcccactgcctcaccgccgccgccgcggtgagttcttcctcgtcgtttcgctgctccctccgcggccactccgccgcggtcttccgcctgtaaaattaaaggtgtttttggttattattctgtgacgaacaattggacattggagattattggttttgttatttggaatttattcacgaagtggttttggaga

SEQ ID NO: 13125 - DNA, 1501 bp, Oryza sativa
ctgtttcatcttaaacaaaatcaacatcggcggtcattgaacaaattgtcaactatcttgaataaaagggacactattacaactagtgatcccataaacaaacttctgaaattcttcgatctcttttctttgcttgcccaatttcttcttgcttgtgcgatccatggccaaacgcctttcagacatctcaatatctagcttcgtttttttcttctttctgtcccctccttccagggttgctagtgctcgcgatccaatgcataccacagcgatggcgattccacgaacaaaggcttgcgatggtgtcggcggatgagctgtcgaggccatattcgccacgctgagcttgtcgccatggtcacctcttcttgtttgcgcattgaggtcgtcgtcatccagggatagatcgactcccagaagtcggcggcggccggacctagactggctacaggaagggcaagttgggaatgggcaagttggcgacggctggttgcagtgagggaggaagcgaagtccggcgagattggctgcgccgccgccagggacgacggaaggggatcgggaagagacagattatcgggtcggggacttgtaccgtctctacgaaaattgactaaccacgcgaaaatccaattctgcccttccaccagttccatacacgcgaacaaagggggaggtaccccgcaccggattcccgtacctcgcggtaccgacgattgtgggtcgtttgatctggctgaatggacggttacgattgcagtaccgcgcggtaccaaaaattctgctggacagtaaaaaatctcttctttctgggcctgatggcccacattcatactcttcctactccatatggtacagtagaagttggcctgctagctcaacatgtaatcgtttgggccttgctagttgctgcaaatggtcttttaggacagaaaaaagtatactttgactccctcaactattgcccgagtatgattcatgtccatcaaccacaaaaccgggtatatcgactcctccatctatcaaaaccggtgcaaacaatgtccctcggtggttttggctgacgtggcggtcttgaccaagtctttgtcctacatggcgcttacgtggcattagaataaaaacaaaaataaaaaatatgtgggacccatatgtcattcaaaaaaaagtattgtaggacccacatgtcatcctccctctccttcccttcttcctccccatcgccacagcgttgcactccttggctgctgccatcctcgtccccaccgccaccgctgtcgtctcgaccgccaccgccgccattccggccaagagaaaggccggggggagagagagagggggaggaagaagggaaggagagagtggatgacatgtgggacccacatgacagcgggtcccacaatatttttttgtgtgaataacatatgggtcttacatattttttttattttttttattctaatgccacgtaagcaccacgtaggacaaaaactcggtcaag

SEQ ID NO: 13126 - DNA, 1501 bp, Oryza sativa
ctggagcagtacacccttccagatagctaaccgtgctcctctcatcagccacaattagagtcctctcaaattgcccggtctccttgtcgttgatcctaaagtatgtcgatatctccattgggcaaaccgtatccttgggcacatagcagaacgacccatcgctgaacacggccgaattgagggcagcatagtagttatctgccggcggcacgacgctgccaaggtagcgcttgacaaggtccgggtactcgcggatggcctcggaaatggagcaaaagatgacgcccttcttcatgagctcctcccggtgggtggtggcgatggaggtggagtcgatgacggcatcgacggcgacgttggcgaggcgcttctgctcgctgagcgggatcccgaggcgatcgaaggtgttgagaagctccgggtcgacctcgtcgaggctgttgagcttgggcttggtcttgggcgcggagtagtagcagatggactggagatccaccggctcgtacacgttgtcgctccaggtgggctgcaccatggtcaggaaccggcggtaggcggcgaggcggaagtcgagcatccacgccggctccgccttgagctccgagatgcggcggaccgtggcctcggagagccccttggggatggagaaggactcgaaatcagacacgaacccatacttgtactccctcttcagcaggttctgcagcgtctccgattccgtccccgcctgggacgacgacgacggcgatggcttctgcgggcccgtctgcacggccaccaccgagaggcgtccacggcgcgtgcacggcctccgccgggatccgtacgacgacgggcacgccgccccgagcttggcggtcgcggcggcgcagcagggcgagaagaggggcgtggacgacgcggcggctgcggccatggtgcggcggcgtggcgaggccgaggcgaaattagggatgcggatgggatggagagcgcaggaggggtgggttgttgttcggtggtgtggacccgtgctacgtgagcctcagccgcgcgtgaggccggcgcgggtgggcgcggtccacgggaagcccggcgcgatgggggcacggtcgtgtggcggccgagaggcgtggcgcggcagtggatgtggttcgcgccgcgtggcgggccatgcggaaaacgccgtggttttgtgcgatttctccccgtttcttggcctcgccactccgccaccgcaaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgt

SEQ ID NO: 13127 - DNA, 1501 bp, Oryza sativa
ttctctagttccttcccaacattcttgaccttcaccttactccaggaatgcaaccttgtcatcactctatggagggcagtactaatttcaccgagatctgactttgaaacaccctctgaccaggcatcagtgattacctcctgtagggatggttccctttcccagcatatttcataatgcaaacattttgtgtgaaacggccgacaatcctcaggagagaaacaaacagatattgggcaatgatctgaccgagtcgaagttaagtgagacaccctggcattaccaaacatctccctccagtcattatctgcaagagccctgtccagacgaactctgatgttgttccttccctctcttctgttgtcatatgtatagggcactccggaaaaacccaaggcatgtaaatcacacgtttgcagaacatcccgaaaggattgcatttgtgtttcattcctttgtctcactgaaaagtgttcaaactgccacaaggcctcgttgaagtcccccaaaacgagccacggcagattagagaattgtctaattgagttgataagagaccacatactgtgtctattctccaccctcggctctccataaaactatatatatacataaaagtatatatttaaaaatgaatcaaattatcgacgagtgatacttgtagactagatgattagagaattgggaaacagaagacaaggattatactggtgcaggccccttatcaggtaatagccctagtccaatttaaatgggattgatgatggtgttgtgtaacaccctaaaaaaaagaaaaaagaaaaaagaaacaaaaaaaggctagctagcagcagcaggccggcagcccaagcagtagctgggcctttggcccaagtgcagcagcatcagctagcgagcaagcaagtcacagctagctagctttagttcccacctcgccaatttgagaagagagggagcagcttataaggatgagcagcccagtcactacaactccgattctggaatttttgcgttaaagcgaggacgaaaaacccagtgagttgcagtgttaggtgtggtctaactaaatgagatgggaccaatgccgtttctggaccctgggctgggctgtcacatgttgatgcgaaaaacacgcacgggcctggcctgggagatctacttagctttagtgcaggtccaaagtttgttgagaagcgggcgtgcttagctttagtgcaggtccaaagtttgttacacgcacgggcctggcctgggagatctgcttagctttagtgcaggtccaaagtttgttgagaatctacttagctttagtgcaggtccaaagtttgttgagaagcgggcgtgcttagctttagtgcaggtccaaagtttgttacacacacgggcctggcctgggagatctgcttagctttagtgcaggtccaaagtttgttgagaagcgtgcgtgccagtcagtttgatcctgcaactgacaagatatctaaacagcagagacaaaaga

SEQ ID NO: 13128 - DNA, 1501 bp, Oryza sativa; identical to SEQ ID NO: 13127

SEQ ID NO: 13129 - DNA, 1501 bp, Oryza sativa
cattaatatcaatatgaatgtggaaaataccagaatgacttacattgtgaaacgggggagagtagctaggaatggataaataaataatgttatcccaaacagaaaaagttacgtacggccgggtatgtgcttcacgtgaaatgggaaatatatacaatcaatgacgactaatttggcagcaaacatgcatgcatgggccagttaattaattatgctaaatggatagtttgattcgatgagcagccggacgactgaggctttcttttgttgggaaaaaaattaggtttgattgtcacatcagatatacggatatacatttgaagtattaaacgtagtttaaaaacaaaataaattatagattctactaaaaaactgcgagataaatttattaagcctaattaattcgttattagcaaatgcttactgtagcaccacattgtcaaatcatggtgcaatttggtttaaaaattttgtctcgtaatttacacgtaatatgtgtaattggttttttcctacattaaatacttcatgcgtatgtctaaacatttgatgtgacagtgtgaaattttttttttaaatagggcctgagagcaaaacacatgctgcatgaatagtagtcgctcgctcgtgtatcatacttaaagaaagtttaactaggaaaaaaaaacctacttcatatataaaatcacaagaccttttatccaaaaattgaaactttcaactaaaagttcaaaaaaattatactcttggctcaaactttcaatataaaaacccaaaacttctaatccaaaaactgaaacttcccaaaaaaatcaaaaactttgtgctcatggctctcaatctttcgatacgaagttacagaatcatggtagggtagctagctaaataaagggacggatgcgatatgggtgctagcgaatagagcctttctaccttgctgaatcgtcattgataattaggggaggaggaacaagagggaaaggagcaatagtttggggatgatcccctccattgaataatttctcattctggatccgtgctagggatggatcaataatgttatcccaaacagaaacagctagtgttaggtacgggtatgtgcttcacgtgaaatgggaaatatatacaatcaacgatgactaatttggtagtaagcatacatgcatgggccaattaattaattatgctaaatggatatagtttgattcgatcagcagctgaacgactgatcgagagcaaaacacatgcataatgcataatgcattaatttatatatatgaatagtagtcgctcgctcgtgtatcacgcataaattatatatcaatgatcgatcacatgcaacaccggcaaattaaattgacccatcatcgatccatctagctagctatgcctatatatatacgccatatgcatgataaatacgcaagctaattaagctagctacatatatactctctcaaaagtttacattaattgctgatagctcatcatcagtttgatc

SEQ ID NO: 13130 - DNA, 1501 bp, Oryza sativa
aataaccacgtacatgctcactactccctctgttttataatgtaatactttctagcattgctcatattcatatagatgttaatgaatctacacacacacacacatgtacgtggtgtgtgtacaaaatatatatgaatatgaataaatgctagaaagacttacaatgaaacggaggaagtatctcataattctcatcttacttggtcccttatccaagtaatgacttagtctctttgtctcaaaaatataaacttttggtatgcaatcctcgggatgtggattttcatctctcaaggggatatcctcttgtttgcatgtcatctaaatagttataaaaaataaaaaaaaatgacaacatagattaatacgaaatatatcactccacaaacatgcaaaactaaattcaacttctataagttgcaacaaaaataacaaattaaactgaaaatagttaccgcacattcgcaacgaagttgaatttaaacttacatgcttgtggagtgatatatttcatattaatttatattactattttttcatattttttatgactatttaggtgatatgcacgaaacgagggatatctctagagggatgattttactttccccaatcctccgccctgattgctgaaagctgagtcctcgagatcacgggccgatttgtttggagcagtatgggccgtgcgcctcgggcagtgctactcgcgaaagcccaaccctcgcagccggcccatcacagactatggattccatcacctatcacctcttcagtcttcacccacgtccctcgacaccccgtccattctccttcgcgcgccgcccgcgccgtcgcccatcgcggcggcgatctccaccaccgggagcagctggcggtgccgacggcccgcgtcctctgctcttcttccgccgcaaaatcctcccctccatcgactcctcgcgacttcgtccgctgatctccatccatccatccaccgtgtactacccgtcgtcctgctgctttccgtccgcctccggtgagcacccgtgccaacgcgacgcacgtcctctttctttctcatccctctcgttctatgccccgatagatccaccccttgtgaattggagatctgaaaaagattttgtaagaaaacaattgtgcttagttctagaatgacattgtggatttttatatttgtgtatatatattttttggtaataactgttttgagtcctgtccaacaaactcattgagtgaagagtatttactcttttacttctgtataaagttgattttggagcttacaggaaagcttataaggtcatgggtcatcatcgtggacataaaacctgtatttgtgaccttttaattattactagtatatctgtgttagttttatggtgctgctttgctgttctgatccacattttgcgccttttcttgacaaaaaattatgcttcagtgctgggaagatgtggatgggtggttatgatctcagaagaaacttgaagagggatgaaaa

SEQ ID NO: 13131 - DNA, 1501 bp, Oryza sativa
ttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaa

SEQ ID NO: 13132 - DNA, 1501 bp, Oryza sativa
cagaagatttggaagtaaagataatattctttatcataatacacacaatttttactaataggcaggtacgtgcaaaatttcctggtcttgaaataagtactgcatcatcaagcgtgccacgcaatatctgctccggtaggccaaaatgccggtggccgtttctgtggccgcattagattcccacatggaaacaaagcacacatcacaacaagtgtcactcacaagaaatcgtgcaagatgcatccaatatattccatcaccatcctcacctcatctccttcgtccttgtttgcttccctcgcttcacctatcaacttcttcaccatgcttcacctaatcaaattagcagctactggcttcagagttctttttttctttgaacgaattagtcaatgtgatatgattctctagaaatatctcggttccgtttcttccattctcgcatccattttttcctgacggcccaattgttgattgtccagattagtaacagagtttaaaactttgtttcagaaaaaaaaatcatttatatatttttcttgctaggaagaaaaggtatcaaagttgtaacatctcgtgtccaacatttgcactcaatgactcttcatggactctttatggctgtgttaacctttggagcagagggttagggagtattttacccagaaacgttgatgatttagtctgggttcggcagctgtggattagaagaaaaactctttcgttgtgtgcgtgcatgcttcccaagcagttaaatggtacgtttttcataaaatatttatatagaaaagttattttaaataatcatattaatttattttttttaaatttaaaatagttaatactcaataatcatgtagtaatatttacattgttttgcgtattcttctcgatcttctcctctcatcttaaacacaacatatagtctattgttaacattctttgtaccttctttgattataaaatttatttgtaagtatgccgtatgttttgacgttatgcatctaactatggagacgtccaaagtgttctcagcgtagttctacgattttgatataattgactaattaaaacttacactccattaaaagtacagacataagctggtgtttttgacacgcccatgtgcacgagacgttttgttttagtcaggagaaaaacaattaaagaagattaatcggaggttaacacacaagaaaacgtcagtgcggcccccacgtaaacagagctccattgcttgggtttgtggctatataaagcagcttctcctcctccatttctccatccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgt

SEQ ID NO: 13133 - DNA, 1501 bp, Oryza sativa
atctctggggtgagagacgccgccgccaatgtcgtcgccggtggcggccgcatcaaggtcgggttcggcatcgtcggcgcggcggagtcgtgttcggggtccgccgccgcgccacgccgatgccgcgccgccacgccgccgccggcgccacgccgccgccgcgccaagccacagccgcggcgccacgccgccgctccgctgccgccacgtgaacgaacgaagaacgatcgtgaacggacgaaacgtacgtgaacgtgaacgaacgaacgaacgtgaacgagaacgtgaaagaacgtgaacgaacgaaacgtacgtgaacgaacgaacgtacgtgaacgtgaacgaacgtgaacctaacgtgaacgtgaacgaacatgaacttaacgttgtatgtgaacgtacgtaaacgaacgaacgtgcgtgaacgaaaagtgaagttaacaagaacacgaacatgaacttaacgtacattaacgtgaacgcacgtgaacgaacgaacgtaggtgaacgaaacgtgaacttaacgagaacgcaaacgtgaaatacaatatatgttactttgcgtttatcctaatacatctttttgtatgttgcggaaaagacgttgtcgtcgtcggccctcaagccggagtggtagctaaccctcgaaggaattcgcgcaggcaagtgatgtaaatatatgattgttagatttttaatgcaattaagactattagatttaatatatgacacttagacttagcatatatgattatctaggtttgtaatgtacgacacttagacgacttagcatatatgattacatagggtcctaatatacgacacttagacttagcatagtataagattattagatttgtaataagacttagcatataagattgtttgagttagcatagttctaatacaagattattagagttttaatataagattattagatttgtaattagacttagtatataattattgtctagggtcctaatatacgatacttagacttagcatagttgactattagagttttaatacaatattattagagttttaatataagattattagatttgtaattagacttagtatataattattgtctagggtcctaatatacgacacttagacttagcatagttgactattagagttttaatacaatattatttgagttttaatataagattattatagttttaatataagattattagatttgtgtaataagacttagtatataattattgtctagggtcctaatatacgacacttagacttagcatagttgactattagagttctaatacaatattatttgagttttaatataagattattagagttttaatataagattattagatttgtaataagacttagcatataagattgtgtagggttctaatatacgcaagttagacttagcatatatgattgttagcatataagattgttaaagcaaaaatgacctatagacttaccaactatgtcttgtatgaacaga

SEQ ID NO: 13134 - DNA, 1501 bp, Oryza sativa
ggtgaggatgacatgtgtggcttacgtgggtttcaccatttttaaattaatttttagtgtaactgatatatggacccacaaattttattattttccaaaatcaaattgccacgtacctacgtaagcaccacgtcactgccacgtcagatgaagaccgagtcaaattagccactaggaaccatcgtctaaaccgccatgagacctatattgcaccggttttgacagttgagggacacgttgtgtctggttttccggttgaaggatgaaaattgaattcgttgacaagttaagggatctcagatgaacttattccacagaaattaggccggaaatatctgtggatatgggcctcataatgggctcagagcccacagtccaatgggccgtgacggcccagcccgtgttctgactttcatgctcggctcctctacccagccagccgcgagggccgatgcttcactccccaatcctcacagcactagggttggaccacttcgcctcgactcctgctccgatgcggcgcccgaggctgccgacggcgaggcctccatctctctctctctctctctcgcatcctccattgtgagttccagctgtttcttgcggtgtggccccgacgcacgccgcctgttcgacggaatgcctccggggaaagccccacgtccgagcgccagcggcggcggcggcggcggcgtcgataggatagggatctgccggatggtgtcgtccaacacatcctcggtttcctcccggcgccggaggccgtgctcacgtgcgtgctcgcgcggcgctggcgccacctctggaagtcggtggcgagactgcacatcaccaactgggacaaggaggtgacgatgcaggagttcgggtacttcgtgcaccgccttctgctccaccgcgggcgcggcgcgccgatcgacgagtgcaggttcagtttgggcgggctgtccgacttcgccgccgacgcccgccgcgtggaccgctggttccgccatgccgcggtgatgtgccaggcccgtgtgctgcagctgcgactcgctcccagtggcgtccaactagcgctggataacctggccatcgtctcccggcatttggagaagctacagcttactggtgtgaagctgatgcacagtttccttgatttctcgagctgtccggtgctggagcatcttgatatatccttctgtaacctggttgatgccaagaagatctcttcccgatccttgaaacacctcaacatcttccgttgcattttcagccgtactttccacactcatatttgtgcaccgaatctcctctcacttcgtatgttttttaatagggagtaactatatttatggcgccatatttttcaccaaaatatagtcagcatgtatttacattgtaagtccctaaattacatatgtaattttagtgtatttacaatgtaagtcctaaaattacatatgtaagttcaaaattacatatgtaagtggggtgtaactactgtgtaaatttgtat

SEQ ID NO: 13135 - DNA, 1501 bp, Oryza sativa
cagagtcagtcggtcagaccgcgggctgcgccggtctgaccgcgcaatacacgccggtctaaccggcacacactgcccggtctgaccggtcacatgaaataacagaatctgcgatttacctataaatccaatcatctccaaaaccacttcgtgaataaattccaaataacaaaaccaataatcttcaatgccaattgtttatcacagaataataaaaaaacacctttgattttacattaatttgccaatggacaccgcgccgattagaataacaatttccgattaaagaggagatagaaatcacgcgaaatataaaaaatacccttaagcccacacgtcagctctcctatctctcttctcttctctctatcttctctcctagaagataacgccatcgtgagatagcaaggaaggcatggttgtcggtgctggaccaagttggcagaggcgggagtagcgggtcgctacacgtgcagctccacggcctcctctccccgtcctcatcgtcattgttgctcaacggttacaaagcggcggcagtaagcacggcggcagtggcggcgacggccatgtgatgatgattagcaaggccgtgctggcatgcttctccgtcgcactcatggtgaccttcgctagcggccccaccgcggacgcctcattcccttccccgacgggagtgtcggcagcggcggcggcggcactcctgtcgtggctgtcgtcgactcgacgtcggtgacggtgctgccgaggaggtcacacgatcacaggaacagcaggaggaaaccgtaacaccaatacgcagtggcggagaaggggtggcgagaagaactccatccaacacggcatcatcgacgctcccgagcaaacgagagagcaacagaaacggcaccatcgacgccctggccccaccactgaactcgacggcgacgccacgagccgcagcgacgacatcgacgccgccggagaggaaggctgacagccaccacagccattggagaggcatcaggcacaagcatcagcatcatcaccagcactcgaggcgcaaaaagacacagtcctcctcccggcggcagctcgccgagaagccccgatcgccgcgacgacgacgccgccatgcctgccgcgacgatcatcaagaccagcgccgtcggcgaaaaacgtgtcgtttgacgtccggcgtgcaagagctggtctcttcgcattggccatttcatgcgatttctctctcctctccaaccggaaattattattctaatcagcgcaatgtcgattggcaaattaccacgttatggagtgtttttctccaaaagtgagttcggacgatgtcccacagctaaaaccacaaagtcaaagtgccctgtagcaaaatttgcctataattactatcttctctaaccctatagtttaacaaatggtttcactcatcgcttattctttcattcctcgtgtaatggtccggatcttcggctccctgaattccgtcgcccccctcctccgcact

SEQ ID NO: 13136 - DNA, 1501 bp, Oryza sativa
ggacaatctgcggggtgagtttgaagattgtgttattagtattgttgtttggttatgtaaccaaatctgttgcacaggttcaccatagcatatggaaacaacttgacatttgctactgttaaggtacaacatatcaatgcacaaccaattttcttatattcatagtaatttccagaggttgttatatatgaatgaagttatattatatatgactcttaaaatttcaaatttataatgcaaacagaaaccatcatgatcgatcaggattttagcgtatattggttctagctatatttacataactgattggcatgtggtaaatattaaagccgggaacaaacagatttttaattgatatagctttttccaaaaaatttgaaaataaaagcctcccaaaaattgttttctgattcaaacattgttttacgacgctatcctgaatcctcattgccatactgaaatggtcaatgcaaaataaaatagttgatgcaccctgagaaggaccttgccacatcactgtatatatatgggaacatttatcgccaaaaggttcgttgttagaaatatgttcattgaatgttttttttacaacttatacaaaataggtcaaaatatagtaacaggctgaagaactctttgtgaaactgtttatacgtttttcacaccaattaaatcaagcttcacagaatttctgagaaaatcattcgctctataggtggcacattagctggaaaattctgaggaaaaatgataaatatttaatctttccgctagtgtaatttggttgggattacatggtaatatgaaacattattggatggatattatatactgaagaaaaagacctgaatagaaataataggaaagtaggatatccaccgaccatcaatgccggccttatctatatccaccagatcgacggcatttggtagcttttgttacgaaattattgggtgatctcatccataccttggatgggattggcaaccgagtattagccatggcttagtgatcaattagaacaacttaattgtgcttcataaggggacatgccttttcaggatatgttcacatcccctcctggtctataaatatttgaaatcatccatgtaaaacctagaattgaatacaaagaaactcctcctttgctcaatctctctcgctctctcgtttcttctcaacacgttatcagcactgctcgtgaagaagataaaggaggaaatcaatcaaggagccagcatttgaaggtatgatgcctaccttgggtgtaatgcctaccttgggtgtgattcttgacgccattctcggcctccctggttggcaccagaatcaccgtctacaccaccttctatgctgctcgttgtcgtagcactagggctaccgcatcacccacatcacccacttcgaagcatggatccgggtaggtggccgccgccaccaaccccggcgccgcatggtcgctgacgccacgcggcctctgcctcgccggcctctgcacagc

SEQ ID NO: 13137 - DNA, 1501 bp, Oryza sativa
cggaattccgtccgcttgagaacctgtacgggtaggcgggcgatcaagtttttgggtagcacttcaagcgcgactgctccggttcttcgacgacaacgttgcatcttcctctgcttctgcttcaccatagcttctactggagagaacaaaggagacaacatcaacagaggcaatacgaattcctcaacatcttctgcaccgttctctgggtataagattgtaactttatttgattttcttcttattatttacatgttcacaatgttatccataggatttcaatcctatgtgaatatcaacgatgtctatacttattttaccttaaacatctcatcaccagatcgtttctcattgtgtatgccatatttattgtcataatattttggattaaaatataccgaattatgaccaaattttcaacaatatactctaacaaaaacacctctagcagttctggtttctcatttgaaggcccaactctacctactacccttcagcagggcccatatccaagccaacaaacccactaacttttttaaacttttaattttaaaaatcgatcatctcaatacttatttttatttttagatctaaacattttttttctatttcactccgcctgatgtgtggcgaacaacattgtcacgtcattagtaattcatgtcacggttttatcgtgccagttttatcttgtcacactagtacaaatgacatggtaagacaatactaccacgtcagccaaaatgacatggtaaaataacactgccacgccttcctcctcctgcgcgtggttcaaccactcgagctgcgacatgacagcgccagggatcttcaccttatcagcctcacaccgtcagtccgcggatccaagaattttcttaagcgtgaacaagcttaatagtagataattactaataactactagcccctctagttctcagcccaggtttccagtgctccaaacaactccacccaaatcactccaaaggacgacgcgccgccctcgctctcgtgtttcatagcctccgcactccttgtcgcacatccccgcgggcatgcccgttgctgcgggcgcagctcaatttaagggtattcaggtgaatatctaagatttttgaaaaaaaaatatatttgtatgagatatatgtctcatatgaatatgaaaaatatagaaaagaggcctattaatcgaaagaaaagcccaataagaaagcctggcctcctctcctcattatgcaggcccagtagccaagaaggccccaaaattaagtcaccctagaccacctcctggtcccaacttcgccccgctgaaacaccgcggccgcgccgccaatcgccatcgcggggaggtgttgttttttttttttttatcccttcccattttgaatacccaacctaaaaattctaagcgcgcccctagcggcgacgagcaccgcagggcacagccgcgcagggtataaggattcaggactcaatcaggagctctcaggttgcagacttg

SEQ ID NO: 13138 - DNA, 1501 bp, Oryza sativa
tcgtatatatgctatagctcagctataaattcacagctagtccttgcttcacctaggaccagtgtgatcacgcgattactcttgtagtaagctgatcatttttataaagttttatgtcaaaaaaaagttgatcatttatattgtgtagtaagacggatgattaatcatcacaccgttatatcttctggaagtgtactataatgtttaatatatctaacttgggatatatactatgcacataaacctgtgcatgtacacacgttatacatccactaaaaatatcatcgaaaattataaatctttttggtacatgtacctttagtattgcatctatgtgtaatgtatcatcttgaatttcttcacgcttagaccttgttcggttaatccccttgagggagggattaattggaagggatttagggggtgtttggatgggggtaaaaaattttagtccctatcacatcggatgtttgtacactaattagaagtattaaatgtagactaataaaaaaaactcattacataaccctggacgacgaatctattgagtttaattaatccatgattagcatatgtgatgttacattaaacattctctaattatggattaattaggcttaaaaaatatctcgtgaattagctctcatttatataattagttttgtaagtagtctatatttaaagctctaaattagtgtccaaatatcctatatgacaaggactaaagttttgtcactgatccaaacaccaccttattccacacctattttggtgtgaaattattccctctcaatccctttcaaatcaaacaagctattagggaaaaaaagcttggtttagttcctaactttttcttcaaactttcaacttttccatcacatcaaaactttcctacacacaaacttctaatttttttattcaaacttccaatttcggcatggaactaaacacagccaaagacaattatgatagaattatactattaaagctaaaaaaacccctatatattcgtagatcgagacattactctattaaattactgtatcatattacaaacataatggagtagtgatcgaagataaaaacgatagaacaaactctcccattaaataggacacattgtacaaagtactgatcatgcaacaatagtagtactctgttgcgtgttgattacccatggaccagagtagccatcatcatcacccatgctgccaatctgccatatgcgatgtcatatgcttgcgcttgcatatgtagagagatttctctccacacggcaaagctagccatccaccacctttgcttgcattcactcgccattactgacggacctaccaactgtagggcgtaggcgcaagcaccactccactgttgcagttctcaaatgcttgcacttggcttccgctcatgctcataaaaaagaaccgctgctaacgttgcgaatgccctgatatagcaagctgttcggccgccggcgcgaagaacatggagtccgtggtgg

SEQ ID NO: 13139 - DNA, 1501 bp, Oryza sativa
agcagcggcgggggcggcgtgaggagggaggtcgtggcagccggcgcggtggtgggaggaggggtggcgttgcgctggagagaggcggcggcagcggcgccgacacgcgaagagatcagtggtgacggggccggcgcgcctagggaggagggggtggcggggaggaaagaagcagaggtgaagagagaagagaggagaggaggagatgagaagagagaactacgggtgggtcgcacatgtaatagggtcaaatcattaaaggcataagagacattttgtgcttcagttaacaccattaggtgcctttaacagaatagggttataccgtatcttcattttcaaaaaggagggtcaaataagcaaactcaacaaagtagggtcaaattggtagttagggttcaaaacggggtcaaataagcaattgcccctttacaaatataatctaactgtttgacatgcatagtggatccatcagctttagttgaaatcgacggacggatctttttcttttttcttttatgataacttttgagagttatgatctatctaattacaattatatattaactgttagctagaaaaatatgaaaggtaagttagaaaataggagaggagaagagatacggagggtggagggagtacggattacgtacgtgcgcaaatacggtgcggggtgttgtaccggattttttaatagagaactaatggttaaaattgatgggtccacctatttaaaggaaaatcaatggttagatgtattttgtttttatcagaatttttaagattttctctactatattaaagtgccatgtggcggtttaggagcgtttgtagagcgccacgtggcggcttaggagcgtttgtaggaagtttaatggacttttagtatataatagataataaataaattaaatgtactggacctagagaattaacatggatgtagagaatatacatcaaagtgaaggaaaaatgaagccggcatgcaaagaaacacacctccgacgaatcatgtgcgagcacgcggatggaagggcccaccaggcagtatattagtatatactttgtataactgcttcattctagctaggctagttgatccatgctacagtaacggtctaatgacctttataggtagctctagcgctaacttgtctacccgtagggtgggagtcctaggggagtaagtgacattatttactagcacaagcacagtgcttaggttatataaatgccattggatgtgggtgtgccccacgaaaagtgaggtagatggtaggtggtgatatccatgtccatcatttgtattcctccacgttcgggtgtgacgtattgcgtaaatgcaataactacgcttgcagactagcagggagtggtctctcggtagtacctaggtgcctggaactaagtcctatgttgtaagcatgtatatgttaagtgtgtattagacatgattagtatagaagtacagttgtatcatagttctctaatactctgttct

SEQ ID NO: 13140 - DNA, 1501 bp, Oryza sativa
ttagcagtattcaacaacatagtataggaactaaagaacagattttcaaggccaacctctgtgttggtagatccatccacccattttctgcatatggtagtaactctaatcctcatttgaccttctgggtgttggtaactacagagaaaacaaaagcacaattataacatcaagccattcttacactggaggcaacagaataaaaatgaaaggtaccttgttacaaattgtatatacagatcgggattctgatgtcctggttggcttgaccgctcactcggtgagacatcaaaaaatactgttaatgaagtattcctgtcaagaccacacattttccatgctgttgtatttccttgaccaacaactgtgtcggcacatagagctcctttctacaaatgccatgatgtattaaaccaagtctcaaaataggcctttccaatttgaaatatcttagagcattgactagatggaacagatacccctaccttttccaaagatgtgcatggtccaataataccttgaaccttaatgtccttcgaacagtttatttcaagcgtgccactttaacaaaatgaacaagacaaaggatcagtcactgatgaaacaaagtatatgaaacatatacaacagtaagccatgcacatcaaaccaagctgttacagtacaaaatatatcttttgttcgcacaattggtcaacagaaagatcaaatattcagggaattttcgtctactgatatatttattgtacgaagaattaaaatgttggcaccacctccataccccagtaccagtttataaacagagcaattcttatcaagataatgatagggaaaacctattgtagtcataattcagcatttatgcttcatgaagcagaaagctcaataccacaatgcagcccaacagggggaataagcatcaaacttacttgaatgaaaggtcgagagactgttcccctccctcaaaaatacgtttaaaagaatccttaaatactgaatgcccaaagctttcagataagacaacaaggccacctgttctctcaatagcgaccttcatctcggcaaggccaacctgtaggtgttccaaccattttttgtagaaaaaacagaaaatgagttcaggtcatgtgtatcacaatcagcagttatgaaatgcctaatgattgagaattgaagtatgcaatgtatcaagtgataactgtgaactagcaagcagagtcattacgactcaattggcactaacaatttcactagaagtgaaacaaaaaatagtcatgcccgtttatcaaatattaatctactttcatgatcactggattggtatgcagacaacttgatcctcacaaaatgaactatcaataaatattttcatggactatgttgtatcaagttctacagttgacaacaatacatatatttgtatgaattgaattttagttttgctccaatgaaacgaaagctcatatcagaaaaggaaaagccaaaaaatatgtctggttat

SEQ ID NO: 13141 - DNA, 1501 bp, Oryza sativa
aacagaacccaagcgtcgtcaacgcttccattccgtgcaaggccagaaatcattgtggtccatgacatgacatccctcactggcattctctcaaacatcttacgagccctctccaaactccctgaccgcacaagtccacacagaagaatgttccaagagccagcatccctcaccggcatgcgattgaaaagggcagacgcatcctcgacgcggccaactgcggtatacgcctccagcatcgtgttccaagagacgacgttcctctccgccatgccctcgaagagggcctcggcctcgtcaacgcggcgtgcgcgcgcgtagccggagagcagcgccgtccaggtgaccacgttccggcgcgcatcagggcggtcgaacagcacccgcgcctcctggagcatgccccggcgcgcgtacgcggcgaccatcgccgtccacgacaccacgtcccggtcgggcattccgtcgaacagcctgcgggcgtccgagactcgcccggccgcggccagctccgcgacgcgccagttcgagtcctgcacatggttgaccccagcggatgcggccggggcggcattgttgctgatgcaattgaccgtggcggcaaggcagagccgcggcgagcggagacggcgcagcgcgggcgcagccaaagctgccattagagaaccaggagattctgcaagtctgcaacctgagagctcctgattgagtcctgaatccttataccctgcgcggctgtgccctgcggtgctcgtcgccgctaggggcgcgcttagaatttttaggttgggtattcaaaatgggaagggataaaaaaaaaaaaaacaacacctccccgcgatggcgattggcggcgcggccgcggtgtttcagcggggcgaagttgggaccaggaggtggtctagggtgacttaattttggggccttcttggctactgggcctgcataatgaggagaggaggccaggctttcttattgggcttttctttcgattaataggcctcttttctatatttttcatattcatatgagacatatatctcatacaaatatatttttttttcaaaaatcttagatattcacctgaatacccttaaattgagctgcgcccgcagcaacgggcatgcccgcggggatgtgcgacaaggagtgcggaggctatgaaacacgagagcgagggcggcgcgtcgtcctttggagtgatttgggtggagttgtttggagcactggaaacctgggctgagaactagaggggctagtagttattagtaattatctactattaagcttgttcacgcttaagaaaattcttggatccgcggactgacggtgtgaggctgataaggtgaagatccctggcgctgtcatgtcgcagctcgagtggttgaaccacgcgcaggaggaggaaggcgtggcagtgttattttaccatgtcattttggctgacgtggtagtattgtcttaccatgtcatttgtactagtgtgacaagataaaactgg

SEQ ID NO: 13142 - DNA, 1501 bp, Oryza sativa
taacttatgtggcgaacttatgtggcgctgtattaaatgagagagatgaaaaaaaaacttggtcttatacaacacatatctcaaagggaaaaccaatacactattgctgcccccagttttggaaacaaaaaatatattttgtttccctataccaacccctagaataacagttggtacatacaaaaggctccaaaatgtaacgtacccaaactctagacctttaaaatttcttgtcaagatagttgaaagattacttttatatttttgtgagacaaaaattttcattttaaacataggtgaagataaaaccaacctttatatgtaggaaaatgagagcaaaattaaaacctttttcatttctaacctgagattaaaaaaaagtgcaaccatatgtgtaattatgcatacttgcataggacatagtttaacttgagtcttttttcttgtgcatttgtatttttggttggcatggcataataggtctgatgaacatgattaaaagctaacttcactaagcaaacctaaagtcattcttgaggtataactttaaagacatgaaaatggagttaagtaataacatgtcaggtcaagagaaatccaaatataattcttataaaatttagatgcatttatgcattggaaacacacatataaagaaaggtcttgctaattatcaagaacaatccatgcaagacaaaatcatgagaaaattcatgaaagcacaaatcaatataatcagctcactataatttttactcaaattaatatttaaatttcttagctcaaataattcagtcaaagcagtcaactataggatgtaaaatttaactttaatctgctaaaaacataactcacaaaaatgtgcattaaactgcatagaagtgtatgagtgaaataatttattcacatactaggttaattatcaagagcaaatataatttttctagagtttatttcttctatttagacctcctaaaattcaaacaaagttctggtgagcccatattctctatttgtctgacagcaaactacacataattagtacaaccaaagaaaatagaatctagataatttcatctacctccggaaaaatccactataaattattctgcacagaaattaaataattgaattactaaagtgagggagagaaataattcaggaaaatcgttggaaaacatcttccactcatgttcctacccttacctctcttacccacatagctaccatcgacctgggcccatctagcagctccttggccacgcgtcgaccggtgcctagccgtgtccgagacataggagtttcgagaaatgccatcatagaaacgattttgtaactcaacagcacggaatagacggaaccctaacagagatggtatttttagaataaaattgttagtacgatgatatttcttggaacttacacttgtccatggtgtttctgggacttagacgcttgtcaatggtatttcatagattatctcttattatatatgtaagtc

SEQ ID NO: 13143 - DNA, 1501 bp, Oryza sativa
caaaacctgatttagggaagacaacaaaacacaggagtagggtcccgcagatccaatcttgctttgatattttgatctctttatttctacgccgtgcactgaccttgggaagacaacaaaaacataggcgtgcaagcagatccgatcttgctttgatgcactgatctactttgttatctttctacgccgtacacgccgtgcaagcagatccgatcttgctttgatgcactgatctagggatctgatattgctttgatgcactgatctagctgatctagggaaaacaacaaaaacatcttgctttgatgcactgatctaggcccgttgtccgagcaatcgctcgctcgacagcatggttccaaactttatcagtgttagtagcctctggcaaacctcctatttaatctagtgctgcccaagctagataagtgaggtggtattattcgtgctacaatgctcggttgctacatgtcgcgcagtactgtgctgggttgctactcctctgctccgtgggctggctgctgggctatgtttgtttttttgttgggccggtctgcttctgctttggccgagctacttgccagcttcctctttttatttgcagagcgttaggatgtgtttggataatggaaaatagggggtgagattgggattgggaaatgaatgaagggttaggattaaatggaaaagggagaatgaatggttaagatttaaagatgggtgggaaatcatttccctttcccatttgccaaacactcccttagagatcgctgtcacgtgtctggactcgcggattagagcaagtacaatagcaggctataagccagctgcaaatatattttaagtagataaatgagaagagagaagggcagcgagctacagatttgtagctagctgtagtacggactccaagacgcagtgtgtgtatgacaagtgggaccagatattaatagtgtagtatataactattgtataaatgagctgttagattggctataaatgaattagagctagtagttagctatactattaaacttgctcttagtggtgaaatatcgcgtgggcccatgttttaatgacggatgaaaaattagcttattttttaattaaaaaagtaggtataggtataggtgtaggtatagattaagataagataagattaaaataagattttacattagctgattagcagggcttttgccttgatatttgtactgcccaatgacgacttgacgagcggggcaacggggaacatgggccagcgagtcggagtacgactcctgttcgcaaccccgaggggggcaccgacttctgggcttctggcgttcacgcggaatgctggaagtggaaaccgactcgggctcgtaccggtcatccttctctataaatctggggttcgtgccgcctcgtcgacaatcgcccatccaaatccagcgcaacgcaacgatcagacgagacgagaagagaagatagaccggcccttcatcagtcaaaagagtta

SEQ ID NO: 13144 - DNA, 1501 bp, Oryza sativa; identical to SEQ ID NO: 13143

SEQ ID NO: 13145 - DNA, 1501 bp, Oryza sativa
acccgggagcgacaggttcacgtcggcgtcgcgctcggagcgcgccgcggcggtggacgcgaccagcacggacgcgtcgcagccgccgacgaagcagtcgtggaagaagaggcggaggacgcccgccgccgtcgtagggttggagatctgcttctgcgccagcacgtcggcgatgatccggtccgcgcgcgggcacgtcttgctgtagtagtccgccgacatcttggcctccgccgcggcggcggcggcgagcaatgccaggacgacgacgaggtgagtgtccatggtcggtttcttggcagcgtgcgatgctacacctaccttttgctagctagcttaccttcaggtatctgagatctcgccatggatggaggaaggattagatggcgggagagcttcttggaggagagcaaatggagggaaagagagtggtagggaatggtctcaggacttggtgtcaacagagttcataaagccgatcgattttcgttaaaccgttaggtcttggttcgtaaaaaccgatcgatattaaccgggttctgtacgacattgatcgaaaatcgtcgatttttattggttcttcgttgttgatgaggagcggtttttacttcgaaaatgaaaaggggattttattgtccaatggaaatatggaataatttgaaattatcttatactccctccgtcccataatagcttacgtttttgactttttatttgcaacgtttgaccattcgttttatttaaaaaaattagtgtaaatataaaaaaagataagtcatatgtaaagtacttttgataataaagcaaatgataaacaaaataaataataattccaaaattttttgaataagacgaatgatcaaacattgacaaacaaaaactcaaaaagacaagtaatatggaacggaggtagtaattcaataaaaacaagagttagttgcgttcgataattcctcttcccaatttctactccctcgtttttcgcgcgaacgttttccgaactactaaaacaatatgttttttttaaaaaaaatatagaaaagttgctttaaaaaaccattaatgtatttttcaatttttaatctaatatacttaattaatcatataatagtatgttacctcgttttaatccattttgtaattattgcatgctttgggctgacggcgatcacatgatcaataacattttgggccctcgttttaatccattttgtaattattacatgctttgggctgacggcgatcacatgatcaattacattttgggtccttttggaacgaataaattttgcctgaggatctcaaaggacgctattcagtgctagcaaaatcgttgacaacttgagatgtgaattgcttgttaaaagagagattccatggagttggcatctcctatggctcatggcaacattccatagcttcagaattttgcaaaaacggcaacttagttcgatgcaagaatactttgctccagcttagcatgcatcaacaaactacacat

SEQ ID NO: 13146 - DNA, 1501 bp, Oryza sativa
ggaggtgtagtccagggatttgcatggaaatttacttgcacggcaacagagccaaggttatgtatagagcagtgaacctgaagagacctagagatgattaactgacaatgaaatggcgacctggagcctagtatattcagtcaaaggagcactgtaattgggcaattttcaagcccgcctctgagatcaatctgttgtaaggatgtttgtctctcgtgatatagggattaattatgtatttgagcatggttcaatgcactctcaacttgtttccgaaatcatttttgtgtgcaggttttcaatctgctgtgaaaaatgtccgaccgaaatttgtctgactgaaaggttctatattatatattacagttttcgatctctacttatctgccgtagaatggtaagtacagcttatgtggtaataatatctgtgtttcgtttcagaagcaagcatatggatttgttcattctgttcctccatgtacccacgtgtgacaggtctgtaggacggttggcgattgttcaatattgctgtcgcaattgggtcatcgtttgtgaacaccgttgacatcttgttgtcccaactccatctatgtactcatcaccgttgacatcaccatttgccgtaaccatttgctttatttcccactgggacgtgcttatgtgtttttttccttattatagcttctaatactccctccgtttcatattataagattttctagcatagattcattaacatctatataaatatgggcaatgctagaaagtcttataatatgaaatggagaaagttagttataatcatgtgttttttcttattatagcttccaatagttataatcttgtaatttttttctactattttaatatacaagctagcactgtcttatgtgttcgcttaaagaaaaatataggtgatatgccaatgaatgagaggtgcattttgcatgagttgagccaaactcggagtggcaacatgccgccaaccgaacaagccgttgccggttgatgacttgattctaatggtcttggttaactggctggatgttgacgtggccatatgagtttttttaaaaaaaatgtttgaatagttgcatcgtttgaggatacaaaaggaattaattaaatattataaagttaaaaattgatttaaaataattttcttataaattcatatatagacttttttttgcaaaaaaccagccgtaccgtttagagtaagaaagcatgcgcatttcttcgaacatcccatcataaaataacacaacctatgtgtgaatacgcaactctggaatataaatcacatcatatcttcctatatagttggtatccactaaggcgtatttactcctataaagtaagaaatgcaagaagccacatcatcaacaattttaagtcatcagatcacattagtacaaagttaacaaccattggatcaagaagctacttattcattcaattcaatcatttattagttatccaatcacctccctttgctcca

SEQ ID NO: 13147 - DNA, 1501 bp, Oryza sativa
tttttattttcttgaataaaaattatgtgtggcaagtttaaaatttaaattgatacttatgtaagaaaataatatattttatttagaaaagcaagttaattcaaatataaccaagactttaggagtgcatagcctactatgctttgtgatactaatcacatgctagttacgtaggactcgttaattaccttagactaatcacatggaagcagtgaatccgtaaacacgtcatactcaaaatcgcactcagaagttggaacgcgtagaaaaatacacattggcctgaacgcctgatcagaacttgctagggtcctgccaacgttcgcgtattacatattgttatgctaaaaacccttggaagatcaaatttgacaattacgtcctttaaaccttctctaccgttgattcataatcaacggatgcgggtaagaaccgaaccttggaatcacacacggccacgtggcgcgttttaaacatgcgtaaactttgcttctaggtttagccacgtggcccagtgagttagtagggcttgcaccctgaaatcggtattctagatagcctactatggctgtgtttagttcctgaaaaacaattgcaagtttgaggaaaattggtagtttgaaaaaaagttgtgagtttatgtgtgtaggaaagttttggatataatctgatgtgatggaaagttaaaagttgggagtgaactaaacacggcgtatgcttgagtgatactactaatcacgcactagttacgagtaggaattgtgttaattaccttagactaatcacatggaagcagtgactccgtaaacacatcgcactcgaaatcgcactcgaaatcgcactcggaagtcggaacgcgtagaaaaatacacatgagcctggtcagaacttgctcaggtcccgcgaacggtcatgtattacaaccagttgttatgcttaaaaccagttgtttttcctttaatcaatcatgcttcttcaccctcttgattactgataaagctccctcactgccgaattaacaatcaagccaaaatttctgatgtcactgctttggtggtttggtgtcctagtttgtaaccctcttatatatactaaggctgcgttcttttaggagagataggggagatttcactcgttttccgcgcgcacgcttttcaaactactaaacggtatgtttttttgcaaaaattttctatagaaaagttgctttaaaaaatcacattaatccatttttaaagtttaaaatagttaatattcaattaatcatgtactaatgactcacctcgttttgcgtatcttcccaatcttcactatctcattctcctcaaacacagcctaagtcaaatgttcggagcctaagtcaactgtcgaaacatgaattcggcaataataaaacggggtagcgcacgagacctaaaagtggatggatgtggagacaaaggatttagacaggttcaggccctctcaatgagaggtaataccctactcctgtttggggatt

SEQ ID NO: 13148 - DNA, 1501 bp, Oryza sativa
ttgaccaaaatcaaaagggagtagtacctaattaatactccagttgcagttattagttcacagtggaaagcacattgtacagaattagtatttcattagatcttaagaagaaacaacaggggaaatacgagtctataaaagagcaccatcttttcttaaggcaaacagatcccctggcaaaaaaaaattataccctgtcacatcgaatgtttagacacatgcagggagtattaaatatagatgaaaaaataactaattacacagattgcgtgtaaattacgagacgaatcttttaagcctaactgcgccatgatttgacaatgtggtgctacagtaaacatttgctaatgacggattaattaggcttaataaattcgtctcgcggtttacagacggaatctgtaatttgtttttgttattagactacgtttaatacttcaaatatgtatccgtatatccagtgtgacatgccaaaactttacacccgtgaatctaaacacaacctaaatacttcaaaagaggagagagataagaagaaaatatcatcaccttgtagatgtaaaaactcaaaaaataaaaagaggtgaagaaaataccaccaccttgcagatataaaaaaaaacacaagaaaaaaaaaaagaaaagaggaccaccttgtagataaagtactgcagctcctggaatagtggagtgcaactttctcaaattggaagattcttcttcaaccgtaaccacttgccattcaactctggagacgaggcgaaatagacagttgagaaaagccagattggattgcattttcacttctatgacagtatagttgcgtgagcttatttgggaaggaggcatcacggtatgacagtacgtgcaaaaataaatcaccttgagagaacagtacgaaggaagaacaacaccacacgacgaattaagatcaactgcagttacacgacaggtgaaaacttcagctcatgagcatgaccattatggcattattgcatccaatggtacaataaacaagactgataagtacaacagcagtagcctgacaatgcaagcccaacggccggccattatgcagtcaaatggcactagaacaaatcgaattcggaacaagctaacttaaggggaaaaaagatgaaacgggcccagataagcagggcccgaaactaacctgcctgtcaaactccagggtcaactacactaacacttctcagtaggatgtgcctagcttagcagaacttccagtgattgttgcagttcacgcaggtcacgaacgtcgtcatcggctcgtcggcgctccgagtctggagctggtagtaggtagtcttgcgctggccgcacctgccacacttgaactgatcagtggtggccttcggtgctcctccacgctcgcactcgaacagagccttctcctcgatcttcttgttctcaagcttcctggtgtcgctagccatttctgtcggggttaggtcagcaattctctcaggctgcacttgtccta

SEQ ID NO: 13149 - DNA, 1501 bp, Oryza sativa
aactaaactactatattttttttttgggcgggggtctaatacgtaggcagccccgtccacgatcacatccgcttaccaagcacgtgcgcagcaagtaccagtaactggtgtgttcggatgccatttttcccagtccctctctctcgtttttcgtgcgcatgcttttcaaactgctaaacggtatggcttttgtaaaaagtttttatacaaaagttgcttaaaaaaatcaaattaatctatttttgaaaaaaaattagtaaatacttaattaatcacgtgttaatgggccgccccgttttccgtatgcaccgatgtaggctgtgtttagttcacccccaacttccaactttccatcacatcacatccaaaacttttctacacacataaacttttaactttttttccaaacttttaactttccctaaactttcaacttttttcaggaactaaacgcagccatagttggtccaatatgtataacaagaaaattcatgtagtcccatgtttaattcagatgtatttcctttttctccaggccttgaatccaatgagcattgtatcagtgtattgacccaacccaacaaattaatctacccatagactctatacgtagataatttgtaaaaaaaaacattgtgtgccgaaactttgtacatgtttatctatggatctatatctatatgtaaaaatatgtagaaatttatatatagaaaatgtattcctagatatatagacttgatacaaagatagtttataagcataaattctatacaaggaaacgtttatacactttatacatagctactttttacatatacgcataaaacctttatacatgtaaatttgtgcatataaactttctgtgaataaatttgaaacacattctaaaacaatttgaaaaaagggaccatatacctaggccctagatgctttcaccattcaatttctagcccgctccaagagaagggaaggggttagagggaagcccaaaacaagaagaaatatgcccacggaaaaaaaaacaacaggaatgatatctcgcgcatatgcgcccgcatcgcacactccggcctatccgacacataagtgttagaggtggaaaaacttggtcaaaacacttgttcctcttccctagttccgctatttccatttgacgattgataaggcggctcgccgtggtccatcaatctcttgctctggcgcccaacagtccttcaccatctccagccaccctccatccctttccatctcaccggcatctggccatccctgtctcctgccgccctccatccctccccatctgctttctccgtccaagtggcggcacctctagctcctcaaaatctagcatgtgggtagcgatttcagccatcactccattgccaccatgtggcgcatcaagttcgtactgctccggaagatgtcaaccgtccagttcttacaaggagaagaatgatttcggtatgaaagatttaggttttatgaatcgaatttgtttgag

SEQ ID NO: 13150 - DNA, 1501 bp, Oryza sativa
aacgctgatcccacttccgcggcgcagagcccacttccactttcgcgcacctcgtcttcgccttcgcgttgttgctctccgtcccacagccgccactgctgccatacaccgccgctcgccgccgagcgctccctcgccggcatgacggcatccatcccctatcactctgcggagacatagggatgaaaacggagcggatttggacagataatggtcataccatatcctaaaccataatttttaagccgattcggagcaggtgcggatattgtacggatgcggatgcggagcggattgtttcggatgtcagaaatagtgcggaatcggtttgaaaatggattaaatttatcggatgttacgtgtatatgcaatcaatgcaaaatcgagttagcaatctcaggaacaataatacaataatccataaatgacccatcgtaataagtatatgattaagtgctaaacaacatgaatacatgatgtccataatataaaaaatatagctacgtgagtgtgacatgagacgataaaagccttagacttaaaaatctatgttaattaatgaattagggcattggatgtaccaacttatgttatatagaatagatagagtggttatatatgttgataatctcggattatccggcaaacggcttatcacataatgtcggattttagagacaccatatccgcatccgcatccgcatccatctcatactatccgcatccgtatcccccggatttcgaaaagcccataccatatcctcgtttcgaacggattcgaagcggatcggatcagatattatccgatccgttttcacccctacggagacatgtggctaagaaacggaaagagaaagatgaactaacacgtgggcccaatatttacttttattgttttactcaatgacatttgggtcccgttttgtttttttttaaaatttaatgccacgtaagcgccacgttgatgctatgtaagatgaaaaccaagtcaacccgctacgtaagtgctatgtaggatgaaaccgctattaaaaccaccgggggattctatttgcaccggtttttgaagttgggggatgtgttatacccagttttgcagccgagggatgtgattcaaccaggggcataagatgagggaggaaaagtagacttattcctgcaaaggacgccgatcccctacttccctggagtccaggagcagatcaacacaggccagtatgaacacacagcccagaaacgtgccaccccccagcccagaagaaccggcccatgtgatccacgagaggcgggtgggtagaagtgagctggtcgcgaggaaaattcgtcgacgccgcggagggtttatagcgagcgccgagcggagcatccgaggggataaaccagccgccccgcaacccaacagctatcttttcccatttctccccgcccccccaaccccacctccaatccctctcgtcgtcgaggcgagcgcgggcgcgggcgcgggcggcgagatggaagg

SEQ ID NO: 13151 - DNA, 1501 bp, Oryza sativa
atgaaatcaatcgatctccagatgaacttgaccttgatttgttgatgatctgttcgccacatttgggagtacgtttttttgggagatttttacttgtcagtgaccgagcgatgagttgaagcagacaatgcggcagcaagtactccctcagtcctttaaaaaaggcagaccctaggtttccgtgtccaactttgactatccgttttatatgaaatttttttataatttatatttttattgttgttagatgataaaacatgattaatattttatgtgtgacttgtctttgtaatttttttcataatttttttaaacaagatggatggtcggaaaccagatttgtcttttttttttttgacggaggaagtagaccgtacacgaggccacacatgtgcacgtacatgcgtgggccgcgtgggccgagctgtctcggccgttgcatgtgtgatggcgatgggccgattaacaaattcctcctctctctctctctctctctctctctctcgatctcgatctcgaccgtagatccggtcagattagcttagcactagcacctgctcatgctgccgccttgttaaattagagaagcagtgtctgtgtctgtgagtctgtcactgcagctagcgtgcccacaactggcacaggcacaggcacatggtgatggtggtggtgcatctggccaactcaggctcagggccacgtgcatgtacgttcgcttgtcattgtgtcacagagagggtcccaactctcccaacccctcgcgttgtgcgtttgcatacgtcgacgatcgcccaatcgtgtgtgtgcgggggggataaggatccggtgcagttacagtacagactgcaagtttagcagctgggactgttttccatcgttggatcaagataatcaacggtccaaacagtgctacaggaacacactgtgtacgattttctgtaaacagtatttaggaaagatctaggacatcaatttctgatccaatggtggttataggactgcttaagttgcaggagctatagctactgcaggtgatcccaatccgtgtgggggggttgccgagtgcggaagcgccaggcgtgtcgcggtctgtttggttcacgtcgcgtgcagtgtgcagtgcagcagcagtgagatcgacacggggggcgcgcgtacatgtgcaggtgcagccaaaccaacagtagcgctgtggcggcccgatcgaccgacgcggacggaagctggggtaggcaggggggaactggaggtgcacagggttaatcatatcatatcatattaaatctttagttttcctgagccactaccaccagtgcgtcgcttcacgagagctcacgattctgctacagtgcaacagtccctgcctgcgcgtggaccgtccgatgcacccacgttgctgagatccgaacatccgcgtgtctgcttctgcgccagcccgagcccctgatccgctcgcccgtcgtcatccccaagacctcagccaggcacgccacgcacccac

SEQ ID NO: 13152 - DNA, 1501 bp, Oryza sativa
tagaagcaaaatataaaaattaaaaacaaaggggcccacatgtcagtcaaacaaaatataaaaaaatagtggtacctatggttccaccctcctctctacctccacaggcgagcgcgcgcagagagccggagagggtgggggtggcggccatcgtgcgtcgcgacatacctcgctacgagggcgacgctagccgccggaggactgaaacctaagcccccttccacacctcgccgcgtgcttgcccttcccgctccccttcacttggggcgacctcaacagcgagaagggctggccgccgcccctccgccgaccgccgtccttctctctccgctggcaagccgaagctagccaagtgtgtggagagggaggaggaggggaggtcggcgagagggcaggggaggaagaaggccagcgaggtcggactcctccacgaccgcagcctccagccatcaatctcggtgagcaggcggtggggcacatgggtcatcatcaggccattggtgggagcatcaaggatgactccaatgactctggcatcgcgttaaacctctcgaggaagaggctgccattgggttgcaagtgccactcaagaaagcggcgccaggttgagaagggcggtggcggttactcctacctctctcagcctcccccccctcgccaacctcctccctcccctgcccactcgcttggcctccctgcctcctccctatccacgcgctcggctggcttcggcacatcgaccgccacccttcaccctctctgggcctctgtgcatgctcgtccgtggagagagagaggtcccactattttttatcttttgtctaacttacatatatgccccacatttcttgttttaatttttatattttgcttccaatgccacattaccaccacgtaggacgaggactaagtgaaaccagccacgtaggtgccacggcagccaaaaccgctatccaaactattgagagaccttgtttgtatcctttttgacacttgagggacccgttgtatctggtattatggttgacggatgaaaatcaaactcgttatcaaattaagggacctcaaatgaacttattccagtgcctaaaggggcaggaggacaggactccggatgggccaaaaaagtaatggactgggacgttgggccccggtccgttacccggcactgcctacgtttctgcgcacgtcaggatgtcgtacactctagctagagtcagaacatctttgagctctccggccgttttatttactccagaggaacgaaagcaacaaatccacatttatttactaactttacagcaccaaaaatccaaaatgctagcagcttctgcagcaagttagcaaacaactaactagcaaatcacacactggctatctgccacactttgtcgatgcaatcgcgctagctgaaaaaaaatccaggcacgtatgtatgaccgtggccgccaagaaacctcacaaagacggagaaaaacatgtgacgccaagcaaagcgtat

SEQ ID NO: 13153 - DNA, 1501 bp, Oryza sativa
ttcgttgttttgttttcgtcaaacacccgcgccaccgtgcatgcatgcttgcgtctgatgcgtgtttccaatgcaggagctgccggtgcagcagtaaggcgacacggtgagcagcctggtgtacgaggcgaacgaccggatgcgggacccagtctacgactgcgtcagggccatctccttcctgcagaaccaggtgtcacagctgcagatgcagctcgccatcggacagggcgagaacctctgcatccagatgcagcaccgtgatggcaacgagaacgagaagaatgtgagagaggaggaggagagagagagaggagggaaaagagagaaggtgctgacgtggaccctaacatgtggggtccacatggggacctacgctgactcagccgccacgtcagacaataccggagttaaaaccaccgaatgatctaaagtgaacggttttgtaagttgagggatgtcgtatatctgattttgcggttgggagatgattttgtatctcgatgacaagttgagggaccttgggtgtactttttccttttgcttgatgcttggtgccagggtaggtttgcagcccagtacagagtaaacaggcctaatctagccatcagtcaagatccattaggttcctgagcccttggtttcttttgtgaataaagtccaataaaagtcccttaaatataggtaatatctaattcaaccactcaaccgttacgactcctcgaattattaaagccagtacaaatgactctaggatgatttcgatggtggttttaactgaagtggaatcccaatcagtaagaagaaaaaaaaaatcccagggaaacccacttgtaccagaatagccatgagcccgagctcaacggggaggtagagtccaagcccgagctatgagttcttctgccatcgggcacacccgtcatgccatcgttgttgcagcctatctgtgctctgcaatgacattttggggttgcttagatccactggcaaaattatttttttccctatcacatcaaacgtttaaacacatgcatgaatcttttaagcctaattacgctatgatttgataatattgtgctatagtaaacatttgctaatgacaaattaattaagtttaatctcgcggtttacaggcgtattctgtaatttatttttgttactagactacgtttaatacttcaaatgtgtatccgtatatccgatgtgacacaccaaaactttacacccataactctaacacagtgtcagggttacggataaggcatatcttctatcctgcgacttatggaatatactaataaggacttatggaatatactaataaggtatatctttatgtacacggattggttccatgtacgctcttaaggatttgttttaaatcacagaaaatatctccacgagtcaagcgatttccaaaatcctactcggaaggggtaaagtttctgttataccgtgtcgaatcaaatatccccatatttttcttggggtcaagatgatc

SEQ ID NO: 13154 - DNA, 1501 bp, Oryza sativa
aacgaaatgcgtcgggggagatgggagcacgctcccagctgccgctcctcgtccccactctgtgtcgtgggcagtgaggtgggcggcggccgcagcgtcgacggcaaggtgggcggtgcccgcggtggaaagggagcaatagcttgcgcgccccaacgcgcggcggcggactggccgagcgctccggcgtcgaccaggccatgatgcggagcagcgactggagctcctcctcctcctccgacacgggccccctccccgaccacgtccgccgcgagaccgcccccttttcctcttggacttgccgccggccgcgctcgcggcgacctcgcagagactcgggaagttggcggcaggagcaggaggctcggtggccgccggggcggcaacgttctcgccggggcgccaccatccctatctccccgtggcactagcaccgctccagtcccggacccgctgaagccaaatccttgctactgcggcggcggcggcggaggggacgcgaagaccatcggctgctgctgcatggcaaagcgcggccctagcctcgccgccatcatcccccgcggcgagcgcaccaccgatgccacgaacgcctcggcctccacgaatgccacgccgccgccggcctccacgacgatggacagcgacccctcctcctcctcctcctcctcctccggcgagtagaccagcgcaccggcgaagcggtagaacgccgggagcaacgcctcgagggagtccctgagtgcgtggacaacgtctccgaatggtggtgggggcggacgagcaggagcgcgacccagtacgcgtcgaatggggagagcagcacgcggcagcagccgccgccatctccatgcgtcgggagcgcgacggaggtgacgctcctcgtgcacaccgacggcggcggctgcggcatctcagcgacggcgaactcctccgccgtgttccgaatctcgccaaagcttgtggggtggtttgacccccactatacgccgtcgccgcattgtccgccgtcgccgctccgtccatcgcccgccgtcaccgccgccgttccggacgccgctctcgcatgaagagaaagagggacagatagagaagggaggagagggaggaggaagaagggataagggatgatgatacgtgggaccaataggtcccacgattttttttttgtgaatgacaaatgggcccgcatatatttttttatgttaattccacatcagcgctacgtcaatgccacgtggtacaaagactagttcaacactgccacgtgtgcgctacgtcagcgaaaccaccctccaaaaccaccgagagagtcaaattgcaccggttttgtaagttcgggggtcaagatttctggtattgcggttgagggatacgatttagattcggcggtcagttgagggagtcaaagtgatcttattccgctctctgatgcgtccgaagagaggcccacctgagttgggcctagtgggcttagttgcttgcgagacttagaagtggg

SEQ ID NO: 13155 - DNA, 1501 bp, Oryza sativa
gcagcttaggagtaaaaacggagcggatattatccgatccgatccgctccgaatccgtccgatgtgaggatatggtaagggtttttagatattcggccagatgcggatgtagatgtggattttgtcatgcggatgcggatgtggtatgaacgatatccgacggatgcggattatccgatattttaatcggattatccgatgtactgtttggcggataatccgcgaatttcaggccacacaacaactttcaggcccacctagctagcccaatagcccaacccggcctaacctaatcctctcctcatcccccagatccgtctctggctctctctctctgtgccgtccctcagccgtcagttgaggagtcggagagagtagcacggcggcacagcgcgacggcgaccctacgcggtggccactcctccccaacacgcgccaggccgatcctcctccccaacacgcgccagccgctcctcctcgtctagcaccgccgctcactgctgtgtgttttgtgctgtacgcctgtactactactgatgtatgcctgtatgcagtatgctgcgtgtagcactacataggggtgctctactgctctatgcttgctgttgctgtatgcctgtatggcttgcctcatgccgatgacttttatttttacattttaagcaacgtagtgaccggtgaactattgaattgaacacttatatatatattatgtttttggtggatcatggatgtatcttggattattttgactagtgaactattgaaatactattactattgaactgaacgcagtaaactaatgatgttttgccatcgtattggggctaattatattgccgccctcttgttgaatggattgaatacaaacttgacatccgataactttttgtccgtttccgaaccgagtctgcaccgaatccgacgtccgaaataatccgctccgcatccgcatccacacgtcatccgcacccactccacatccgcttaaaaaatatggtttaggctatggtatagctattatccgtccgaatctgctccgttttcacccctagacagcggcagtagccaagggggtggcttcggtgacaatgacaataacctccaaggtcgtcggggatgacgaagaccaatgtgtatgtgttgatgtttgtatgttgaaaatgctgtgagaaattaatctagatgtttggacttttggatgctgtgagaaattgatgtttgcatgttgatgtgaatcaggattggatttgaatctgatctcttgatgtggatttaaaaattgaaaatgcagcaatgtttttgaatgtggatttttttttgctagcggttagaaggcaactgcatgtggttattttcaatcttttttgcctcaaaatcaattatcgctggcagctagcttaccacagctgccagcaaaattctcttattgttggcggctgtcgatcaagagcgtatttccgctatggacctagctggtgagattcttcggaagagaatg

SEQ ID NO: 13156 - DNA, 1501 bp, Oryza sativa
tttgcaagcatttctgcagtgcaagatgcagaggccgggatgtttattattccattatctaaaaaaaaccatttctggcaaggtatacaaattaactacaaacccaactacatcctactcaggcattgtttagttcacaaaacaaaattttttcacccatcacatcgaatgtttggacacatgtatagagtattaaatgtggacaaaataaaaaaaccaattacacaatttgcgtgtaaattgcaagacaaatcttttaagcctaattgcgccatgatttgacaatgtggtgctacagtaaacatttgctaatgacgggttaattaggcttaataaattcgtctcgcagtttcctggtgaaatctgtaatttgttttgttattagactacgtttaataattcaaatgtctatccgtatatccgatgtgacaactaaacccaaaatttttccccaactaaacaaggcctcaaagaggacaaatccaaactgcatgattttcgtactatcctagagtaaattacagatagccgcaaatcaaaataacaattaattgtactagcctacatgatttaccccccttttcttttcgtctcatcgagagaagccagatccaaacaagcgtcaatagcatggcagtgaattaattaatggaggaaaattagtagggttttgggtacacctgggaatgtggccttccgatccttccgctagtccactgctaggttgcccccgccgacgaggagatggccggagaccagagttggccggagacggggagggaaagccttctgggagggaaagtcggaaaccccggtggcatgatagcgccggccggagcaacggaagctccaggagagtgatgcccgggagtagaacggaatcactcctctccaccgtctcctccgcatcgccgcccgtcggtcgccgccgccgccgcggcggccgcctcaccggcagaggcacattgctgcgagcccagcgatgaaggcggcggcagaaggcccacgttgccgggccaactcaggcccatatattgattggatgggcccacgcatattcgtcggctgcactctcataggccttaattacggcccgtgattggaagaccataaatttcctaaggaaaaagtacacccgaggtccctcaacttgtcatcgaattacaaaatcatctcccaaccgcaaaaccagatatatgacatcctcaacttataaaaccattcactttacgtccttcggtggttttgacccaattttatccgacgtggcggctgagtctgggactcacatgggccccacatgtcatgatgccacgtcagcatcttctctcgctttcccctcctctccctttctcatctctctctctctcactttctcctcttagggagcacggccggccggcaggggaggagcgcgacgggcgcgcgacggccagcgagggaggagcgcggctgagaggagggttggcgcgatgggtggcggtcggcgacgcggagcacg

SEQ ID NO: 13157 - DNA, 1501 bp, Oryza sativa
cctgacaaaggcgatgaaggaggtcggcaagcagcttactggaatggggtaggaagaggaaggccggtgtggtagcggtggggaagtagagaccattggcccgtcagcaaacgactcgggcttcctcctctgcaacttcgtcggccgctgcacggtcgctgcctcgtagctccttggctactcggacaacttcctttgtcgctccgacccgttgctctcccacctccatgccatcatcacaacagttctcttctggctctccaacacggccgtaccgccccgcaggcctcgcccacctccacgcgctccacgccgcgcttgccaacctgctcctcctcccgaagaagcgtgtcgcccaaaccactagctcatctaccgcctcctcccttctcgacggcttcttcgtcttcgccgacatgtatggcaccttccaggaggccatcctcaacctcaggaagcacgcccccaacgtctagaacatgttgcgaaggcacgacgctacgaggctctcctccgcgcgacgttggggggcccgcgcaggtcgtcgtcatcatcatcgccgccggagtgcagctaggagatgcggagaagccaagtgatgtccacaagcgcggtgtcggggacatttaactttttgccacttttaagatgtaacaattaattatttgtcactcgctgtctataacatatgagcccttatgtgtctatgaaatgtgggttcagtgacaaatcttttatcaccacatgtaagagtggtaaataattaattattccgcagtgtcaagcagtgccagccagggtgcgtggaagaagatggagagaagagaggagatgatgacatgtgggccatatttgcttttgccatgtaagcgtgtacttagcgtgagtgaaccgagtcaatttgttacgttagcgaattcatactgccgaaggatcttatttaaacggttttgcaaagatctgggatgcattatatatggtattcgggttcagcgacaattctgaaactcgacgacaataggagggatgtaaagtagacttttacccattatgtgcagcctgtttagttgtcggaagtccaaacgggatggaataagttcactttgggtccctttatttgtcgcccagtccgattttcgtcccttgaccgcaaaaccgggtacaaaaccgggtacgacccgtccctcaacttaggaaaaccgggcaaacgagatccctcggtggttttgaaggcggttttggcttacgtggcgcttacgtaacttattcgacttggtcttcgtcccacgtggcattgacgtggcgcttacgtggcaattatatctcggaaaaataataaaaagcgtggtcccacatgtcagctgtacacaaaaatattttttaaatggtggggcccacgtgggccccgcatgtcaacctcacacctctcttattccctctcccttctctcttcttcctttccctcctctctctctcccctacccgggctgccgacggcgtg

SEQ ID NO: 13158 - DNA, 1501 bp, Oryza sativa
catcgaattcatgaacaatttgatggctcgatttggttgccgggatcgatttagatgttaggacttggtacccctagtgtaaatttgaacttaggggcggagggagtacttgggtatcgtagcaaagcactataacagattagacctttctattctgaaacagacatgtagagtagagtagatgaggtagcacgtttctttccttcatttccgccaagtttgatcgtgccgtttctgttcatttcaatttttcaaggatctggtactatttgaggtaattaaggacccggtgatggcatcgttttcatccatggcaatgcttttgtggaggttggtaaccaaatcttgacagagaccttgcagttcaggctttgagagtcgaaagccatggcactggaacgcatcatcggggtaattagcaagcacgtcggtccatgatgatacgttccgacgaatcattgccgacagaaaggcacgctgaactccaaaccccaacaaactttctccatgcgaccatgcctactgcatcttatgttggtcccatcaatggcatggcatggcagatggcacatctagctagtagttaaatcgtccgctcgcgcagttgcgccggcggatgatacaagaagcccacgcagcaatatgctgatctgtttgccactcacgcttgaatgaatactagtagtagcagtactagtagctttgctattactgtagatctgtgcgtacagccgcagcacggtggtagcaccatagtagtagcaccgtaccggcacgacggacgagcagtgaataagctcatttatgcatccgtggtgtacccatggtttccctgtaggccacagtactacgacctatacggacgcaacgcgaaacgggcaacgacaccacgtccgcggccgtcggttgacgtgaacagcggcacgatgcgtgagcggttgacgtgaacagcggctgcggctgcgcagccagcgaattgaagagaaaaaattcctccccaaccgcgcgtcccatgccgtaccccacccttcgctgcgcctgcgccgcgcacttcctgcccacctcaacatgccggcagattggcagtgtggcaccaaaccacgtcgcgcgcgcgcgcgctgctgctcccgatcgcgttcgcgttcgcgtttcggtttgaccgcgcgtctcgcctagatttccacgggtaaggtgaaggtaaacgccgcgcgcgccacgcaccaaacacccagaagaacgtggtttctggccaaccgacgtcaaggaagaaagggctcatggccgcgcggcagcaccacccgcacattaacgcacgccacccaccgccacctactcgccactcttttactcggcgcgccttgtctctctctctcagtacgaggggagtagtagtcagtagtcacagcagtagaagtagagcgccggtgccgtcgccaccgcggcgggggtaatgcatgcgctcgcactcgcactgcgcctgctcctccagctgtcgcgatga

SEQ ID NO: 13159 - DNA, 1501 bp, Oryza sativa
cagaaatctcttagcatagccttcttaaaatagaaaactaagcattttctatctagcacgattctactttcttctaactcgcggttaggagtgtttctgcgacaaccatcaagtataactcgacaaaaatcaccggccatggagctcatcgaagtacgtatcctcctggaatcgaaatcccacaagctgacaacgcaaacaaagtcgcacgtggaactctcactccagaacaacagtgctgtccccgtcacaataatctcgccgtctacttccaaagtcacgaaagctgctgcagtatcaaccactaacacaagagttgcaatcacaattctctccaaatgtaatgtgacggttacgatttcaaatcagcaatcacacacaggtcgatcggtcacgccccctgtcgtggtaatgccttgatggcggcgaggaaaaagatttgagagaatgtggtgtgcagtgcaggcagcgacgacgaacgggacatggcacgaggcgctagtggtggtgtggtgcccccgcgtgacgccgcaggataaggctctcggccccatcgcggcatcaatcatgcattcacgctgctactggcctactgctattgctattgctattgctagccgcttgctgattcgtggcgcaccgcttccgaccgcgaccacatcaggcaaggttaattgcgtgcatgattgctggaaaaacaacacagcaaacggcatacagtagcaagatcacacacgttcgtttttgtcgtcgtcgcggtcgcggtgaattgttcagaggagagccagagtttgttcaggggaggacgtgtggagcacggatggatcagcgcgtcgttttcaacggaggaatgattgagagtacggcaccgtacgggtgctccttcgaggaaggtgcaaagcacgcatgttcagggttactactagctcgttgcctgtcgctgtggccacggtggtggacgacggcgagattttccctactccagcgtaaagaaaaccgaaaggagcgatctccaagtggcaacacgtaaaatctcgccccacatttggatttatccatccgaggaggagccacggttaaatgccgcgttcgcgcgtgctcgttacgtacgcgtgttgctttcgagtttgattaatcgttttttttgccggggtggtggtgggattgggatagagttcgggccactgcctgtgaaaactgtgaatcgcgtcgcgttgcacacggccaaaacgatagcgcgcgcacgcacgcacgcatccgtgccgcacgccgcgcgccgcctacgtctcgtcccacgcggttcccgaccggaccccacaccacacctgccaccaacgcatctccgccttatttgaggcgcgcgcacggggcgcccaagccatccagcctgcgtgcgacctaccaacgcgcgcactcctcgatcccatcatcggaaggcggcgaggcgcgcggtggaggattgatctgcgggagggattgatggcggaggcggaggcggagg

SEQ ID NO: 13160 - DNA, 583 bp, Oryza sativa
aaccagatacaacgggcccttcaactatcaaaaccggtgcaaacaaagtccctcggcggtttagatggtggttttggctgacgtggcacctacgtggctaatttgactcggtcttcatctaacgtggaattgacgtggcgcttacttcgcaattcgaaccggaaaaataataaaacatgtagggcccacgtgtcactctcacatacaaaataataaaaaatggtgggacccacgtgggccccacatgtcatcttcacacctcccttcttccctcttccctctcccccctctctctcatcttcttccctctccctctcctcatctcctcttctgcggaactacagtaacatgccgttgggggcatttatacccgttggatcaagttttggatgcacgagattaaatgctacagtaacaataaaaataattagtatattttttattgtggctacagtgttgttcactgtagcaacgagatggcactgtagctcccctcacgtttcactgtgcgcctctgccgttttcccctcaacggcagaggatgggaacccctcttctgcaggcgagcgcagcggaggagcga

SEQ ID NO: 13161 - DNA, 1501 bp, Oryza sativa
gaaagcgccgctgatggagcttgcttctccttgctggcggcatcatgctgctgtcgaagttcgtcgacctcagcgcgcaagtccttgatcgcggcttcaacttggggtcgccatccactaaccccttcgtccaacttcgccaccgccacctgcatctccgcctgcttgttgttcaacgccaccagcgactcctggatgtcgccgagcaacttgccgaaatcgagattctgcttctccattgcctcaacctgcgattgcaaacgagaagtgtaccttggtttctccaggatcgctgctctgataccaaatgtcacggcacttgtggaattcacgccgagacgaagacgaatccgtgggaaatcgaagaggaatttgtgaattgagaagaggaattgaggaagaacagagaaagaacagaagaagcagtagaacagagagagagagatttgaattgaattgaggattttgttgtttctacaatgttcgattccttttctctctactctgccgatcttatatagcgatgtgccaaaagatctcgctccctctctggcagtggcccggtcgacagctaccgggtccactcattcgacacgtacttgctcgtgggccgccgatctcgcatggatcgcctgggttgggcttcatcatgtattgtcgctgatgctatgggcgctggcatgacattttccaatacccatcaaaccctaattattaaaagtacatacttgtctgaatatatttcttacgctgaacagttatttatgatggagaagaggttgacatcataaaaaaaatatatttatcatactgatgttcagtttgaaccagtatatttgtggaaatgatttctgtaacttagcaggagaattgccaattaattaattacaagagagaagagttggcattcagatagagaaataaaataaaaatgaaatttctttggcttgtcttaagctgccaatgcttctgctaatatgtaggtccacattccgtctttggatttggcgatcgaagaacaacgttgaagctagacatctcgatggcagaaatcttttgtgtttatctttttctttccaaaagtccgaagttcagcataccaaaggttgaaaaaactctttggtttgaaaaaacaatgcccccctacgtactatccagtccagatcgttgtcaaaatgatcagaaatggacatgttataattcctgatacttcctaaccctaagcgcgattcgtgaggtagcagtagtgctgggcttctggccatcgggttatgagagagttccatccattgcttcttaatttgattatatgtggtacgagatggtacagaagcacactatggaagcacatgcaagaccatatatatgctgagtttaattctatcaagaattatgtgaaccaaacaaggcattagatatttgtcctctggtgtatgtggaggagagtcaaatcatacaaaactgacatattcactccaagttgatagtacgaggacacaat

SEQ ID NO: 13162 - DNA, 1501 bp, Oryza sativa
ccgagcacggaggagaacttcctccccttctccacatcaatgccacctaatggggaggggaggggggcggttggaagatctagcacctatgggccattactatccaacaccaataagattgtatgtagtagtgtgtaccctgacccatctattccttgttgatagcaacacctcatggatgccctgtcaatatatctatgtatatattataatagaaaatagttgtcaattttttttaattgtgtcctcgtactatcaacttggagtgaatatgtcagttttgtatgatttgactctcctccacatacaccagaggacaaatatctaatgccttgtttggttcacataattcttgatagaattaaactcagcatatatatggtcttgcatgtgcttccatagtgtgcttctgtaccatctcgtaccacatataatcaaattaagaagcaatggatggaactctctcataacccgatggccagaagcccagcactactgctacctcacgaatcgcgcttagggttaggaagtatcaggaattataacatgtccatttctgatcattttgacaacgatctggactggatagtacgtaggggggcattgttttttcaaaccaaagagttttttcaacctttggtatgctgaacttcggacttttggaaagaaaaagataaacacaaaagatttctgccatcgagatgtctagcttcaacgttgttcttcgatcgccaaatccaaagacggaatgtggacctacatattagcagaagcattggcagcttaagacaagccaaagaaatttcatttttattttatttctctatctgaatgccaactcttctctcttgtaattaattaattggcaattctcctgctaagttacagaaatcatttccacaaatatactggttcaaactgaacatcagtatgataaatatattttttttatgatgtcaacctcttctccatcataaataactgttcagcgtaagaaatatattcagacaagtatgtacttttaataattagggtttgatgggtattggaaaatgtcatgccagcgcccatagcatcagcgacaatacatgatgaagcccaacccaggcgatccatgcgagatcggcggcccacgagcaagtacgtgtcgaatgagtggacccggtagctgtcgaccgggccactgccagagagggagcgagatcttttggcacatcgctatataagatcggcagagtagagagaaaaggaatcgaacattgtagaaacaacaaaatcctcaattcaattcaaatctctctctctctgttctactgcttcttctgttctttctctgttcttcctcaattcctcttctcaattcacaaattcctcttcgatttcccacggattcgtcttcgtctcggcgtgaattccacaagtgccgtgacatttggtatcagagcagcgatcctggagaaaccaaggtacacttctcgtttgcaatcgcaggttgaggcaa

SEQ ID NO: 13163 - DNA, 856 bp, Oryza sativa
aagctgaaactgtttagctgagctcaagctccagctccaaaagagatggaggtggaggtggaggtggaggtggagctgtgctaaacaggcccctagtgccaccctactccaccttcggcttccctactccaccttcggcttgacaagacccgccaagccaccaccgtagctcggagtcactgcatgccgccgaggactctaccaagcccgctgcttcctctgctgcaagctgctgctcctcaccgtagccatggagctatggagtattgtccttcatgtctgtcattctgagaccggaggaaggaggggataatgagcttctgatttttctttattttcttttttttctggctgtaccaccacgtcaatgtcatgttgttatatacttatatctcatgactcaacatggattgactagtcaacacgtcacaaacacgtcacatagtacgaaaccactctaagaaccatcaaaggacgtacattgatcagatattgatagttgagagggcattcatatctgattttatggtggaggattacgaattagattcatctactagttaagagagtcaaaatagatttttatttccttttgcttctcattgttgacctgttttttgctcagaaaagttcacttaccatccctcatctttatttcgagtttaatttgcttggcatgccttaatctcaataccaaaaatctatacacctaaattatacaaaaccgaacttgggtctcgtagtagtatagatcccaatttcccttgttttctcttacatgacagatgttcaggcccatttgtcatcctcaaaagagaaggagaccttgacgtccaaagggtgccgcctaggggaa

SEQ ID NO: 13164 - DNA, 1501 bp, Oryza sativa
tacttggtctgtgccttgggggatactgttgacaaccactgcagcagctaagctggttccatcgacaattcttgctcccaactttgggtatttcagcagatattgttctccacttttattcagggtatgtgccttatattgaagatattgtatgtcaattaccagttcaaccatgcatgagtacatacttccctaatttctacatattgtattctcatgaaatgtacagaatttattagttctgttggactactgtcaacggactctttgctacttaatttttttattttcctacctttatgactaaaccttttccctgaagataaacaattattaagcactaactgttttatcttgactaaaatttggcagtacatgtggacatatagctaacatctgaattctgaagtatggatgataatgtttcaacttgctctgaattcattaggaaatgagctacctgattcaggagtccaaggcttacaactttagccccattcttgtcagcttcacataccgccttttcgataagatcattgatagcttccttctcccaatccaatccatactgcacaaaacaaaatgtttctaacctgattatcaatttatcatgcacaccatctgtgaatcatgcactgaacatggttactcttacatggaaactgtatcttggtatggcccatgactgcatcctgatcttcttcatgacattcctctcaacagtgaatgaagaaccgtacgtccatgtcagcaccatggagagccatgacagaggccacatcatcctcatgtaccacctggaaacgtagggcctggacgcaaattcggcgaaaccgggcctcatgtggtagatggaatgcagggtggtcaggtgtgtaaggtgaaccacatccactgcttcttcttcctcattgtttttcagtgagttctcatacagagtgtctgatgacttgtccatggtgttgtagatataatcgtagaacggcatgaaaagggagtagtttgtccgaaactgagtgtggtgcagagaatgaaacctaatatatcacataagttcagattattataacagtgaaaacagcatgtatgatcaagttatttattttgcagagtgacatgcacatcatcttcttttatttggctttttcaataactatagaccatgtgcatcctagctatgcagatatcaggagtggttttagagtatattgtatccaagatcaataaagcctcctttatcttaaaagaaatactgaaaaccgtaaaatttctccaatataaaatatggtacttcccctatgctttcttaaaaactgtaaagttactcttttacatactccctccatcccaaaatatttgatgccattgacttttttaaaaatatttgaccgttcgtcttattcaaaaatttaaataattattaattctttttctatcatttgatttattgttaaatatacttttatgtatacatatagttttacacatttcacaaaagttt

SEQ ID NO: 13165 - DNA, 1501 bp, Oryza sativa
ctggaactctgacaaaatgacaatcaagttttccctgataacttctttcctgtagatcaccatgcaccatggtgtgacgagtcaatcttatcggcagttaacaacatatataagagaaaagatcgtgatgacagctgacagcttatatcctcgggcctcatttgttggctataagatgagattataaacaaaaacaatttattagcaataaaaaaattgtagttaaaacttttacaatatactccctccgtactcgtaaaggaaattgtttaggacagtgtttaagtcaaacattgggaatataaattatgaataactcttaagttgttgagtttgaaaatgtaaaaattatatgaatagatttgtattgaaaaatattttcataaaagtatacatatatcacttttcaataatatttttatagaaagaaggagtcaaagttgcattttggagatcgtgtcgctgtccaaaatgattttctttacaaaaatggagggagtatatatttccagtgattaaaaaccaacggtaaaaaggacaccaagttaattaacttcgaaataaaatttgaaattcaaaatttgacaacggttgacttcatataggacaaacgatggactctggccactcatgtgcacgtgacgatattatagctgctaactaatttccacatcagattttcatttcttcgcaggaaaagatagatggaagcaacttttctgaacgttcttctcaaccgtcgactattctgtcgtcttctctccgattgactctctgcagcagctagcttccagaattgctgcaactttcactgtttcacagccaactatcggccacctctctggctgatcgatcgacaatggcgacgacgagatcgcaatgtattgtcgcacgcgcgtggctgcaactcgtttggaattccggcgtgcggctaagatgcgcgacagtgacaaagctcagctgcagcttaagagcaagtttaatagtatagccaattactagcttcaaatcaactatagtcgacttaattagcaatctgtacaatagttatccataaacgtatactacactattaatacatggtctcacctgtcatacacacattatttcttgtagtccgtgcttatagctgctgtttttcttcttttctttcatctctcctcgatatgtgtttatagttggcttagagcaagttcaatagtatagccaactactagctccaatttatctgtagccaatctaatagctcattcatacaatagttacatactacactattaatagttggtcccacctgtcatacacactgcgtcttggaatccgtgctgcagctggctacaaatctgtagccagctgcccttctctctcatcatttatctacttaaaatatgtttgcagctggcttatagcctgctattgtacctgctcttatatagtctactattctagctgctctaattcactcgctgcacagtagaagcaaggaagtcagccgcacgcg

SEQ ID NO: 13166 - DNA, 1227 bp, Oryza sativa
gagacacattcagtgaaaaagaattggaaatggtaatattcttcttattcaatgccccatatgcaatatggatttagagcgagtacattatctaaccaagaattttgagcaatcttgttcaattatgaacaattgtgagcaagcatatttgctacactggagaaaaatgcagatgtgctaaataactggagtagtagttgtgctttctagtaggctagtagtaagtacaagtgctctagaatctgttatgcagttgatagtcaaacatttgactgatgacaaggacaagatgtcatatccataacacaccctagcgttctcagtaaatattgtgttagtcaaaaactcaataatgcaataattccagagtctcttgcagttcacagtcaaaattctcagattgattccattgcctcttctaatgccagccacatatgaataactgatgtagaaaatatatacatcaaagtgtaaaggccttaccttcggaatcaggtgtagcaaaatattgtatataccccagtaataacagcccaaaagctattagtttcatacttccttgaaaattattatcaatttgtttaattttcaggaacagaagcactcttgaatacactgtgtttgctttcttgatggaaaatagaagcactttggatttgaggtctgcactaaatagctgcatcaccgaagaataaaataaattgtgtgagactcacaaggcttaaagagtaaactgagaatacagatattgaggaatcttcataaattcctgccaaaattgaaaggaagtgctttaacccaaacaaggcaagaatctccttaaaagaacattcagactgtttgggattctttctagagataattattttatttttgttgcaaaccatttttgatttcttgcatataaaaaacatgtgatcagtcacctgactgtatgagtcttgcagcggtcactaaacctaaccggatttctatagttacactgtaatcgattgcctgtacaaatatggggtggtccaaaagaccttaaactgtctaaaaggttgtccttaaatatgaaaagtatgttactattgaaataaaggttgtcttaaagaaataaatgtaaattctaaaccattactggagaagttagaagctcaaaaaaaaagcccaaaatgatttaggggaataaactgagcaaaaggaaaaacagagacagacaagctgtcctcttctctttgcagt

SEQ ID NO: 13167 - DNA, 1501 bp, Oryza sativa
taagtagcagcaaggaaaggaaatgatggtaccatatccaagtcatatgctaaagaaagacaataggacaataccaagtgacgagagtaacttatgacaggcagcaatggcatatctagtgccaaaaccattggagatggaaaaggagataaaggaaaattaatacgataaaatcggcaatgatacgtagaaagaggaggaggagggggagggaagcgatagtcaggaggacaggagagggtaatgatgacaaaccgatgagaagcattggcaacaagaatggcttgaaaattccctatttactgtgtaacttttcccctcgcacttgtgtcacccccatgtgggccctagccgcctctagtgcccccaactcatccacctctggcctcgccaccaccagagcaagccgttagtaagttgcgtcgtgagctatgaaggaagtaggggggaaaaccctagaggcgtgggctagaatgtggtgcaatgcttggggggtatagatgaagctagtgcgacgtggcagatagggtggcacagatagaggttgtgcactggtggaggttgtggcaatgaggatctagccaatgcaactggtttgggacaccgggagagcgaacttggtgatggtcagatccactgtgtggcagtgcatggccaaggtgccatgatatgacgagagggtggcgatgatgcgggctagaggtatcgtaactgatgatggcacacagggaggtggcgatgactacgtgtagttggaccctcccagcatggtggtgcgactcaccccttcttgtcttggtgagattggctggcaagccattgtagcacgggagccaagaggcgcaagccttgacctaggaggtgggcgggcgggcgatggcatgggacaacacaataagaggcaacaacatcatggggtgatgatgaagcgattagtttgcctaaggcggcaacaacgtgggaagtgagtttggcgtagggtggcttgcaaatgtcaagccctacctaatggtcagttggcagcgtggcgttggcacgatggttccacgctaaaggtgctttgacatgagagggtagaaggtttatggcaaaagtctagcctattcgaggctaacaatggcgacacttatggacgttgtaactttggtgagggcatcacacctctggatacatatgaggggggggatcaggaagcacttggagatgctagaagatggaggccaaattcatatcaagttagagtcaacccgaaatccaggaccagcccacactaaatcattgcccagagctcatccgaactctttttttgacattttacatatgtattgaaagctaacgggactaccttcctaaagggtctggtctcacggcaaaaacatcttctaagtcaatgggaaatgttgaacaagagagcctccaaaatctatccgggtgttgcgccattgtctttaaacccattgggccatgtattgtgttggagtccatttgggacgcatccagg

SEQ ID NO: 13168 - DNA, 1501 bp, Oryza sativa
tctgtgcttttgcttttgtgaactagatgtgtgcaatgtacatttgttgacccttctgtatatccttgatttgcatgttctgtgcactgattgattttgtagtaatgctttgatgtcagtttctaaatctatgcaagaaaatgctatatgctatttaggtggatgtttatgcactgattcaggatgtttttttttctagaaatccacaaatgctatatgccatttgcattttagtttggtatttttaatctttcaatgacaaccttacatgaggaaataacacaagttattgaagatttctgtactagaatgttttttatagtagtcaatttttgtctcttcattttgcatgctcaggtttagtattcagaaggagaagagtattgttaatacatttgttcagaaggagaagagtatagtattcctagtcatcactatactctgatatatgacatgagtttgtgctacacatttgacactactctatgaaaataattatttctactatatgaaagtaatattattttcatatgacatggtgcatttaacttgtatgttttattctgttttgttatatattttagtccataatacttatgttttgagatcttttttctctccttgcagtcatgggtcatagaaaaagatcaaaagttgatatttctagtgaatctaacagtgacaatgattgtagtttgagttctgataatcatgatagtgatgttcatttatctaatcatgatgaaagttctgataatcatgtaagttcatttgtcatgttcatttatcatggaagtttattttttatttcaatattttttttgaatcttcttgtttttttattaaggaccaacattttgaggaaaatgatcctttgcttcatttaactaaagaagagcttatgaagaaattgaaaataaagcttggtaaaaggccatttacagatgaccataaaaagaaggtatgattaatgcatatttagatttttgtaatttacattatttttttaatatgatatttttttattttcagagacataaagttgaatcagactcaattatcgatgatgcattgttagagattcacaatgatctagttctccattctttgaaaatgaaattaagcatgcttggtgaacagtctaaaaataaggtaattttattaccttattacattggtgaataattttttctttagtttttttaatttcttttctttaaatttttttggcagagaaaaacctttgagaaagataaccaacaagggtgtgttctgactgattgcaaattattgttttatatgatcatgatctttaattttttatagtttttgatatgctatgggataagcttgacacttttatatttacttgctgaacatttagctgtgattgaatgcttgtgcaagcatgtgctgctccatgttagaatgtctgcatactttttttttcttgcaaaattaactgtaactttaaatattttttcatgtaatttttttcagt

SEQ ID NO: 13169 - DNA, 1501 bp, Oryza sativa
tcaggtcctgatacttaactcatgtatcatgcaattcttaccacgtagaagatgattctaccacactccacagccagccatgaccaaattaacaagttctttgcacccccgtcttgtctcttttctcccccaaagtagcagatggataggatgaaggcccggactcacagcgggatcgacggccggcgacgaaggcgccgaccggagagggcccgcaacggagttggggcgccggcggagggcggaccggccggccacgcagatggagccaagggtgggcgttaacggcggcgtggtggttggcaggcaacggtgctggagctcccggcggcaaatccggcgaccacgtcgccgatggccacgtcgccgatggccacgtcgccggtgatggagttggggcaccggcggagagcgcaccggccggccacgcggatggagcaccaggcggcaatccaacgaccatgttgccggcggccgcgtctccggtggccacgtcctcttctccccgagcgggtcttattcccagcctgcgccggagtcgccgatggccaccttctcacggcttaggcgccgatggccacctcctcctcacggcttaggtgctcagcctcgttcctatttggatgggaaaggtggacgaagggtatcccgtccaacggtatactggtatatagcatttccgtaacagaaaaagtccactttgattcccattaaaataggccgaatctaattcgtaccccacaatatatttttgcgtgtgtaaatgacagatggatctcacagatattcttttaattctaatatcacataagcgccacgtgagacgaacaccatgtcaacactgccacattagcgtcacgtcagcaaaaccgctgagaaagtcaaattgcactagttttaatagtttgaggagtcgtcatatcctgttttgtggttgaggggtataaattagattcgacctatatttttaaggtttgacttaaatattgtactaaacgatctctttacgagtatggagggagtattaaacaagtcgagatgcattttctagccacgacaacttactcatcttttattaaaatccatcttcggagagcatattcttgcttgctacctgagctcctcgccgcatatactctctctctctctctctctctgcttctggatgaatgacatgattcggcgtaacgtgactgtcccattatcttgtgtccactttatttatatttacgctaacaatcagcgtaacgcaacgaaataaagcgccgcgtctttactcttttgtggacagtgacccatcaatcaatgcacaagcagcagtgacgtactgacgttaatcgcagctctacccatcatttgcagccaccagcatctgctccggcacgcttctgccaccgccgtcgccggagatccgtcacgcgtccgactccgattgactgaaccgtcggagcacgtacgccgggatgcggtgctggcgtcgcctggcggcggccggcgcact

SEQ ID NO: 13170 - DNA, 1501 bp, Oryza sativa
gggcaacggctttatcttttgtatagcgtgattcattatagtgcgccagactgagaagtggcgagaagtccatgggggtcgctggggagtccatgccttgtttataagggggtgattatgatccaggaaaggtgcgctgtaatgggttatgttgtgcgaggggtattgtcacgactcctttccgaggtaccgtggtggtattgaggcacatggtgacatgatgtggggttgtgtcttgtgggtacagtggtacacctctgatcagagtttaaactattcgaatagccgtacccgcggttatgggtgagttgagcaatgtttttcgtgattagtctcacactactcatcaatgttaataatgtgataattaatttgattcctggtttggaatgggtaattcctggtttggagatttaatttgttcaactggggttggttgttcaaatgtggttgggcctatgcaacatgggtgtgttgtatggtgttatttaatattgattaattattcaactgttttactattctcttaaatatttattaaatgctgttttctgcaaatgagctatattatgccatcctttgttatcctgtgcacatgcatatttgctgtgtgacttgttgagtatgtcatatgctcattcttgcaatattcattcatcagaagaggagtatctcagtgaaagtgatgatctggaggattaggcttgttcttggttaagatgcctgtggagtggagtagccatagctgttccgtagtttgttatagttttatttttccgctgcgtagaatgtttttttttgagaggaactatctacctctgtaatctttttatttgcgaatattaaatagtactctattattaatttgtcattgtgtgcctcggttaattcctggacgagggtttaacacacatgtaagcgtttggaattttggatagaaattccgggcgtgacaagttggtattagagccaccttgaccttaggataagccaaatggtaaaccttaagtagccttcaaaatattttgaaaaaaatagaactgctcttctctattctcttataaattaattaagttggcagcacatgcaaggttatgcacaaaatttatttaattcaatttcttttcttttaaaagcaaaaagttattcttctcaaaatgtttttttttcacttcaccaaatcttattgattagtcggcactgtacatttattatggtatcgatacaatcatgatagcactagtactactcatctttcttatggtgacactgtaccgtgcttataatagatcataagtattttagttttatttttgttatttgtcaaaaaaaatttatttgtccctgtccaaaaagttaaattctaaaaatatatttataaaatagctttgtatgtgtcttttctattattttctacctttttggtcaaaaatcagttaagtctagatggtgcagctaacttaaagaatgctttaattcttctcttctatgtttctttaga

SEQ ID NO: 13171 - DNA, 766 bp, Oryza sativa
ttttgatctatcgatattgacaacaccgtcgattacaccgcaaatcgttaggtgatttttgttggccaagagaaaaagcatcaacaaacagcgagtgaatgaaccaatggcttttcttttcttttttcatggtgcattgtccgagaaaattgacatttagccacatgtaaggatgggtttcgctgtaatgccattccgccaagttgtttcgctaaaatgctatcgccacgctcgcacaacacgctgcttcgccgtttttccaatttcaccggattaacacaccgaatcgcgagtgttgtgaccaatgtgcccctgggtcattctttagatcagtgagacaaaggggatcgagatgcgccggctcttgctcacggcggtgccctagatcgatcttgtcagcatcgccattccacctgtcgcgatccccctctcgccctcacccagctatagctcacggcggtgctgccatcgccgttccaccccccgccgccgctgctgcagtccccttgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 13172 - DNA, 1501 bp, Oryza sativa
ggaatcagatgattttttggggcgcttcttttttttttttgccttttttacgtttttttttgccgcgtcggaatcggtctttttttgccgcttttttttttctcgccgccctttttttcacccttcctattttttttcgcgctggcctttttttttttaccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttttcacagaatcgaattatttttttcgccggacagttacggtttttttggcccggtttttttcctcgctcgccctgttttggtttttttcctcgctcgcccggtttttttttcgccagtttttttgacggacgatggaagcatctcttattttttaagtagtagagatatgatattttctattttgtttttatggctaagaggatttggttaatctttgttgttttgcactgaaaaatggttgtgtttctccacgaaagcgaggaggttatcctttgctagtttgctcggaaactactcgtttgtcgtaacgtaattccgatatttctcgtcatgtaagtacgatatttctcttatttgctaatttgctcataaattagtcgtttgattccacgaaagtgaattaatcttgaaattttgatctatcgatattgacaacaccgtcgattacaccgcaaatcgttaggtgatttttgttggccaagagaaaaagcatcaacaaacagcgagtgaatgaaccaatggcttttcttttcttttttcatggtgcattgtccgagaaaattgacatttagccacatgtaaggatgggtttcgctgtaatgccattccgccaagttgtttcgctaaaatgctatcgccacgctcgcacaacacgctgcttcgccgtttttccaatttcaccggattaacacaccgaatcgcgagtgttgtgaccaatgtgcccctgggtcattctttagatcagtgagacaaaggggatcgagatgcgccggctcttgctcacggcggtgccctagatcgatcttgtcagcatcgccattccacctgtcgcgatccccctctcgccctcacccagctatagctcacggcggtgctgccatcgccgttccaccccccgccgccgctgctgcagtccccttgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 13173 - DNA, 1501 bp, Oryza sativa
gagggcgagagggggatcgcgacaggtggaatggcgatgctgacaagatcgatctagggcaccgccgtgagcaagagccggcgcatctcgatcccctttgtctcactgatctaaagaatgacccaggggcacattggtcacaacactcgcgattcggtgtgttaatccggtgaaattggaaaaacggcgaagcagcgtgttgtgcgagcgtggcgatagcattttagcgaaacaacttggcggaatggcattacagcgaaacccatccttacatgtggctaaatgtcaattttctcggacaatgcaccatgaaaaaagaaaagaaaagccattggttcattcactcgctgtttgttgatgctttttctcttggccaacaaaaatcacctaacgatttgcggtgtaatcgacggtgttgtcaatatcgatagatcaaaatttcaagattaattcactttcgtggaatcaaacgactaatttatgagcaaattagcaaataagagaaatatcgtacttacatgacgagaaatatcggaattacgttacgacaaacgagtagtttccgagcaaactagcaaaggataacctcctcgctttcgtggagaaacacaaccatttttcagtgcaaaacaacaaagattaaccaaatcctcttagccataaaaacaaaatagaaaatatcatatctctactacttaaaaaataagagatgcttccatcgtccgtcaaaaaaactggcgaaaaaaaaaccgggcgagcgaggaaaaaaaccaaaacagggcgagcgaggaaaaaaaccgggccaaaaaaaccgtaactgtccggcgaaaaaaataattcgattctgtgaaaaaaatacaaagtgtttccttcgtccgtgtaaaaaaagtccgactgtaaaaaaaaaaaaggccagcgcgaaaaaaaataggaagggtgaaaaaaagggcggcgagaaaaaaaaagcggcaaaaaaagaccgattccgacgcggcaaaaaaaacgtaaaaaaggtaaaaaaaaaaaggccagcgcgaaaaaaaataggaagggtgaaaaaaagggcggcgagaaaaaaaaaagcggcaaaaaaagaccgattccgacgcggcaaaaaaaaacgtaaaaaaggcaaaaaaaaaaaagaagcgccccaaaaaatcatctgattcctattcctatcgtaccataaaatttaaaaaaagggcagaaaaatgcaaaaaaaaaaagaggcgcagcaaaaaaaaaaagaagtcctatttctattcaacacggaaaaaaattaaccgcctttgaaaaccgattcgataccccaccatgacaaaaaaaacaagtttccatctaaaaaaggttcagcataacataaaaaaaatctgactatagaaaaaaaaatcaacactccaaattggctgtaaatcaaccgaacaggagttggtttaaatcgtaccaagtcctattcagcacacatcaggagatcaaaaccatatatctctatctcttc

SEQ ID NO: 13174 - DNA, 1501 bp, Oryza sativa
ccatgtgcgcgtacgaaaccacgtcgtagattaacgtgcaaatgaaaatagagctgatagccgccacggacccacggtgctaccaggcttgcacatccttgatccatcggcaaatttaacggatgaaattagtgccacttgtttatactggtggcaccacttggctaaaaactcgtgcccctttgacaagagaagaacgattggctctctgatacgtgaagttaacatcattgatcatccgtcgctatatatatgaagctgcccattcatattcctatcgacgatcaggagcgagcattgaagcatacgtatatccatctccagaaactcgatcaagcatactagctgagacagatcgagtcacctagctatttgagcaaatgggaggtatatattttagattattcattattttccttccttttttcaagcaattaattctctattttcgttgatttgatcgatcgatcgatcgtaatacggttgcgtggtgccgtggtgatgatgcagctgtcaatggtgtttgctacggtgttcttggcgacaacctcccgccgcggagcgaggtcgtgcagctgctcaagtcccaaggcatcggcgcgatgcgcatctactacccggacaaggaggccctcgacgcgctccgcggcagcggcatcgccatcatcgtcgacgtcggcgacagcggcgcggtggccaacctcgccagcaacccctccgccgccggcgactgggtccgggacaacgtcgaggcctactggccgagcgtcatcatccgctacatcaccgtcggcaacgagctccccgccggcgacatgggcctcatcctcccggccatgcagaacgtgcacaaggccctcgtgtccgccggcctctcgagcagcatcaaggtgtcgacggcgatcaagatggacgtggtcgccaacacgttccctccgtcgcacggcgtgttccgccccgacgtgcagcagttcatggctcccatcgcgcggttcctcgccaacaccgtgtcgccgctgctcgtcaacgtgtacccctacgtctcctacagggagaacccgcgcgacatcagcctcaactacgccacgttccagccgggcaccacggtgagggacagcgacagcggcctcacctacaccaacctcttcaacgccatggtggacgccgtgtacgccgcgctggagaaggccggcacgcccaacgtccgcatcgccgtgtcggagaccgggtggccgtcggcgggagggttcgcggcgacggcagagaacgcgatgaaccacaaccagggcgtgatcgacaacgtcaagaacgggacgccgaagcggcccgggccactggagacgtacgtgttcgccatgttcaacgagaaccagcagactggcgatgagaccaggaggcatttcggcctcttcaaccctgacaagacgccggcctacccgattacacgtatgccattatcacatttcgtatgatatatcgtcgtatatatatccgcgtatac

SEQ ID NO: 13175 - DNA, 1501 bp, Oryza sativa
attctagaaagaccattggggtaatgatatcctaaaatctagttcccatcactattttcatttgcaatcagtgaggacatatctgtctctgccttccatcaacaagatctctgataattttcaactacctctcaacactcaagcattgcaagagtttcaacttctggctataacgctagagagcgtcagctggtctgagcaagaggattcttggtcttacttttgggaaccaaagtttcaatcaaaaagagtctatgatatcttctattcaaacatcattccctccccagcaatcaccacaatctggaaaagtaagtgcactataaaaatcaaagtttttctatggctcctcctaatggaaagattaaatactagacttatgcttcaaaagaagaatcttaatattcctgatggacctgaatgcgttatgtcctctcataatcatcttgaagataccattcatctcttcttcacctgccaatttgcacatcaatgctggaattatctcaatatacattggaattccaatcttcaattcttcaacatgatactcatttccacgcaaagtttctttgtggaagtaattggtcactcttgttggaacatctggacttgcataaatgatttttttttttcttttataatatcccgatctctttccagtgtgggaagaatctctttaagagagattttgctctgcttgtgcatagagcaaatttgttagaccaaccagtttggaaatcatggcttgacactctattgtaattctctccctgtacatatgtatttgtaactttattattttaatatatcgcagtaggagtctctcgtgttgttttaactgtcaaaaaatagttggtggcggtggctccccttcccatcgtggttgtagctccgcatctgatcgacaacgacggcttctgtcgcagcggtggcttgccatcctgtcggtgctcgaggtccctttcccggcccccgaacgctcgagctctcgacgcccccactctccttcacatcgttgaggatcatccatccttggcaaggagcaggttgatttcttctcgtccttttcttcattacattgaaatcttcttcttccttaggtagtagtagtggataagcgagtcctcttgtattttggatattttcatgttcaatttgtgtaggtaagtgcaaacacttggatagaagagagagcgaattagaggcgaccatcccctttctttgcaagagaagttcactcagtgcactttaccgtcaagttggtgcaccacacatccgcatcgaatggaagattcaaggtctagaactattccttcatatcattctttggggtaattggcttaattagctatcatgaataagttttctatggtttatgagtatctaggattcaatttggttgatagatagattaattgataggcaactattatgctcatccacaggatggaatccttaactacatatctgttgaaaatcaaactaggtgagggatcag

SEQ ID NO: 13176 - DNA, 1501 bp, Oryza sativa; identical to SEQ ID NO: 13172

SEQ ID NO: 13177 - DNA, 1501 bp, Oryza sativa
tcgagacatcaaacgtcgacaggtatgaattcgattcgaactataaattggggacttaaattggactttttgcttacacaaagccctcacggccgaaacgatggccatgtaacccagatggccgaaacaaaaagccttctcacttcatcctggttgggactggatcgaagatgagcgatcatccacttagagcccacaagtatccaaccccgcaagcctcacgcgaaatcctcctgggccaaaagtgccatacttgctgaagagtcaagcctcaagtagccaggcgaactcaaaatcaaataggcaccttatttctttcggttcaattttggttttcctctagatttgaagatgagtagctaacctaattgaaatcgtaaatccgggggaaccaacgggtttcccatgcaatgacgccagtcaagcccaccgattttgagcgagaattagttactgatgatacatgctgtgcagttgtgcccttcgtttgctaattggatcgactcaatgtggtgctatcaagttgcataagactgcaccaattggataaaaatctgcgattacttgcttgttaatgccgaaattaaatgtgaaagggatgttatttaatacttgagtcaactccttaatatcaatattgtaagtttaccattgcattccccggtccacgtgcatcagtgcatgcaatgaacagctagttcagtaggcgttgagcacagcaatgacatacctgcatgctcttcaattgaaaatcgtttcagtttgggataagttcgtgcactgaaaaggaaagtaaacgtacgagagaaagcaactgcaccctacttatgcatgcccacttaacattttttttagttcaaccgattccatttttaatggacaacttcaaaatttcatgtttattcaaaaaaaatattttttatcactgactccgatgtgtttttgctagttttacacgtacatttcatcgctccgaatcacctctagatcaatttcaagatctttgaagatgtgtagcttcagtttgtgccccaaaccatgaacatatttttacacgtcctctctctgaaacaaaggattagtctgatccgcatttttactctgtttatccgcaagaaagtttttacacgtcctcgcaaattgcatgctacataattcctccctttgttttgtaatagataacaccattactaacttatagtaatattatttatttttgttgtgacatatttatcattaaagaaactttaagcatgacttatactttagcatattcacactaatttttggaataatacaaacagtccaacgttgtttcaaaagtcaacaacgtcatttattaaaatatatttttttttcaaaaaaaaatgcatgctaattatagacctgctaggaacttgtataaataggggtgaatgcttttgttacattgcaactgcatgcaaagtccaccaggcttctaacaactagctatagctacttgtgcctgcaaacaaagata

SEQ ID NO: 13178 - DNA, 1501 bp, Oryza sativa
tatctatatatctatctattatatactaaaactccatgaaacttcctacaaacgctcctaagccgccatgtgtactcctacaaatactcctaaaccaccacatgacatcttaacaaattggtgggcctaatatttttatctattaaaattttattaaaaaaataaccccacaaacttccctcccctcttctctccccatgggcccatccttcaaccggacgaacaactcaagttcgtacgtacttaggtacggtctccctcccctcctatccaatctcttcttcttttttttctttagttataaaaatttttaaacaataataaatcttaaataaccatattttttctatagttatttgcatgttgtctatcaacaattaaaaaatataaggtgttctttaacctatatgaaatatttaatttttttatcacatcctaaactttgcatatcacgtaaaactgtcatataaaataggtaaaaattgataatgtagattacacgatcatatatcaattgacagaatatacataaacaaattaagttagatctattatataacaaacgtttctaagccaccacgtggcatcctgcaaacgctatgtactacgatgccacgtgtcactataataaattagagaaatttttaaaatttttaagaaaaagaaaacatctagacattaatttttattaaattaggtagacccattatttaccactattatatttatctttaaaagaactccttaacctccaaaccggatccaaattggacctgtacgtagcgtacgttttcttaaggatagtacgtacgtacgttagtaacgtacttccaccccttcttccctcaatttcttcatatttttgcacatatttcttcccctattatcatatactttattagttagaaaatatattttgtgttaaacaattcaacaactataacatctaaatcatacaactaacttttaattcgcttatatcttaaaattattttatgactaaatctacaggcaaataccaaatttccacaataattcaactttgagaaagaaaatgacactttggattatatttccagacttttgcgtaccgttgaagcaattacaaaaaaaatgaaataataatattgtagactctatcattgtgcataacttcataagaattaaattatatctacaatcataaaatctaaaataaaaatagctatgagtaatgttcccaaaatatataagttagaaagcaagagttacacgaaaaaaataagcagctataacatctcaatcatgggatcccctaaatcatacgagtaatatttttcttatgtattttgattattttacatttaaaaacccatatttgaggttatattatctgacttttatatgcaattcaaacaattataaaattgtgaatagtaacgatatatattttatcattgtatatgtcagggttacgggtcagacataccctctacccttcgatatacgttacatatcgaca

SEQ ID NO: 13179 - DNA, 1027 bp, Oryza sativa
  unsure (1)..(1027): unsure at all n locations
tttagtaaattaaaatattggacatccaggccaattatgttcattcataatttgtaatcaatattgaaaatgttaaccaaagattcgagtttaccatattttaaaataaaagaatggtatgtgtggcattatatgtatttgaggtattttaaagagtaaattgcattggtggtacacgaacttattaggtgggtgcaatttagtacatgaatttgtaaaatgcacgttttggcacacggacttatctaatccgtgcgaactaggtccaaaatggtttagcaaggttaattttacctagctgatgttaattaggatgtggcatgcatacgtatagtgagtatgcataaaacatgctatatttataaatttattctctactttatcttgaattttgtatgtttctaacccatgcatcattgctcatttgcccggtattttatatctttctctacaatcactatatctcattatatctttttattgaacaggtgcatgtctaagtagcaaccttctcatatatatgtttacgtagtatcctaatcagcacctaaagcaacaaaattagtcatgtaatgtccttttgaccttagttcgcacacgcaagataagttcatgtaccaaaacgagcattnnacaagntcatgnannananngcacccacctaacaagttcgtgtaccgctgatgcaatttactctattttaaaagttgaaattacatattttaatatgttggttaaaattatctttgtaatgcttattctgattaaggaaacatttttatactgtaatgatatgctaggtacatgaaattcattaataagttgaaatttatcagcctatggcatctcatattctgtaaacctgtaccttgccatgttattggaatttccaaatatgtcatgttgtaataatcttctaattgttatagaagtttgatttgcatctttgcattccaccaagctcaagtatttatcattttatgagttgctacaacttctaatatttagtgcatttcaatgtggcagg

SEQ ID NO: 13180 - DNA, 1403 bp, Oryza sativa
aagtagcagccaccaactaccgacggcggcgacactagctgtacggtgaagaaccaccggaacagccgaagagatgggcgcaccccgataaacatctcgcacaggtgcgcgaagatggccaacgtcattaccgcgttgggggtgaggtgcgccatttggagatcataaaactccagaacatccatgaagaaagaagagaatggcgggaccagccctgccattgcgaaagggaggaagaagacggaccgccccgggtagtgtggtgccgggcgtccctcgcccagctcgaccacctcccgaccggcggtagattccggcatgaatcggcgcggcagcccggcctgcctctcgctcacgatgcgggaaggcggcagcacgctaccgtcgagcggtgcggagccccgtgccatgacgccggcggaggaggaacttgagaacgagtgagtgcggcaagggtagggcacaggaaacaaggagttagggcgcaagcggcgaaggcaaggggaataatggcgagaggaaggaaacgaatctcttccttggcgcccttatacccttgccaacgctattcccggctcctcgtttcccgcgcccactatctcgccccctcgtttctcgcgcccacgcctccactaatcccactcgcccttttgcggcgcacgaggcggatgtgcggccgtggcagtcgagatgagacatatcgtgcgcgcgttaactacgctcgccgaccgaagcgccatcatcatatctccaggcgaaatgaaccggctcgtcccgattcgcgcgctatttcgagaaatgtagcggtcttgaagaggccactcattattatcggtcgttttttccctagccgatgcgcgcgatttgcgaccgctgggttcctgcccacctgtagagaccggtcccacctgtcaccagacctaaggagtggcgtcacgcccgagcgcttccctcgaggggggcgatcgccctggcataacgccgggggctactgtcggtgacatgggatcgggggtatcatgactagaggcttgggcagccgcagtcacccacgtggcctaaccccctcgggggggggggggtcgggcctgagggagacgtggccacccctcctttgtcttcccgaggggtcgggccgctcctgcttcggccccgagggctggggtgcccccgaccccctgtggtattggcgccatgtttgtgagttaggtgggcacagcggcgctcaccaaaccacatttattgcggaatggacaagcgcgccacgccgcatttaatgcagcacggcgcacgcatatccggtccgtgaccggtcgcagtgtgtgatcggtcacagaccggtcagatcgcgggttaggtggcagcaggcggactgtcacacgcctcgccccgtcccgtcggaa

SEQ ID NO: 13181 - DNA, 721 bp, Oryza sativa
atttttggtaaaatttattagttgttggcacgctatgtacacggaaatattgtgtgcatataatatattcttcagcaaagcacgttggtttcatttagcctctaaacagtttgtaaatctgccaccgccaaattacaatgctatgtgcagagagaagcaaagggatcaaccacctatatctggtatcaggcccatcatcaaggagggttgatttattttgttggcattatgtattgtggttgatgccattgccatgtcagacacatcattagcatcaacaatgacatttatgcaatgtttgacttagtcagccaaccgaactataagatgggaatgatggtgttcgtgacgaaaatatcaatgcaattgctctctaaccaacaatgcctcttttaaattacgagactcgtcatatgcattcggtatataatggagtactctctccattcacaattgaagtataagcttttctaacgatatgcatttttcaatctggccaaaaattggttcggccttgtttttgagaaaattcgacagaataatttgatcgtggttgatttggttcaatcttctgttttacgggaaaaaaacaaatcacaacaaaatatcaagatagcgtcaattgtagcagttctaacttccaactcaacacaagaataagatagctacttgaacttcttttccaattccaattaattctgtcattttgactaaacgagga

SEQ ID NO: 13182 - DNA, 1501 bp, Oryza sativa
gtggcagggtgattataccggtcaaggtttaaatcacgtacacccaacatcctaattatttttatattttaacacagtattcaaaatgttactttgagcaaatttcacaaaacttcatatattttaaccaaactattgcaaaactatagatttaaagtgatacatcacaaaattacatatacaaatgtatgggagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggcgtctataaatattatgcacgtgcgagtgcgttttcaatggaaatttagtgaagtcaaaaatttatcgctggtcttcgtctcgttaagagcattgtgtgtgtctgattgcggtgtgcgtgtgtctcccgtgcggtgttggcgcgcccccgtcccccctatccttttgggacctttgaccgtttcccgagtttcaacgtggcatccggtctacccatggtcccgcccgcctggtctccctcgcggtccttgtttcctcggcccgcccaagcacccgtcggccgtcgctgccttctcggccttccccgtggcgtgggcggccgccgcccttggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgtttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctcta

SEQ ID NO: 13183 - DNA, 1501 bp, Oryza sativa
aataaaactatttaacgcgttttttttaacgctagaatgtacaatacgaaacacccaaaagtaactctgggattaaaattaaaattttaaatttccgcttatgcatatgaactaaaggctaaatgatgggattgtaaaccaccatccatgagggttagcttcgctggtttcaatatgtgtgcgtatgcaatggtacgtggtggtggcagtagtagaatggaagctagctttatcatcatcatagaaaacttaaggaatggaactacggaagcattggaagggtagacatgaagtccaagcttaggtagggatggaatgattttcagtgttgcaattcatcaccaattaatttttagtggagggtgaatttaagtcagcacaaatatcgtaaaactttagcatgacaaatgccaaatagatgacgcggggttttaagatataaccatgataactttttttttaaaataggatcacagcatgagctatttaactgtgtcatcctgaaagtatttccaatggtaatatacaaatatggttttcgtttatctaggttacttaatagaaaatgatcgaaactcaaatattgaaagttttgctaaaggaatcaccacatgttatatgagggcatgactgcatgaccataaatgatatagatatgaaatgaaaattgtcgttatatacgtcaaaccatctatatcatttatgttccttccgtcagtgtttttgttattgtcataatctttagaatcccatatgcttacaactacttttgtatgatggacgtaacataattaaggaataaaatccgacgggcacaatttacaatttaaaccgcacctctccatctccaaaaacctcaccattttgcaggtgaattgcaccgggttgagttctgctgtgcccatccagtaccctctccaacaaattaagcacgcacataaaaacttctctcggacttaagccactaattgcaccgaacatagctggcgatatgatatgatcggacacattaagtacttgcttagccggaaattcccagccggattacagctaattgccgtgcaaattttccccttctcgcataaaatttccggtggcttcgcatgcagtgtgtaacaaaccggtaataataaactaataatggtaaagttttgggcttttttcccagaacgggtaggccgtgtacttggcggccgctgtggacgctacaggagatcgcgtccagctggcacgagggcatgatcaaaacgccacgtatgatggcatgcacagttgcgagagttgccggtcaaaatgttaaaaatgagatgtacggactcatcttttcccttatatttatgtttatattttatcagttaaattttaaatttttaaccttaaatttagagttgattttgatttttttttcatcgtaatttatttatcagcttttgcttttagatcattatgaagacgtatgtaaaagttatatttataaattatttttcgtttgcaaactcga

SEQ ID NO: 13184 - DNA, 1501 bp, Oryza sativa
gaaccccttcttcatctttcccgtcatgtcacttcccctacatattttcatcctccatggaaaggtgccgacaagcttagatccctttttttttctacctctagagacatcaatgtcctcatcttcctcctcgctgatgagccccttgcctcatcccagggacactgacaaatggcatgcacctccttgttccttggatacagacatgatggtgagctccacacaagttatgggtagaaaacttttgaaattttgagtagaagaactttgattcgaaagttcaagggtttgatataaagtttttgagttttgagataatagtcttaggttcttaattagaagtgttgcgaccaaaatgatactctttccattctaaaatataacaatttatagcatttaaaatttgtcctaaagtataacaaattctccacctatattctcttttcaatcaatcacaaccttattccattcaagtcgacatgcttttttaatacccgtgtccaacctattacgtgtattttgagatgaaggtattactccataggcttcctgctttggtccatggaacccgcagccaaatgcctagcttaaataaacgtgctagatattggactagtccatgattagcatgttatacagaagcctagttgcctagtttttgaactcaaaacttaggttttggttttccggaataagtttactttagtctctcaatttgtcatcaagtctgaatttcttccctaaactgaaataacaggtatagtccatcccacaactcacaatatcgtgtcaactttggtctcttggcagtatagtggccagttttggctgacgtggcgagtgggccccacatgtcagggccatctattcttcctccaacctcccctctatctccatatccgattcttctctcttcctttgagtgtgctaggcgatataggagaggaataggagcgacaaggggcgtcggtgctcgagtggacggaaggcctcgacggcagtagtggagggtgttagagctatgagtagggcatggctcacatgagtagggcagcaaccggtaaagggagtacgggagatgaccggaatggcgatggaaagagctcagctctagtacgtagcaaagtggatgttggaaataaacacgtcatggtgtattcctggcgtggttgagtcagtgtgtgtgtgtcgtgctgctgcatgtgtgcgtcgtgtgcgttctgttagtttggttgagtcgtgatcacgagtgcatggctgctgcatggttgtttgcatggccgttgcagtgttgatcgagtcgtgggtgtgcatggtgtgcgtggcgtcggttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgag

SEQ ID NO: 13185 - DNA, 1501 bp, Oryza sativa
atacgtatgtacgtactgtattccgaacgggaagggctcatcttctcctcggattgaaggatctggtttattgatcaacggttgggattactgtttttaataagaaacatgatataaatcatgtatgcgctcacaatatacgtacactcaaccttataaacgcacgtaactatatttttttatactaaaaagagatcgatatatctagaaaatgttgaatttagtaagtttgatttcagtgttgacataaagtcacaatcatggtaatgaacacccaaatttcatggataatatttttttccttgtccaaaatttattacaggtttgttaagattgtactagtataaatggacaacaatatgatcatgcatttggctaaaaaggttatgcttttgatcagttccttgcaacaagttaagaatattccataccttttacagtgtttttttccttattctacgttgtgagagataggagtatttgatatgttttgcttcgtgtgaacaccttttagctagtgcttgggtgttttttttaaaagaaaggcaaaagctttgcctcgcctcagagctagtgcttggttggggcacaagaagaaattgaattagcatatttctgaaaagcaaaaatggattatcagcttgtttggtttattagatgacttgaaaaaaaatacacgtatgtagcaacgagtgaaggctaatttaatcatattattgttgaacggtttaactaaggtaaaattcacggtgggaactgcaattataagtttgatcatgtcaagttagtatgcaagtttataaaagagatttcttatacgtctccttctccttctttatttgtaaaagcgaacgaattcaaataccgactcaaacacggatttgtatttccaaatgcaaataatgaacttaaaaagcgactcatacacggataacgtaccaaaataccggtaaaaacatcttcaatttttataatagtagagactagctaaatgcatgtgtgttgcaacgggaaaaaaaataaaattacgctaaatattaaattatggtttaatttttttatctaagtcatattttttttattaaactcaaacaaatctgaacgtagggagcagtgttacgtaggaggagaagatgggctttgtattcatcgagagtatccatgcatctttcaaaagatttttatgatcatatgtcacggtctaagattatgtggagatgaatcgagatgaatgaggatagattggattatagtagatgaaataacaagaaacggttctgaacctaaacagcgcgacgctctctgtctcactgagaaggcaggccgatgggcactaagataaatcttgatctaatgcctaactgatctggaatagggtccctccttatatagatggaggactccttaatctaatcctaacaaaccctatctaatcctaacaaaccctaactctatccaataggcctaggattcccggcccaaagcccatgacattactccc

SEQ ID NO: 13186 - DNA, 1501 bp, Oryza sativa
ttgtcttggaccaacatgtgttacctgctaaagtctaacaggagatgccctgctttccttttctcccaaagtgaaaggaataagttcatctgaggtcccttaacttatcaacgaatccgattttcgttcttcaaccagaaaaccagattcaacaagtccctcaactatcaaaaccagtgcacatgaggtccctcgacggttttgacaaccagtgcacatgaggtccctcggcggttttgacggtggttttggcggacatggcaactacgtggcaaatttgacttggtctttatctgatgtggcattgacgtggcgcatacgtggcaattagatccggaaaaataataaacttcatgggaccttgttagtatcacacataaattaataaaaaaaatggtggggcccacatgggccccacatgtcattctcagcatctccctctctttaactagagcccctcttcttcgtcctctctctcccttctcccatccccaaggcgtcgggcggtggccgggcgagggagggtagcttgcggcggccgggagaggagggaggcggcgtgcggcggctcggcgaggagggaggcggcgcacagcggccgggcgaggagaggcgacgccgttcggctgggcatcgcgggcggagcagccgacggagtgtagctatcgcgctcgccgacgacctcctcctcagcctccttctcctctagcaacctctgccacccccggcctgccgccgctccccgcgaggacgaggaaagccgagaggaagagaaaggagagccgagagggacatgtgggcccacgtgggcccccaccatctttattttctttagctgacatgtgggccccaccattcttttattgatttatgtgtgagactgacatgtgggtcccacgaagtttagctgacatgttttaacaatgctaaaacctgtagttttgtgatatattgtgcaaagtatatataattttgtgataaacgaagacactgaatctgtagttttgtgaaaaaagttcttaaatctgtagttttgtgatatattatacaaagtatgtgtatgtagttttatgaaatttactcactttattatttacatggtagtaaagagatgcccttattaagcacgattttaggtgcccttaataaagaaagcagagcacccgcttgatcaaactgcaatggcacgcaacgcaaccattcaaccaacccttccgattcactgcacgacgggccccacaagtcagtgacgctacgcggtagaggcgaagcggcaaacgaaccgaaaaagggtttttggttgcgagagcgagacgcacccgccgccgctgccgccgcacatctccctcgcatcgcaagctcaccggagaagcgcaagaagagagagagagagagagagagagagagggagggtaagaggaggaggaggaggggtaggcgagggagatgggcgccggggaaggggatgccgccgcgggcaacaaggagaagggcggcggcg

SEQ ID NO: 13187 - DNA, 1501 bp, Oryza sativa; identical to SEQ ID NO: 13185

SEQ ID NO: 13188 - DNA, 1501 bp, Oryza sativa
acgcttgccatggaggtaacgtctggagagactgataccgcagcagttagcgcgtttccggtattggatggtggggatccagatgcagctgagaaaaatgtagtagcagggatgcaagaagaagaagcacctgattcaacgcttgccatagaggtaacgtctggggagactgatacggcagcagttagtgtgtctccggtattggagggtgtggatccagatgcagccgagatagatgtagtagcagggatgcaagaagaagctcctggttcaacgcttgccatggaagtaacgtacagggagactgatgccacagcagccagtgtgtctccagtattggacagtggggatccagatgcagctgaggttgatgtagtagtagggatgcaagaacaagctgctggttcagcgcttgccatgttggtaacttacggggagactgatacctcagcagtcagtgtatctccagtactggagagtggggagccagatgcagcccagattgatgtagtagcagggatgcaagaagaagctcctggttcaatgttggccatggaggtaacgtacagggaggttgatgctgcaacagtcagtgtgtctccggtattggagagtgtggagccagatgcagccaagatcgatgtagtagcaaggatgcaagaagaagctcctggttcaaagcttgccatggaggtaatgtacggggagactggtaccgcagcagtcagtgtgcctctggtattggagagtagggaagaggggtcacttcaagaatcaatgcagagaccatcttctcccacaatgaacattgagcaagagtcaatgcagagaccattttctcccacaattggcactgagacaagttcgccagagatggctcctgctggatctgagaactgtaaagtatcatggttgccgttgccccctcctacaccacttggcgaatcaatgccctccttgccagtcgcagctgcccccaaggttttattggtgatgccggaggaagcggttgagtcagtcccttcatcggaagctctggatgttgaaaaacctgcctccatcacacaggctgagcccagctcacctaatacgccaccgccaggatttgagaattttaagtcgtcatggttgccgctacccacgactcctcccccagttgaaaccactgatgtcttgccagatgtggtggttaccaaggcagtggaagcacccattgaggaagtgtctaggccattgccagctttggaggtgacaaacatggagtcagacactgtcctcagtatcttgcccacaacagtcttgccaacagaagggactgagggactactgcaacaaccactattgagacccccttctccagtggtgcaatctgaaccatgtttgcaaaatgagatggcacctccagggttcgagaattttaagtcatcatctgaaccatgttcagcagaggagatagcacctccagggtccgataatttcaaatcatcatctgaaccatgtt

SEQ ID NO: 13189 - DNA, 1501 bp, Oryza sativa
tacacagcacgaggacgaggggggggggggttaaagctcaaatcaaatgagcatccaaagaaccacaccaggggggagcactatggccgtgggccccacctacgcgctcccggccctatggcccacccgaatacatcgcactcgggcggggggacacgccaggacgagtccacaccgcaccggggccccacctgtcactgaccagcagctcgtgctgggggggagcagcctcccgctgacgtggcgtccgggtttaccataccactcgcaccaacaggaaggctggctggtggtccccacccgtcatcccaccgacagggcggtgcaccggggagacaccgacatgcgggccccactgaccggccgtggtgtccggctcacggcgaggtcggtccacgcgggtgcgggccgggccgcgggcgagagaaccctagccaaccacgtcactgtccacgtcacgccgaccaaataatataaagcggcacccatcgcctcagcgcctccctctctctcgagtctcccgtctcctttcccctccttcctcctcccctttcgtcttagcctcagctcgccgcgagacgaatcctcccctcgccgccgccgggtccgatcgacggcggtatcgagggacggagggggcgcgcccgttctctcgccgtacaccgtcgtcgccgaccggctccctcgacggcacggtaaaataaaaaataaaaagcctcctcctcctcctcctcccctatgatggcggatgcggcggcgggggggcgggccgatctggacgccgttgacccgcccgattcggctcggtcgcatccccccgtgcgcgcgtttactgggaggatctgttgtatttggacgttttagactggatcgagtgagggggattttgcggtgttcttgctgtgacgggattcagctatgtaggtgtaggaatcttatgttaacttgttgggtggctctgctgcttctgattctttctgtgaatctggagtaacaaattctttctgtgaatctggagtaacaaggacttgtgctatggccgatctctacttttagtacttcgttatgttctatacggcataggagtccatctctcgatagataagagttctctgattttggatggggatttgcttgatggatccggagtcatataacatgtttgcaaaaaaagaaaaaggaggagtccatctctcgatagataagagttctctgattttggatggggatttgcttgatggatccggagtcatataacatgtttgcaaaaaaagaaaaaggaaaaatgatttagtttgtgttctgtcatgtataacccttgtttctacaaagatgtactagtttgcgatctgattaagcatctcatgctttctcgctttgattctctttcagagtttgaagttggaaatcaaccttgttgttctctgtagcgctttcctttggattgcggagaatttcaaacaaaaccaacaaacctttgcatctgactgacttgaggtaa

SEQ ID NO: 13190 - DNA, 1501 bp, Oryza sativa
aagcaaggttttcattttcagttttgctcaaaaattcggccatgtcggtagcatcgaaattcccaaatttttgggattttgaagacttattggatcaaaattatttaaatttttaagacaatttgactagatttgaataaattttgatcaaattcaaagaaaaagaaaagaaaaaacaaaagtttcagctgagataatgacttgcccgaggttaccgaaattgtttttcactgatccaaagtagaatattagcagtaacaaaggaaaacgcttctgccgataaaggctccatttggatattgggttatacctattgggaaaagaaaatgatatgctggtagattgaggtgggagattatatgaaagaaagtcatatcccatgtttggtttgatggatgggaaatggaagtttctagagaaatgaccaaaatacccctccctacaataagtggtataacattcaaatgcagccaacgatcacataatatatacatgcacctcaccatcttcgagagccttcgtcccacgcgaggatctcggtggattgctgccagctgcttacaccaaagagcaccctcagatttgatgctatgagctgtggtagatgaatcaacagattatagaagggtcaaaatggcgagggcaatttggtaatttcacctggcaatattaccctcaatccagcatgattgcatatcccattcccaacctatccaaacaagggaaatatcaaaactggaaataatatccatttcccactctctttatcccattttccaaacacaatcaaagagattgtgtgatacatgctcatcaacacgtgtgcccgttaaagcccttggctaggacaagaatccaacttaaaaatccaccacacatcgtactttccactttatactagtataaaataagggattttgtccgtacagttacatactttgtattttacctacatctaatctcctcattttctgtttttattatccttctctaccaaatttctttcctcataaatattttttttaaattatcattaaggtgtgtctacaacaagtttgttactttgcaaatgctttttatctataggtaaaaaactttcactaattgaataatcaaactttcactcatctatagcaaaatacacatgcgtcaacttatataatagccacccgatcgatttgtgaggctaaggaaatgtgtacataagagatttttcgtgtgatgacacaggaagcgagcacaactgagttaactttgttttgccattgttttgttcatcttttctcggtttgttatttaaattagcagagtttttatgaatcatgaaaattatcttcacatgttgaaacataccaaacatttttgctagtcattttaaaaacagaaatgctacttaccgatataccgtttgggatcggtcccggacaggacaatttcccatggatcaaacacacaccctcacggatcagatacacaccctcgagaagcattgagacaccta

SEQ ID NO: 13191 - DNA, 1501 bp, Oryza sativa
aggccaagccggaaggacgcgaggttcgaggtgccggtgctgatggtgattggggagaaggactacgcgttcaagttcccggggttcgaggccgccgtgcggggcggcgccatggagaggttcgcgccggagctgaagatcgagttcctcccggaggggagccacttcgcgcaggagcagctcccggagcaggtcaaccggctcctcctcggcttcttcaccgagcacccggttgccgccgattgagatcctctctctaccttcgaagtgatcacgcgtttatcactgacatgtgaatctagagtttactggactcactcacatgttagtaataaagtcacgtaacttacaagatagactatcttaacgtaataaaatagggacgtctagaagcaaagtgtaatattgggatcaagtattgtactcgcacacaatttataatccacgtgtaatagtgggagtgaatgtgaccgtgggaataatttgtaatttaataattttaaagtttaaaattagtactacctctattttatattgtaagtcattttaatttttttgggttaaacttctttagatttaactaactttgcagaaaaatatagtaatattttcgaaaaaactatcaagttcaatgttaaatttaaggaaacttatttagtgttataggttgttaaatttaaggaaacttatttagtgttataggtgttaccatattcttttttataaatttggataaatttatataatgtttgataagaaaaatttgaaacgagttataatatgaatcgatggagacaaatatatctcaattaaggaagaagaaagatggtgagcaccaaccagggctagcttcctgccagctatctgccgatctatttaatgcaccgttttctattatggaaaaattagtaaatgaactactctcccgtgtgatattaagttcatattttgacttcttccattcattccaaaataaatttattttttaagtaatcattgcatctaaatttgtaaatttagataataattgaattcggagtagataaaatagagaatagttgctttgggatttgataaatagggtattttatctttttatttcgcattggtatgtgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcaccgcatttatagcaggttggacgagcgcgtcacgccgcatttaatgcagcgcagcgcacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 13192 - DNA, 1501 bp, Oryza sativa
gagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcgggggatgcgagaatattagcagcgtacttcttatattaactttgggggcttagatgcttagtgatcacgatgttctatgcacaaagactagctacagtcttagttaattgaggctaagattgttgatgcagattggatggagtattcaaaaaataatccattagttgatgcagatcgatctgaccattaatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatatttgatgtaatatttttggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagtgtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctttgatttgatccaagctaacccaccagccatggcgg

SEQ ID NO: 13193 - DNA, 1501 bp, Oryza sativa
cgctaattggtttgtctcaaagctactcctctaatgtgattaggcgcttgatttttgctaagagaaaaagtttaatagtatagcccactactaactctaaatcatctatagccaatataatagtcaatttatacaatagttgcttactatactactaatatctggtcccatctgtcatacacacgttgtgtcttggagtccgtgttgtagctggctacagatctgtagcccgctgctcttctctatcaatgtttatctcattataatatgtttataactggctaatatcctactattgtacctgctctatgagcaagtttaatactatagcacactaatagctccaaatcatctatagccaatgtatataatagttacttactatactactctattattatctggtcccacctgttatacacacgttgcgtcttgaagtccatgctacagctggctatagatctgtagcccgttgctcttttctctctttttttatagctggcttatatcctgctgctattgtacctgctctaactgttgtcttattaaaggctaaccaggacgtgattagatgttacttcagtaatcacgcttaattaattaacctgcgcgtagtgtttatgtaggagtggtatcaagagctagtgataaacaggttggctgtgatgttggtagcggtgttcgcttggattgtccgtgatggatggatgcaggtcattttcgtcagctggcgagatgatgatgattatgatggttgatggacgaggttgatgtgcgcatgcatgcattgatgcataaacgcctttcctttccaattcctgtgagggccaagaaacaaaaatggagtaggtagaagcatgatcaagaaaaagggcttgatagatagagcttcaacttatcaatttaacttcaggagttaggtttggagtggagttgtggagctgtctaaatccagctctacaactttttgtgagagagttccacccaactacactcccaattttggtggacctgaaactgttgggctgagctccagctccagaaagagtggagctagaactggagctagagctgtgccaaacaggctccaagaatggcttcgctctactgctgataaaccgtgagaaaatgaacgaaacaacttaaaaaaacaatttttagtgacaaaagaaactaatgctgggaaaatgaagtatggtaaacaagccttaaaaattaactctaaggctaagtttaaaattcgcatttgggttgcggatgataagccgaaaaacaaactctactgttgctattgttattcatttccattttgattttctagctgaggctcagtttgaaacgaattactgcgtgattgtttttacggattgtatatttaattatagagataaattaaatattttgataaataaacttaacagatactcggataggtatataactaaaacgagtggctaatagaggaaagtttttttttctaaaaaagtgtgtttttcgaaac

SEQ ID NO: 13194 - DNA, 1501 bp, Oryza sativa
gttgttttgaacttatgcaatctaaatgatgtttctagttaggtactcccacaaacctaggatggtttagaatttgtagtatgcatttgttttttaatgtgtcggatgaagaatgttataaagtttttatgaatgatgcgttgggggacgaaatagagtgtttgtcgattattctagggcacaaatgaaataattaaatatattataaagttaaaaaatacttaaaaacctagaaattctgaaaaggaatgttacttactcaattacttgtcgttcacggtttgttctaaatcaaaattttgctaactttcactaataattttagaaatttatgtatttattcttgggcataaatttatgcggtttaacggcatgttaattatatatggtatgtaaatctaaaccataaatcttaagaggttaaattatatatgtatgcaaattaatggtaaaatatttgacttagaataaaattaaaattataataatttaaaacagagagtattaaagttcgtcttagaaaacatacccacagtaatccatgacagaaaaaagaacacgccatcggaatcagcagctctcaactgaagaagggaatttctccaattattacagatcaaacctcctccgaaacaacaagcaacagtccatttttgctcatggaagctggaccatctgatgaaaccaaaaccggccgaatcgtctcccaaagttcatcaaaaccccttaccaccaatgtcctactaatcaccatttttgtgccctcacaaacaaaacaaaacaaaaatactagtatcatttggtgccatctctagcgcaagaaagaaacagattaccgggaatttggatccaaccaacaacaactgttgggacaagaagcaaattaagcaagccacgtagggctaattgcaaggacagggacgggtcggagttggacggggcacatcgcccggtttcgcgcgactgtagttgacgatgatctatgcgtgtgcttttctcctttaattttgtgacagttgtggggatttattactgccgcaagactttctggttcattcagaaaactgatctttgcttttgcgggaattggtggttgcggtgttatggttgttcttggtgaattgtttttcagacaaacatttattttataatgaagaaaaaaaatcattgtctttcttcgtcagaagctagagctaaattcttactcctctatatcataaagcgatagataatgtcaacattctatatagtctcacaaagcgataaataatgtcaacatactatatactcccttcgtttcaaaatgtttgacaccgttgactttttagcatacgtttgaccgtttgtcttattaaaaaaaattgtgaaatatgtaaaactatatgtgtacatgaaagtatatttaacaatgaatcaaatgacataaaaagaataaataattacttaaattttttgaataagacgaatggctaaacatgtaccaaaaagtcaacggtgtcaa

SEQ ID NO: 13195 - DNA, 1501 bp, Oryza sativa
ggtgcttttcttggtagataaaaatacggcccggcccaacgtggcttgtgatccagcccatgggtctcgtggatcggccgacgggagcaattttggacggaattttatgaaattttcagataagttttcaaatctgcccattctagctgcaaatttctcagtctccctagtcaagaagtaaaggagagcaacgtgatgaaacaatcaacgtggcgctgcgcctccattgctgaattttttagccatgcaaacgcaaacgcaagcagaaaaagaagcagagagagagatcacgactgcatatccttgttgaaattcttcaaccgtctagagcatcccggtaggcggcggcagcgacacatgcatatgcatacgcatgcccagcgaagtaagaaaagctttcccatgggtcggcatgacgagattcccgaaacggcccaagcacttggaccggccgaccggccaatcgcgccgccgtcgccgcgcggctcaggcatctactctgctgacgacggaatattcctcgcaaccatccaaaagcgcaagtccggcgacgtgcgctcacaacttccgtaacggcaccggcgacattatccatttcagatatgaaagaaattgcaactgtcttctactccctccgtccccgtcaaaaaaaaaaaaggcaaactgtggcttcccgtgtcaacgtttgactgtccgtcttatatgaaatttttttataattagtattttcattattgttagatgataaaacatgattaatattttatgcgtgacttatcatttaaattttttttaaataagacggacggtcaaacgttggacacggaaatcagggtttgtcggagggagtacaccgtatgtgatctctgctgaatccattcttttatttctgaaaacaggaggatatttagtgaatttcgcataaatcgagatgaattcatccacctgggaaaagaattcaaaaaatgatatagattcattcctcgatgggatatcctcccattatttgtatatcatctaaatagttatcaaaattttattttaaaaaacaacaatataaattaatatgaaatatatcatccataataaacatgtaatatcaaattcgacttctataaattgtaacaaaaagaacaaattaaattgaaaatagttatcgtacgttcacatctatatttgttatttttgttataatttatagaagttaaattttaatttgtatgtgtgtgaagtgatatatattttatattaatttaacttgtcaaattttttaaaattttttatgactatttagatgcaggtacgattgtacgaagttagaggataatcactttccctttacatatctgcatcaactttctcgttccaaacaggcgatggtgagcagagcggacacgccggccgccgcccatcttgtcccaattcggctcctataaatttccctccaaattcgcactgattcctcacgctacccgcccatcgatctcgcgccatctcacaa

SEQ ID NO: 13196 - DNA, 1501 bp, Oryza sativa
ttttcattttattttattttattttctctatttttcttatttttggattttatttaaactccttttgaatttaaattttatatgtctaaccctaggtcttgaggattcctctgacactctagataatatcaatcaatctcaggacatcgagcaaggcaagttaccatatacctgttgatcatttaagcctatattttacaaatcatttatttatttatagccttctattcaatattctattttctatgcataaattaatcatagaaacccagataatttagtattgcttattttgcttacaatctggttaaaataccctatacttagattgggacaatacgtaagatttggatgatttccaggtggctagtattgtctcaatcgatataagttttaacaggtacttatgtcgaacgaacgggtacgaccgcagattctagaatggggacagacctagttattatgttaattagcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgaaatgacgtggtgtcatacgatcagttccccttaaatacctcgggaacgccagaactcctcttgctgctgttaacattacgttcagagcatatgaggatataagttcatggaacaggtgccataattgttattgacttaatactgggccatgactaaagccgataattatcagcaagtcgtggactgcgggtaaaacgtacatctgctgcagtagaatatctttgaaactattcgaatagccgtactcatggagttgagtactgggactcatatggtaccctggttagaaatctaaagtttatatgttttataaattctgctataacttttccagattgtctaataccgctttttgcaaagaaccctattatatgtcaatgcataacatatttccatgataacttgctgagtattgtgaatactcatccttgctcttataacccctttttcagatctgggtcaagaggaggacccatatgactattactacgaagaccccgataacttagaaaatccctgagggttttacctcactagtcagaatgtatagaaacttccgctgtgtactaattagataggtgagtacctattattgtaaaacccttagtattgtaagactttaacatatgcaataaagaaccagttatattgtatgtatcaatttttactgatccagggattgatacaataatctcagtcggatccaagttgttagttttgggctccgacaattagcctaggcatctaccaccctgaaaatcagtcaacggcttgattgtctagatattgtgtttcttttcatacttagtgttgcatcagttaagtttgatctactaagtcgtgcttagaaccataatctctagactgcttat

SEQ ID NO: 13197 - DNA, 1501 bp, Oryza sativa
gctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacctgctgccattcccccagcataaccggaagccatccatcgatgagcaattcgctcgctttattgaagcgatccaaaagatccacatcaacatacctattttggatgcgatgcaagtacccatgtacggttgctatctaaaggacattctcaacaacaagcgaccgatgccaaccgcggaagtggtgaaactaatggaggagtgtagcaatgctatactcctccaacttccggagaagaagaaagatctggggtgtcccacgaacaggccttgtgcgaccttgaagcaagcgtgagtgtcataaccaaggatgtcttcgacaaattgaactacacagtgttcgcaccaacactgatgcggctctagctagccgattcctcggtccgttacccagcaggtattgctgaggatgccctagtaaaaattcgggatttcttcatcctggtggactttgtggtcttagacataaactctgacaaggagacgccgctcatcttggggcgtccgttcttaagcatcgtggaagccaacattgatgtaggagctggagaaatccggctcgacctcaatggaaaggaggagaagttcgaattccgaccgagaatagaacaatgctctatggtgaagatcaagtacgggccaaatccacaaaatatccgagaggtcgaagttaaaccctcaaagacggatagcctcattgcattcatgaagaacttcctggagaaggaagcgatgggcaggcaccgtccagatccaaaggtggcatcaagaacgcaagctaaaaagcctgtgacaccagccgccaagaagccacaggatgcacccaagacgtaaaatgactagcaagtgaagaaatcgacacccactctctcacctccggagcagggtgccgcatcatcaagctaagcatgatggaggtatggtcttgctcgtcggactaaaaacgacgttgcccttgccaataggtaatttggtatgtatctcatatttgccttttgcatcaaaacatgtttattttttcaaaattttgcattaggaataaatttgagacaaatttataaaaatcaaattttgagcaaaaataaaataaaattttggccaaattgaacgtggctcccactcaacttatcgttgggagccaacggccaaaagtgggcccagttgggcctaccaggccttgttcggccaaaccggccaggcaacggtcagttgtggcactttcaggggcaacggctagtaggtcccacatgttagttctagccgttttggg

SEQ ID NO: 13198 - DNA, 1501 bp, Oryza sativa
aacttttactatttgatttgttttttttacaccatgcatatattgaatttgatcatgcgtgtttttcaataaacatgcgatacaattaataacatacttctgtaattttttgaaaaaaaaaacattcataactatttgaacagcttgtaaaaaaaactaacttctcatggactcatccatcgatagaactgagccaaactaaaattgctctattggcgaatccataaatttactagaaatagacatgcatgttggatcattcaaagaataccgatagggagtcgggtaaccccaggccacactatgattattgttgttacactatcagcctctgctcaataatagaggcatgaggcatccgacatgccgcgtcgccggcggagctgtactggaagatcgcgctcccgaccttgccgatgcccggcgccattcgcgacctcatcaacccagtgagctcagcggcctcagcttcgaaggaggacacggtgaacaacgtgttcttcctcgagaaggacctcttcccgggctccaagatgacgctccacttcacccgcgccaccgccggcgccgcgctgttgccccgcggccgcgccgactccgtcccgttcgcctccgaaaagctcccggagatcctctcccagctctccgtccccgccggctccccggccgccgacgccatgaggtccaccctcgccgagtgcgaggccgcgccgcaggccggtgaggccaagcgctgcgcgacgtcgctcgagtccatggtggagttcgccgcgtccagcctcggcacccgcgacgtgcacgccgtgtccacggaggtcgacagggcagggccgacgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtgacgctggccggcgccgacgggaccaaggcggaggcgctcgcggcgtgccacaccgacgcggcgcccagggtggcggaggcgtacaagaggctcggcgtggcgcccgggagcgtgccggtgtgccacttcctgccacaggacgacatgctctgggtgcgcaactgagcgcgcgcgcgtgaaaggggataaaaattgtgtgatctcaaagctagctccttcctacaatttggagctatgtgcgtatcatgtcttatcatgcatatatgtgtgtgcgacggcccgatcgatcgacatgccactatacgtgtggcagcatgttaataagtctgcatgtaagattcatccatgcatcttgtccggtgaaatatataaactacgacgatgttgcacggctgtacacaatactcccgaaaagattgtgttaaattttgtatttgttatatagcaaaatatagacatatgtatcttatatcgttgatttgattataaacagagcaatagttagattaaaaatcagacatggagcttat

SEQ ID NO: 13199 - DNA, 1501 bp, Oryza sativa
aaacaaatatgtcatgtaggaaagatgctatatcgcattcacgatcatgccggatacctctattattgagcaactaagaagttagcccgcatgcatcctaggctgcatttgagacatttataagtaataggttgattgtgttaaaatgtcgtatttgttactatatagcaaaatataggtatatggattttatatcatcggtttgattataaacagagcaatagttagattagaaatcagacctggagcttataattgtaaactatttctcttttagtaatacaaaatagcaacggaagaggaatgaaaagcgtagagctcgagccaaagagggaaggagtaggtgtgtagtgatgggcacaggtgagggtaatgtggaggggattttttctttgtaatttttccaagtgattgaagtgaaagacaattattagatgctattttcctaggatttgtaagattttttttaaagatgtgatacaaatcctagaaaagtaacatctaataattggttttcacttaaatcacttagaaaaattacaaaaaatgaatcccctccacatcacgctcgcatgcgtctatcactacacaccggcctactccttcatttcctctctagctcgcgagctctacgcttctcatttctctccccttcctattttatactccctccatcccataatataaggcatggtcaaacttggcacagtctttaaaagattaaatctttgacttaaatttctcatatactataaggtttattgcaacaaaattataaccatcttaaagtaaatttaaatatcaatctaatgatattaatttcaacaaacaaaacttaatttatattgtaatagttgttggtcaaatgtttttaaagttgaatattggaatgtgtgcatgccttatattatgggatagagggagtataactaaaagaaaaataatctatattataagctccatgtctgatttttaatctaactattgctctgtttataatcaaatcaacgatataagatacatatgtctatattttgctatataacaaatacaaaatttaacacaatcttttcgggagtattgtgtacagccgtgcaacatcgtcgtagtttatatatttcaccggacaagatgcatggatgaatcttacatgcagacttattaacatgctgccacacgtatagtggcatgtcgatcgatcgggccgtcgcacacacatatatgcatgataagacatgatacgcacatagctccaaattgtaggaaggagctagctttgagatcacacaatttttatcccctttcacgcgcgcgcgctcagttgcgcacccagagcatgtcgtcctgtggcaggaagtggcacaccggcacgctcccgggcgccacgccgagcctcttgtacgcctccgccaccctgggcgccgcgtcggtgtggcacgccgcgagcgcctccgccttggtcccgtcggcgccggccagcgtcaccgtgtacgccgccgcc

SEQ ID NO: 13200 - DNA, 1501 bp, Oryza sativa
gccacctttggatctggacggtgcctgcccatcgcttccttctccaggaagttcttcatgaatgcaatgaggctatccgtctttgagggtttaacttcgacctctcggatattttgtggatttggcccgtacttgatcttcaccatagagcattgttctattctcggtcggaattcgaacttctcctcctttccattgaggtcgagccggatttctccagctcctacatcaatgttggcttccacgatgcttaagaacggacgccccaagatgagcggcgtctccttgtcagagtttatgtctaagaccacaaagtccaccaggatgaagaaatcccgaatttttactagggcatcctcagcaatacctgctgggtaacggaccgaggaatcggctagctagagccgcatcagtgttggtgcgaacactgtgtagttcaatttgtcgaagacatccttggttatgacactcacgcttgcttcaaggtcgcacaaggcctgttcgtgggacaccccagatctttcttcttctccggaagttggaggagtatagcattgctacactcctccattagtttcaccacttccgcggttggcatcggtcgcttgttgttgagaatgtcctttagatagcaaccgtacatgggtacttgcatcgcatccaaaataggtatgttgatgtggatcttttggatcgcttcaataaagcgagcgaattgctcatcgatggatggcttccggttatgctgggggaatggcagcaggttggtgtcgcagtactcctgcggcgcagccttctcccgctgaattgtctcttcttctccatttgtgttagatggtgaagcctccttattgttctttcttgttcctgcagtgttaggatgtggctggtcgcgagtggattttcctccccttgtggttatcattaaagttctctagagagggctcaggttgccctggaatcctcctagattcattagcagggacaagagtagccatctgagctagttgagtttctagcattttgttaaaacttagctggttttgaaaagcagaggcaaagccatctaacttgttgacggtccttaaatcataatatctgaccatcaatacttgcatataacgaaataaaatatatggtatccaacttagtggtaggtattattactaatcatttccactagtgttggtgaaatataagtatgcatgcatattaaggagaaaacacgtctgtcatgcaacaaaatacacctccggacaatcatgatacatttacatggattggaggacccacatgtcaatcaaaaccacttagaattgggccaaatcatagtacatgatgttgggtgcccattaagcaacctcctagccaaaagagagaccgggaggtggatttttgggttcggccgaacccgttcacctccatgtgtacactcctgattttttcccaatgatcgttggagggtgttttggacaattcccatagttgtaacgtcatatgg

SEQ ID NO: 13201 - DNA, 1501 bp, Oryza sativa; identical to SEQ ID NO: 13197

SEQ ID NO: 13202 - DNA, 1501 bp, Oryza sativa; identical to SEQ ID NO: 13198

SEQ ID NO: 13203 - DNA, 1501 bp, Oryza sativa; identical to SEQ ID NO: 13199

SEQ ID NO: 13204 - DNA, 261 bp, Oryza sativa
tagcctttttcctttttgtccatggaaaaaatggttcccaactttccaccgatcgcttagcttagctagctagctttagtggcttgtctcgatcgatcatctattcatcttattgtcgatcagagaccaaccatttcggcatatcgttcgatctatcgcctaactttgctgctagctagccatatatatttggatttatattgttgtcaaatactatatcagattgatcgatcggtgatcggtctatgccgttgctgccga

SEQ ID NO: 13205 - DNA, 1501 bp, Oryza sativa
cctcggggtaccacgtcatacccctcgggcccttgcactgctttgccccgaggccctcgcccagccgctgtttggcgggaggagcaagcgaggagggggcccaggctgaacttcctttaatgcgcgcagcgccccaactgccccctgtcgcatttaatgcagtggggcggacgtgcggcgtgctgaactgacgcgcaatggtcaagaatgaccggtctgcgaccggcctgacgccggtcacgtccgactggacggacaaccgtgctcccacgttgcatctgcttccggcggagtggaggtaggtatgacccgtctcatcggggagtcattcggacggtggccaccacaagtcttcacctattaatgagggaatgacagggttgtcccccgtgtcaggcaagggacggcgctgggccccgcttaaggacaagctgtggtttagcttccaggtgaaggcacgggtcgagttccagtcaagatagggtgggtccccacccgaaagaagagtaggtagaggcggtgcatgtggtatccccttgaggtataaaaggaggaccttgcccaccgagaagaggaggactctgagaaaacatgaactcgtggaggagggaacaaagagtgttctcccgagtttaggaacccttgtaactctcagtctaaatcccacaggagtaggatattacgcttcatagcggcccgaacctgtataatttggtggtttgcgagctagctgggagccttgggaacggatacgtaatttctagaggcgagctttttcccccggccgaactcacgaaaggggggtctcacgatctcccgctagagaggatcactcctcgacaccatcccatctatattttaaagctgcgttcgtcagttaatcaataacctagagatgtagtcttcgactgaaatccgtgatcaaatattatctcgggtctcagagtcgtcatcagttttatatctcccatagtgtttcttccatgattggatcttgatgtactatcggggcctttttttaccacactcagccattgtttgcccggtgttttaggtagtacgtgtacgtactaataccctaccaatctaccatacatccaatacccttactgtggccgcgctgcgtccatccaccgatgactgatccacggcgtctctggtttggccacatggcgacgatcccgcaaacactgcttgccctgattgatactcctcttgctacagtaatatactccctccgttttaaaatatttgacgccgttgactttttaagtacgtgtttgaccattcgtcttattaaaaaaattaagtaattatttattttttttcatataatttgattcattgttaaatatactttcatgtatatatatagttttacatatttcataaatttttttaataagacgaacagtcaaacatgtgctaaaaaatcaatggtgtcaaacatttggaaacggagggagtactcagcaattcaccatataaacaaatcacaaca

SEQ ID NO: 13206 - DNA, 1501 bp, Oryza sativa
aaaaactctgaattctgagagattgcagaacaagtaattaagcagagtttggtgagattcgatggaaaacatggagcaaaagaacatctttaattgctcggtcatcggaggtaaaaaaacaattcgcatctggttagcgtcgtctggatctggccggggtgagggaattcagcgttcctgcctgtggaatttggaagagtctttgctcctgaatttaagaattccggccaagatttggagcatcttgaataagtcaaaaaagatagttcttgtgaatcgagtgctagtttcacacgtactggttgatcacaaagagaaatcgtacgtgtcgctattcttcaaaagacatagaacggtggatgaatgggcacgcttctcgagcttctaacaatgctgtttcttataagaaccttgcatttatgaatttattagaaatattgttgaaatccattttcaactttataatattcaatttcattcttatgtacttgctctgttccaaaataactcaaactatagggatgaattatatattttggaaaagagggagtacactcggataattatcccaaaccattggactattcaaccatttagtacaaaaaatatattttagtgtcagttacttatgttgttttttcaccttaattatcagctgagctggcgcctagtccaccatggcttttcttttacatgtttgcatgcaaatatggacttttatcgtagtacttcttttaaagtttcaacatgattttgcgtttcgaaatggctgtatggtttacacctttctacacgcaaaagaacacgattttaatgctagggtgaatcatggtgtcgatctgggggaccgaattcctattgtttttcagtacggatcatcctgtttccttttctttttcagatgctatgaagaagaagcaaattagtatgtctcatccatagaattatatcgattctcattcacacgcatgaacgatcgatgctaattgagaaagtcagatcgaagtgggggccattgtgcagatgattaattctaagtagatcactgtctatgatgatctctatcctctatcctcacactgttcataaaaggagattaaaagtgattaattaactttgctcggaagagatcggcacaaatggcagcatttcaacaatgctatctgcccagcaaatctttattaggtgcagaccaacagtttggtgaaccactcctgcatggtgcctacttgtcctactatatgtgtattatctcctttctaaatgcatgtgttgacgcctttttgtaaattcttgatgattttacctttgcagttaaggtaacttccttgcattgtcagtgttgaaatgtgattggagtactacaaagtaactgctagatcagcttgtttactgtatgtctgaatctaagaatctaaggctgtgtttagttggatccaaagtttagattttggttgaaattggagatgatgtgactgaaaagttgtgtgtgtatgacagg

SEQ ID NO: 13207 - DNA, 1501 bp, Oryza sativa
cgtggcagtgttgacctagtctttgtaccacgtggcattgacgtggcgctgatgtggaattaaaataaaaaaaaatatgcgggcccatttgttattcacaaaaaaaaatgtgggacccactggtcccacatgtcatcctcccttatcccttcttcccccctccccgtccttggccatctcctcctcttccaaatccagcgagggttcacggcgagttgaagcggcagcggcaatagcttcaggcgtcgagaggccgggggagagaagtttaatggaggtggagatggagcacggcgaggaggcggcggcgatggaggaggagctgaaggggtgggacacaccgaggagggaggagtgccgcatcccggtggccacaatgacgatggacagcgacccctcctcctcctcctcctcctccggcgagtagaccagcacaccgacgagggagtagcttcaggcgtcgagggagtccctgagcgcgcggacgacgtcttcgaacggtggtggtggcggcggcggcggggacgggaagaggaagacgtggtggacgggcagcagcgcgacccagtacgcgtcgaatggggagagcggcacgaggcggcagccgccgccatctccatgcgtcgggagcgcgacggaggtgacgctcctcgtgcgcaccgacggcggcggctgcggcatctcggcgacggcgaactcctccgccgtgttccgaatctcgccaaagtttgtggggtggtttgatccccactatacgccgtcgccgctcggtccgccgtcgccgctccgtccatcgcccgccgtcgccgctgccgatccggacgccgctctcgcatgaagcgaaagagggagagatagagaagggaggagagggaggaggaagaagggataagggaggatgacatgtgggacaagtgggtcccataattttttttttgtgaatgacaaatgggcccgcatattttttttattttaattccacatcagcgccacggcaatgccacgtggtacaaagactaggtcaacactgccacgtgtgcgccacgtcagcgaaaccactctccaaaaccaccgagggagtcaaattgcaccggttttgtaagttcgggggtcaagatttctggtattgcggttgagggatacgatttagattcggtggtcagttgagggagtcaagtgatcatattccattcccatcaaacggttttaggccacaaaggaattcagcccaagtaaatcccctcaacaatttgagaccacagatcaatttgggccatgctatctcgtcgacgtattcaacccaccccagaatttggcccacttaacactcgtcggtaaattcggcccacaactgaatttggcctatcgatatctcaccaatgaattgggcccacaaaatgaatttggcccacctactcattcacaggcacagggccgcccgaggccccgacggcggcgccggcgagggccacccgaatctcgcggccgcacaccaccggca

SEQ ID NO: 13208 - DNA, 1501 bp, Oryza sativa
gtgaatgaaataaaacttttacaatgtttatctattgatattagaagtaatctagacctttaaaaaaaaattcatccaaaagtgacatgtaaaacatgtactcctatttctgcatgaagaagtagctcaaatgtctgaatatatttgccacaattgcatgacagtgccctaatatactaacatttatgcggcacaataatcagcagaaccaattatcacacgtagttaattaagttgaaaacaattgctattttggacggacaggatcattgccagatgcaaagacaacgtgcatcccgggcctccgaacatcgcggcgccaatcacagccactcatcagggcgaggcgacacaacatgtgcaaatgcagctaataattctgaaaactaaccaacatatagttatatggtctcatatcatatgatctgtatatttatatatttaccactgtacgtgtgtgtgtatgtgccatctgaaaatgtacatatctgaattggtccatggctgcatcttgttacttttgattagtaggactgcaggagcaggagcaggaacaaactttctatcttgattattttctgacgaagggctggtttaggttccaacttttctatcccatcaaaattttcttacacatacaaactttcaacttttccgtcgcatcgttcccatttcaatcaaacttccaattttagcgtgaactgaacacatccgaagtgaacgttttggtcttggtgttcttcagatacctgatctatcccttcacagaaatgatagaaagacataggaattcatagttctctgtggcatctaggaaaccgaatatttctcgggaaaaaaaaccatgttgataaggtagagatacgcagtgcttgtaaaatctgcatggggcagtgcagtaattttttttctttttagaattccctgggaccctggctgttgtgcgttgctgatttcggatttgccgtaaatcaatacaggtgagcagagtagtgcatgtggggtgagtagcagagtaggctgttggtaggtcatggtgttggagacatgtaacatggcactgcactatcgccatgatcgtgtattggattcacaagttttccctttttcatttttttgcctggtgatgatagcaaagtggttgtagacaaatgtactgtgcttgcagatttgcttatcccatatttctatttagagcatctccggcagctcatctaaatttcaacttccatatttctaattagatggctatccaaaaagattctcactctatattacttttcacttcaacagatcatccatattacattctccatatattaacatcctatattttattaatatttttcaaccaccacatatttttactcaattcctctcacttttcaccacttaaaaaaaatcttcctcaccactctctcttctacagccgagaggacgtgggccgatcggggggagcggcgcgggcgaagacctgagcggtgagggcggcggggtggca

SEQ ID NO: 13209 - DNA, 1501 bp, Oryza sativa
tggcggttgatggaatatctaaaaactataaacaaaccccaaatagaatcccaatgatgattaaaaggagggacgatggacgggtcataaagtagcatggttacaacggttggcgggacttctaaaaagtaaaaaaaaaaacccaatgataatcatgttcgaattttaaaatctcaaagacaataaagagggaggcagcgggagagcagtacatgtgtacaatggtaaaggtgctgacagtttggtggaacttctagaaagtaaaaaaagaacccaaatggtaattacgtttgatttttaaaatcccaatgaaaataaagagaagaggcagtggatggaccgtagagtagtatggtggcagcatttgacgagacttctgaaaattataaaaacaaaacccaaacgagacaataaactctaaaaactataagtctaatttttagaggtttttagtgagaccaaattgtcggagatatgggcccgggggtatgtggagtaaaggagagctacttccctttccagccacgtggctctgcgagctggtcccacccacatacctcgtgagtcactaaggtgatggggagagcctcgggggtcgacgacatcccctcgggggtgacgtcaccccctcgggctctcccgtcgttttagcccgaggccctccctcggggggaagggtgagaggggagtctaggctgggcggccataaatgtgcagcgccccaaccgtccctcgctgcgttcaatgcggcgagggcagacgtgcggcgtgcccgaccgacccctgtcagtcggatacgaccggtctgtgaccagtctattgccggtcacggccgattgaatggatggtcgtgcccccacgtcgcctctgtctccgcggagtggcggtaggtacgccccgtcacatccggacgtcgttcgatatagggctgccgcaagtcctcactcatttatgagggaatgacagggctgccccccgtgtcaggcgggagacggcgctgggccccactcaaggaccgaccgatgcttagcttccagcaaaaggcacgggttgaaacccggtgggaagagggagaagggccccctcccctccctccgatggagggggagggtagaggcggtgcatgtggtatccccttaagctataaaaggaggaccttgcccaccggagagcggagaggagcaaggagaaccttgtaaaagtccactgataatcccaaacgcaggaggagggtattacgctccagagcggcctgaacctgggtaatcgaattgtgtgctatctaaacggggatcggagggacgaacacgcgacttcggagagacgagtctctgccctcggccgaactcacgaaaggggggtcacgcgacttcccgcgatcggggggtcttccctcgacagctggcgcgccaggtagggggcagttgcgcgtttgagaagaagtcgcttccttccgctccaagtcggaccaggccctagaccgccatggtcgaggtcctgg

SEQ ID NO: 13210 - DNA, 1501 bp, Oryza sativa
tcttaagttactattgaatgtaacgtttttagaggattaagaaatacccaagctcacagtataggctagttcatggtagtattaattagcagtaaactgatgtaatttatcattacatcctccttggatatgtttttcatattttattttctctcacttttttttaggagcaggggcagctctcttgtttgtttatattttttttcagcccaggagctggttaggccggcgtggcctagctcacaagtatgcgcggatccacggcccagccggtgcctactgaagcgatcgatttgagagtctagaagcgacacgtgtcgaaaaacttatgggacaagtggaccaatcagctggctgggtccccatctagctttagaagtattgatgattgggcccgtatataatcggcataaggaaaaggaataagtccattttaactcccttaaatataggtcaaatctaattcgtatccctcatccgtacgtgataccgatatcttcgagggagctatattgcaccggatatttgaggggctccaagtggacttactccttaaggcaatccgaacggacttccttacagtgacaggccttcctcacggcctttttccagctgaaggaattttgtcacggcctaaacccatctataatataatcggaacgggctcaggccttgtatggataataattcaggcccagttcctacgagaaatccaaactctctctctctttcctccgcgctaaaacgcgcgcgggggagcgggagacacctagacggacagagaagagaaaaacactgcgccgattaacaagtgcttacggtttgtttggcaacttaagtgaaggggattgggagcttacatgaggaaattgatggtgagattaagatgggaatttgatttttattcccaatatcttgtttggcagaggtggtggaaattgacatagagtttagttagagattaggtcattaatgaaaacggttagctgagatttgtttaggtaaagtaaatgaggaattccctccaaattaccacccctaccaaggtattgaaaaggaaagagttccttcctcaattccccatctccatcccatcaaaattttcatgtctcccaaccaaacaaaacaggtaataacctcatccttctaaacaggtaaaaatccctccaaccaaacgggccttaaaggataaacctgtaagcctctcgaaacttcgtcacgcggccgaccccaacgcgcctttttcccccgtctctggaaaacgcgacacgactccggcgccgacctccacgtaccccctccaccaccctcgccacgcgtacgtccgccgcgccacgctgctcgaatcgctcctcctccgtttattaaacccccgcgccgcgcacgccgcggcactcgtcgtcatcgtcatccattctcgcatcaaccaagagacgccacgagcgcgaagcgaacacacgaagcgttcgtcaagcaagaacagagtttgtttgtgccgcga

SEQ ID NO: 13211 - DNA, 1501 bp, Oryza sativa
tccaatgttgcaataacgtagtagatgcatgctgtattcaataacaccaccacccaagtgacttgttttttattggataaaagttcaacaagtttgtgatatggtacaagctctgcaaagaacagtctcacaggggtgtcaaaatgcagagagctcgcgtcctagaagacggccatgagctcggcttctcccagcacatgcccctcgatggcgtccatcagcttgtccttggtcacctgcaagcaatcaagaatcaaccaccgttaaactaatccttaaaacagcacatgtaatcgcaacaagatatggttcgatcggatcaaaacttgccttgttgccgaggtgcacctcgtcgtcgagggcgtagagcttgaactggatgcggtggccgcgggagggagggatggggccgcgccagccgggctgcttccagtcgttgacgccctcctggatgccgccgtactcgcgggcggcggcgccctccttgccggagaagccctcggggaggcccttgacggagggcgggatgttggcgacgacccagtgcgtccacggcacgatggggccgtccgggtccggggcgtcgacgtcgtgcaccaccagcgccagcgaccgcgtcccgtcgggcaccccgtaccactccaccggcggcgagatgtccttcttcgcgccctgcccctccagcgtgtagtgccgcggcagccgcccctcgtgcgccgcgatcgggtgcgacaccagcctcaggctctcctgcgccatcgcggcacaaacaaactctgttcttgcttgacgaacgcttcgtgtgttcgcttcgcgctcgtggcgtctcttggttgatgcgagaatggatgacgatgacgacgagtgccgcggcgtgcgcggcgcgggggtttaataaacggaggaggagcgattcgagcagcgtggcgcggcggacgtacgcgtggcgagggtggtggagggggtacgtggaggtcggcgccggagtcgtgtcgcgttttccagagacgggggaaaaaggcgcgttggggtcggccgcgtgacgaagtttcgagaggcttacaggtttatcctttaaggcccgtttggttggagggatttttacctgtttagaaggatgaggttattacctgttttgtttggttgggagacatgaaaattttgatgggatggagatggggaattgaggaaggaactctttccttttcaataccttggtaggggtggtaatttggagggaattcctcatttactttacctaaacaaatctcagctaaccgttttcattaatgacctaatctctaactaaactctatgtcaatttccaccacctctgccaaacaagatattgggaataaaaatcaaattcccatcttaatctcaccatcaatttcctcatgtaagctcccaatccccttcacttaagttgccaaacaaaccgtaagcacttgttaatcggcgcagtgtttttctcttctctgtccgtctaggtgtctcccgc

SEQ ID NO: 13212 - DNA, 1501 bp, Oryza sativa
gaaattaattaagccaagcaagtgaagtgacctctctctctctctctctctctctctctctctctgctgcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagctactgccgccgctggatccaccgggcgagctggccacgccgccgccgccgccgctggatctgccggagacgccggccgggtcctccgcggacggcgccgcgtcgtcgtgctccaccgacgacgccgacggcgggaagccggccgccgcgtccaccgaggcagcgtaagtacaataattaatcgcagttaatttgttgcaagagattaatttaatttactcgataaatcgcttgttatttccctccaaattatccaaattatggttctcttagcatactataaaattgaattgaattcgaaacaaggaactaattaatttaaaacttttcaagtctcttctatctccttttcagtttttcctctttttttttgctttgcattttgtttggatggagatgatttaacggtggccaattcgtttacgtggataattaattaattaatttacgcatttctccgaggggcaaaacggtaaaaaaagacgctactagcttctagccaagggagtgtgtttgtgtggttaatcttcttcgaacattgcgccgggattcgcgtgctaaacctccatcgcacatgtgcttataatttcctaattaatttaatgtgttcctcttaaattgaattgtcttgtctttatttacatatatatgctagcttttaggtgagcttatgttcattttttttgctagagataattaagtactggagtagtgtatatttttcagacacgtactacgtactctacatacgtgtatatatatatactctcaatctctcatattatatagcaaaaatctatgagtaccttggaagtgtttatgtttcattaatttatactactatttgccaattaatcgatcggtgcatgcatgtagcctagataatgcgcactagctacaaaaggaagtacgaatacgtacgtacgagtacgtgttggaattaggttgcgaattaaattgcaaaagaggtcgatctggtgagagaacaaacgtaattaattaattaattaagacaggatcatgaatatataggagtattaggcatcgagttaggacattttcattgcaagtcgtcagtaacataatttcttattgcctagctacttctacttgatggcttatagtagtagttttcttttcataacttttaaattctcgatctgaactatatacctttctgacggaaattctctacaatattaattttcatcgtgtggttatgtatgttcaggagcaagtcgctgacgcctgggaaga

SEQ ID NO: 13213 - DNA, 1501 bp, Oryza sativa
ttcgacctgtggtcgcaggtggaggttttcgtacctggcgacacttttggacatcgccgacgtgatggtctcctccgtcgacttggtgctgaggtggacctccttggcgacgcggcggagctcaagcgcgagctctgcgccgctcacgctgcacccaacgatgacgacgacctcgccggcgaaggagtccgggacgcggtacgagtgggaatggagctgtttcctcctccacctatccatcccgtcgacggtcgggagccttggctgcgagtagtgcccgatggccaccacgacggcgtcgaacacctcctctgtctccgcctcgccgtggcgcttgctcctcaccgcccaccgcagcgacccgtcgcgccgcggcggtgccatggcgacgcgcgtgaccgtggtgttgagcctgacggcgtccatgaggccgaacgcgtcgcagaagtccctgatgtacctgaggagctcgccgtggacggggtaccgccgcgcgtcgccgccggcgtcgttggtggggcggaacgggaagtcggagaagcctatggactccctcgggctattgagacggagcgaggcgaacacgctgctgtgcacgccggccatgccgagcgggtcgccggcgtcggtcgccgcgtcgtacagccactgcccgccgacgccgccgcgctgctcgagcaccgtcacgtcgaggccctctcgccgcagctcgcgcgccgccgccagccccgccatcccgccgccgacgacgcacaccttcttccactgcgccggcagcttgccgtcgtcgtggtcggacaccatccttcccttctcgacgagagcaagagagacagttatataagatcctacgtactactccctccgtttctaaatacgtatttgacacatgtttaacacatgtttaactttttaacatgtgtttgacaccgtttaactttttatatgtcgtggtcggagtatttgacaccgttgaccttttaacacatgtttaactgttcaccttatttaaaaacttttgtaaaatatatgtaaaactatatatatacatataagtatatttaacaatgaatcaaatgatagaaaaaaaattaataattatatatttaaaaaagtcaacggcgtcaaatattatttagaaacagaggccaagtaagcgagacacagttgtccgttgcaacgggaaataaaaaaaaaggttagaaattgctctgcgcaaggtatgtgatgctaccccttcatgtcggatgttgtacctctactctagagtttacatcaatgttatccttatctatttgaattgcagaagcctagccacagaactcattcgctgaattttcttctctccgatgtgctacagtttgacaactttgatccaaaacataaactcaaccaagttacggcgtttgagaaggtgatagtgacaatgacgaaagttacttccttaaattctccagtccaataagcagatgttgctccgacaagacaagtctgcatttca

SEQ ID NO: 13214 - DNA, 1409 bp, Oryza sativa
ctatgccgatttagttaataataataattggtactctagtggtaaaataagtgtaagtgtaagtgaagaataatttgatgtaattgttggtgacttggtattgtaaatttgtaatgtttagatgtgtcatgtatcaccaattgctacattatctaaaaaaaattcaacaattgttaagttgataaatgtggagtgtgatttaagtataatgtgatagatcatagtaagaccattatttgtatataactacgtttgatataaaaatcaaagtaactagagtaccagcttctaaatttatgatgtcaccataatctggaatcgtgttttgatacttacaaggttttttttttccttttgcacggggaatattgtctcccttcttccatttttgtatgacgctgatatacaactcaaaaaaatattttaatatttgacgttggtatatacactgaaaatcattttccaaaagtcatttcaaatgttctttcattttgtcaaacatgtcactgtcagaaacttcctaaacaaaaggatgcagggagtacttaaaaactggaacatatgcaaacaatgttttacgcattcatatacgtgccttaacacatactaccatgatgagttgttattctctttgcaaaattcaagcctatttatacttagtttacaactctataaaagatgcaaaactccccttctatgaggaaagttgaaaatttttctgggattttggatcgtatccgttttgtgataagtaaaagttatcacaaagtaaaacagtgtggtagtacatgcataaactgaaatagggatgtctcttatcttctcgagaaacggggctaaacctaatactacacgtacagtacacactaacacggcttaacacatatactctgcaaattcaaggccgcgtgctgtgaaaggttttcatattcccctttcttagaaaacttgaaaaaatttcacggaattttgggttgtattaggtttgtgttttgaaaattggaagtggcaagtcaatcaatcaatagttataaaaaggtaaagattttctgcttccattgctaaaataaacgacgtcgtctcccaagaaaccccaagaagaagccaagaagcacaccggcgccgccgcgccatggtcgccgccaagaccaccaccgtgtccacgcgcctccgccgctgcatgcgcgcgcacgacgagtacgtggtgcgcgtcggcagccaccgccgccgccgccgccgccttctcgccactgtgaccgcgcacccgggcgtggcgcgccggtgggtgcacaccacgctgtggcgccacgcccgccgcctccgctccggcgacgggatcaccgtcggcatgggcgtgcagtggaccccgccgttccgcgcgccggcggcggcggcgcggcggccgtgca

SEQ ID NO: 13215 - DNA, 1501 bp, Oryza sativa
catacatcaaacactaataccaaaacgatttttgtttgcagttgaaagggattttcgcgtgcggatctcacgcccgtctacaacagggtgcctgtgaaaatatgaaacttttcgtgcgggtgacgcaccagcacacgaaaaatcagatttttcgtatgcgggtggcttatgtcgcccacacgcaacaaaaaaaaagacccccaaaaaaataaaataaaaaacataaccctagccgccgccctcctcgtggttgccgctgtcgtcgttgtcgtcgttgtcaccgttggtggcggtgccatcgccaccttccaccgctgcccaccgccggatctgggcgggagaggggcgccgcctctagacccggccgggcgggcgaggggcgccgctgccggtcacggccgcacgcaaggacgcgctagctgccgccgcccgccgccgctcccggccgtcgccagccgcctcgcgcctgttgccccgcgcctgtggagaaagagacgagagagagagataagaaataggataaggacaagtaggtggagaggataagatagaaatttttgaagtagttgagaggaaaaaatacctgaggagggaggggattttcgcgtgcggtactcttaagatgctcgggtcttcacgtaaaaattggcttattttttgcgtgcggacctcttaaggaatcttaaggatccgcacctaaaaataggaggacgatttttccaaactcggtcagttatggaccatccggaatctgacgaggagttcgtccaggaaaatcgtttttatatttgtgaaatgcagacttgtcttgtcggagcaacatctgcttattggactggagaatttaaggaagtaactttcgtcattgtcactatcaccttctcaaacgccgtaacttggttgagtttatgttttggatcaaagttgtcaaactgtagcacatcggagagaagaaaattcagcgaatgagttctgtggctaggcttctgcaattcaaatagataaggataacattgatgtaaactctagagtagaggtacaacatccgacatgaaggggtagcatcacataccttgcgcagagcaatttctaacctttttttttatttcccgttgcaacggacaactgtgtctcgcttacttggcctctgtttctaaataatatttgacgccgttgacttttttaaatatataattattaattttttttctatcatttgattcattgttaaatatacttatatgtatatatatagttttacatatattttacaaaagtttttaaataaggtgaacagttaaacatgtgttaaaaggtcaacggtgtcaaatactccgaccacgacatataaaaagttaaacggtgtcaaacacatgttaaaaagttaaacatgtgttaaacatgtgtcaaatacgtatttagaaacggagggagtagtacgtaggatcttatataactgtctctcttgctctcgtcgagaagggaaggatggtgtccgacc

SEQ ID NO: 13216 - DNA, 1501 bp, Oryza sativa
acctcggccgctgttgatgtgcagccgtgtcggcagcgctttcgataacacgccgtaccggactgccctcccagccgccgccaccgccgccgccgccgccatcccgccggttcgctcctcagttctcaggcgttagggtttgctttttttttttttttttttgaggagcaccgagaccgagagaggagtctgctatattgattttttttagcacggctttacacacgtcagaatctatcacgatctaactatatgtaatattattatttcgtaatttttagatctccgagatcgaaatgtttcagagtttatatacaactctgtcttccgttacatttgtttttcatttatttttccccaataatttaaggagaaaagacgttttaacccttgccatgtatgaattgattacgagctggtttggtttactagcaattcttgccctactaatattttatttttagaaagtgtttaaaccttggtaagttttgtcactactaaatttatataacatatataatttgtaatagcaagggtataaattggaagcaaaccaaaactagcctggtggttacaagaatcttagtagtacgttagatcctgggttcaactctacatggaagcaatttttttaggatttagcactttgttctttcagtggtaggcgacgtgatgttcataggggtatatcctaaatatttgacgccgttaactttttagcaaatgtttgaccgttcgttttattcatttttttgtgaaatatataaaattatatgtatacataaaaatatatttaacaataaatcaaatgataggaaaataattaattattacttaattttttaaaataagacgaatggttaaacatgttttaaaaaaatcaacggcgtcaactatttagggacagagggagtgtggcatagccaataattaagggagtatgtggcatagccaataattggcttaggctaagagctgtttaggctgtgtttagttcacgttaaaattgaaagtttggttaaaattagaacgatgtgacagaaaagttggaaatttatatgtgtaggagagttttgatgtgatgaaaaagttgaaagtttgaagaaaaaaattgtaactaactcggccttaatgattcgtaatagtctactactagtctactatagctctaaaaattgacacatcatctgccatcaatcagattagtcaacaactactaattctatcaaaaattgacacatcgtcttgtttcgatttttgaattcgtcttggtgatttcctcgtcaaacccaacgaaaccaggcacccaagtcccagcccaattttctttaatagcaaggagaaaatgctggagctagcacgattcaagcgtaaatcacacacgcctcattgtttatgccagccagcaatgtactcactcattttttcttgaccactttctgtcttcactttaaaaaatgcagtgtgttgtcgagaataaagacagtggaaacactcaagt

SEQ ID NO: 13217 - DNA, 1501 bp, Oryza sativa
tggagcactccttttcttttgcttgctgttgcccaatttagatgttgtaattgctctcgggctctggcaatactccaacaaacaggttgtgctcctttctaattcaatggaaaagaaatgctttcttttgcttctcacttgagtgtttccactgtctttattctcgacaacacactgcattttttaaagtgaagacagaaagtggtcaagaaaaaatgagtgagtacattgctggctggcataaacaatgaggcgtgtgtgatttacgcttgaatcgtgctagctccagcattttctccttgctattaaagaaaattgggctgggacttgggtgcctggtttcgttgggtttgacgaggaaatcaccaagacgaattcaaaaatcgaaacaagacgatgtgtcaatttttgatagaattagtagttgttgactaatctgattgatggcagatgatgtgtcaatttttagagctatagtagactagtagtagactattacgaatcattaaggccgagttagttacaatttttttcttcaaactttcaactttttcatcacatcaaaactctcctacacatataaatttccaacttttctgtcacatcgttctaattttaaccaaactttcaattttaacgtgaactaaacacagcctaaacagctcttagcctaagccaattattggctatgccacatactcccttaattattggctatgccacactccctctgtccctaaatagttgacgccgttgatttttttaaaacatgtttaaccattcgtcttattttaaaaaattaagtaataattaattattttcctatcatttgatttattgttaaatatatttttatgtatacatataattttatatatttcacaaaaaaatgaataaaacgaacggtcaaacatttgctaaaaagttaacggcgtcaaatatttaggatatacccctatgaacatcacgtcgcctaccactgaaagaacaaagtgctaaatcctaaaaaaattgcttccatgtagagttgaacccaggatctaacgtactactaagattcttgtaaccaccaggctagttttggtttgcttccaatttatacccttgctattacaaattatatatgttatataaatttagtagtgacaaaacttaccaaggtttaaacactttctaaaaataaaatattagtagggcaagaattgctagtaaaccaaaccagctcgtaatcaattcatacatggcaagggttaaaacgtcttttctccttaaattattggggaaaaataaatgaaaaacaaatgtaacggaagacagagttgtatataaactctgaaacatttcgatctcggagatctaaaaattacgaaataataatattacatatagttagatcgtgatagattctgacgtgtgtaaagccgtgctaaaaaaaatcaatatagcagactcctctctcggtctcggtgctcctcaaaaaaaaaaaaaaaaaaagcaaacc

SEQ ID NO: 13218 - DNA, 1501 bp, Oryza sativa
ggaggcgcgggagggtgagctcgccggtgcccgtgcgccaggtggccgagccgttgaggaagaggtagccgaggaagtcgcggtcggaggaggtcggcggcgagtagatgccgacgtagtcgaggccgtccgggtccgggaggcccgaccaccggatcgtgatctcgcggtcggactgggtgagcttcgccggcgtcgcggtgagcgtggtggccgccgccgccgccgcggcctcgccggcggcgaggaggaagaggaggaagagaagcattttgcgggcgagacgacgtgaggagttagcgtaattaatggagagtaggtcactgacgaggtggggcccactgtcagtgggtccagctccaagtggaatatgccttggatgttggaagttggaagggcaaatggatgaagtgaagagataccgaattgaagatggcaaattgtccacttttgcggcttgggctggtttggtttgaagcctaaattagatttactaatatttcgtaatttcaatagtgtttagtgacatgcctaagaaaataagtcatttcaatagtataaacttaggctattttaactttaatccaaacacgattttccttaccaaaattagttatgtcaaaacttgtcaaaatttagcattgacaaaatttggtaaggcctatttaggccacaattcaaaccaactctttaagccacttttgaatgaatgggggtggaattgagtggaattgcttctaatttgaattcaaaggttaggcagcagcagattaaattagtgtaccttctggaaaaaaaaatgctgccatctggcatggtattgcttgtttttttttttaaagtacagtttacttattaaaaatctggaagtggcccaacctctgaagctaaattgaagcccaacaccaaattaaagcccagttagatataaaatcacggcccataattcattggcaacatgcttgtacactttgagcaactttgatatcagcgcttcaaattggaaaaagtccacttagactcccttaattattcacctaatctaattcgtgacccttaactagaaaaccgggtaagacgactctccgaattagtgaaaccagtgcaatttgactcctccggcggtattggagggtggttttgctgacgtggcgctgatgtggcggtgctaacccggttttcatgccacgtggcgcttacgtggtattagagttaaaaaaaatatatatgggactcatatgtcattcaacacaaaattattgtgggacccactgacacgtggggcccacatgtcatccttcatcctttcttcctcctccctctctctcccttctctcttttctctctccattctctctctcccttccagatcggcggtggaggcggccgggggccagagtggcgacggcggcgcgcgggcgagggctagagcggtgacggcggcgtgccggtgacggccgcgccaccgcctatcccgtctccaagccggcccgccgctgct

SEQ ID NO: 13219 - DNA, 1501 bp, Oryza sativa
tgggacggagggagtagtgtgtgtgtgtgtgtgtgtgtgtgtgtgtgtgtgtgtgtgtatatatatatatatatatatatatatatatatatatatatatatatatatatatatatatatatatatataatgcacgtatacgtaatatattctatctcaggtatattcaggtaggatattttgggacggagggagtagtatatatatataatgcacgtatacataatatactctatctcaggtatattcaggtaggttaattatgaacatatacgtactgccagcagtgttgtaccagctatgtacatgtgtttttgtacgtagagtacgtagcatgtctaggttggccgagttggcttcgtgtctgccacgtacgtactttaatttgtaattataccggccacagacagctcaaaaaattaatcactaatttctagctatgcatgggtgtgtttgagaggaggtttaatttgcaatttttttttttgcccattcaatgagttatttaaaaagataacattgtttcaattcccaactggattaactatattgagttctggagtgaaggttacacacatgatacatccattcttattatatttttctgggtttcctcaaagtaatcggtattatcaaatggctaaaatttctccgagttttggctatcattggccaaaaccacacctcatcctaatctcgctatatatgttttgctactaacaattggtcctcatcaatgatttatagagaggaagagcccaagtggacgcctgagtcctgaccagcctgagagctagctctgccgtgcttgcctataatttctcctcaccggacagatgctatggccctcttcttttctccaacaaaaatcagataaaattttggatacttatgacatattttttgaactgctaaacggtgtttcgtgtaaaaaatttctatatgaaagttgctctaaaatatcaaattaatctattttcaagttttgaataattaaaactcaatcaatcatacgttaataccccatcttttttgtaaaatacttaatcttaatctttatcttaatcttcatattagtgtatatgttacctaacctattcattgcttttaccttccgactatggcccgatttagatccatgggtaattttttagccctccctcaaatagcccaaaagtttcaaacatgtgagctatttcagggctatttggaaataacctaccaaaaaaactatcctcctcaaggggtgctaattggggctatttcggatggacccactgaaaaaaagtgccttctctcttcatggaaaagtgcattaaatgctaaatagctctcaaaataacccttggatccaaacaacttaattagggctattttattaaagggttatttccttgtgctaaaaaatagctctcaaaataactcttgactagttctccaaacatgccctgtatatcattgcgccgtcacagagagtggtaaagcctgggcttggccagca

SEQ ID NO: 13220 - DNA, 1501 bp, Oryza sativa
tcatttattaagtctattcgttatttgtgcattagagtaaatggacattgatgcatgcatccatgcacacaagtatttataacccacatgtaatatattgatttgctattggctagaaaatagtggggatggtgcatgcatcgagtttgttgctagagtaaatatagtatgagagagttattagcttttcttggctttggtaaacctattaaatatataaatcgatttggaatggagggagtatatgtatacgtacaacttttttaaggatagtacgtacgtacgtactttcaccccttcttccctcaatttcttatatttttgcacatatttattctcctattatcatactttattagctagaaaaaaaaacttttgtgctgaacaattcaacaactataacatctaaatcataccacaaatttttaatccaccgttgacaataaagtttaactggcctacttaccgataaaattatggttcaggctcatcttgaggagcacgactatatcacgggaatttagagaattctctagccattgattttcattaaattaatggaccaattatttaccaccattagatttataaaaaaaattcctaaccccaaaccgggtccaccatggacatgtacgtattactatatgtatacgtacatttctttaaggatagtacgtacgtacgtacttgcaccccttcttccctcgatttcttatatttttgcacacatttattctcctattatcatactttattagctagaaaaaaaacttttgtgctgaacaattcaacaactataacatctaaatcataccacaaatttttaatccaccgttgacaataaagtttaactggcctacttgccgataaaattatggtccacgctcatcttgaggagcacgactatatcacgggacccatgaataaggcattagcgaaaactccttagcggcaatagtcggcttcacccgatcgtcagaggagtattcatatataagtttaattgttttatccaattaattggtagaagtggtatttttaaatatttatatataaatgtggacatctgtgagacatgggtatttgggtatgatgttgtcggtgacatggggccgggagtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcacagcggggctcacctaaccgcatttatagcgggttggacgagcgcgccacgccgcatttaatgcggcgcagcgcacgcttatccggtccgtgaacagtcgcggcgtgtgaccggtcacagaccggtcagatcgcgggttaggtggcaacaggcggcctgtcacacgcctcgccccgtcccgtcggaa

SEQ ID NO: 13221 - DNA, 1501 bp, Oryza sativa
ccaacgtcaggaacccctgaatttcacaacgagataaactcaaatcactctcctgagtcttgaccaaatcaaagtttttgagttcgtgatgaatttcgtagaaatcatgtttgatcggagccattcaatcaaaaatactacgacacaatgctcacattcatagcttctttcagtgataggttatgtactcatcaacagcgagatatctgtagtgacttcgtcaatctcaatatatgccgacttaatctttcaaaaatattcataaagataaggtgtgcatatatgttcatagatgtgagtatgcgtgtgtcgtaagcatgaaatgttagtgttatgtttagaaataggggaatgctactagacggtatcccgtttgatccggataatatcttagaggtatcacctgatacctgggtatcagccgatacctaccactaccaggtatcaggcgatacctcaaagatattattccatccgaacggggtattagtcgatatctatcaggtatcagataacaatagctcagaggtatcattctgttcgaacaagattccgtcctatagcatttttctcgactgtgtttagatataggggcgtaaagttttggtgtgttatatcggatatacggacacacaattgaagtattaaacgtagactaataataacacaaattatagattccgcttgtaaactgcgagacgaatttattaagcttaattaatttattattagcaaatatttactgtagcacaacattatcagatcaaggagcaattaggcttaaaagactcgtcacataatttacacgcaatctgtataattagttatttttttatttttaatacgttatacacgtgtcaaacattcaatgtgatatctcaatgtgatatgatgaaaaattttgtctggtgatttatacgtgggcgaagaaatatgatccctgatctcgtatcggcatggtcccacgattcctccgacaccgtccgtccgtctgtccaccaccccgaagcgtgacgtgacacgcaccatccacccgccgccccgaccacgtcaccgcgtcggcgctgctacgacccgaaacctgcccagccacacgcacccacagcacacccacgcggccgcagccacgcgctcgcgccgacccgacccaacccgacccgacccgacgcgacgtccaagccgaagcgcgcaggaagccgcggttttcctccctccagcccacgcccaactcatcccatcctcccccctacgcgcgcgcgtccaacctgtccccgcgcgtccaggaatccaatccaaacaatccaccacgcacccacacgtgagacccccccacatccaccgtcctctctcgcaacttctctgaagcccaccacctcctcctcccctatttattcccgcctcctccccaccacatcaaatcatccctctcctcttctcctcctctcaaagatcgcaagaagcaaacaagaacacaacaaatcgatcgatcagtcaacctcac

SEQ ID NO: 13222 - DNA, 1501 bp, Oryza sativa
acacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccgcccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgt

SEQ ID NO: 13223 - DNA, 1501 bp, Oryza sativa
attattttgcttttgcaagccactgcattattgttgctgtttcctctccttcccccttggcatgcttagttctcatctcagtctcaaaaagtgcagattgtgcatgttctcttgctacatcttcctcaccctctcccagagaaatattactcgctacatctgttgcagctaaatactattacctccatattttaatgtatgacgccgttgactttttatccaatgtttgaccattcgtcctattcaaaaaatttatgcaattgccatttattttattgtgactagattcatcatcaaatgttttttaaacatgatataaatattttcatatttgcacaaaaattttgaataaaacgaatggtcaaacgttaatcgaaaagtcaacggcgtcatatattaaaatacggagggagtacatgatttatctactgattgaaaaaaatgagggtacaatgacaatcagtcctctgcgtcctgttccctatcatccttgccattcacgaacatagctctacacaacgtggacgtgtttccttcatcgatgaatcccctccaatctgaaagcatctcgccaatgatttgcctcatggcgcgttaattagtttgcccgggatcatgtcggtaaaatagatgtttggtgtctgcaaaatcatgctggaattcagaccgacatagaaaagctttccattccctacttacgatggtctgctggcttatttgtgataaagaaacacaagaattaatgtaatttgtaattgatcactagtgcggaataggtcatctatgtcgaacgggaactctcatatgtgttggtgagcgacttattcacggattattagtcagtgatgcgaaaattcatctgtgtcgggccaacaggagttatcgatagctgtcatcttaatttgtcgaatctaaataaaagactgtcatcgactagatttgaccagtcaaacaagccatcctataaaccatcacggacatgatactttggcctttccataagattggttggactcatcataagatttagttgggcttcacagacatgatgcgcttcccataagatttggaccatttggttggcctcctcttcgatcaacccggctaaaataactggataaaaataaggaggagaagaagattctaggggctagctacagctgggctcagaagatactgttcttttctctctgagcatgcaatcccttttctcctttgaacatgatacgtttagttccatttaaggcttctcttcttgaactcccagcaaacggtgatgctgtttaaatttatatataaaggctgtgctagctgtttagtttgtttacaactaccaagttatagtctggtggtcatatttccttccatccatacaaaacggattcaactaccaggtaattaagcaggtagtagctagtcaatattgaatccctgtttcacattataacatattttaggttttgaatagattcatgtatataaatccatatatgtgctcttt

SEQ ID NO: 13224 - DNA, 1501 bp, Oryza sativa
gaaattttgcgattctttttttaaagaaatgtactccagatacgtaagatccagccagtttggttaaggtttggcttttccaatcattaagctaaactgaacaaccttcggtattcagaacaaatgtggaattaatttggggcaaaatttttattccaaccaggagttttgtagaacgctcgcctgcaaataagcagaggaaggatggaccgaaaactcactctctcctgattaataagtaaatcatcatgttaaataaattttttgttccatctttgtgcggaagaaatgagcccaaattacttacacacaagcagggagttcttttagaagaaagcacctttatgcgaaaatgactcagaatgcctgccacctgaagtgacaaactgacaatgccattaatattccattgatttgatgacacgatttatagccaaattgtgatggctacggctactcttacatgtaaccactactgggaagggctctttaatccggtttgcaaccccttccctggttgcaaaccaggacgtccaattcgagactaaatatgtcaatctttagtctcggttaaaataaccagaagtaaaatggatctttaattccggttgataacactaaccggaacaaaagatggtaacatcatcggttaggctttttttttcttttttttttgcttgcatttattgccaccctcgaatccccacaaatcatgcataacaaatcatccacgattcataagcccatccataaaatcgcccacaatacacaaatcattcacaaaatcatccacaaatctaaaataatctacaacaaaatttacaaatcattcccaaaaaaaattcacaaaacacgccgccgccaaccgctcggctgtgcgccgcctccgctgcccggcctcccctcccgttggatctggcggaggggaggccgccgcccgcttgtgcctcgtgcgccaccgcggcggcttccgccgggccgctgctcgctatcactatcggaggaggaggggagaggggaaggggaggaggtagaggagagaaaatgaaaggggggaggagaagaggaggggataaggacgaggcagtgcgcgcggttcggggtagggattttagcaattttttttaattttggtctcggttgttataaacaaccggcactaaaaataataggggtctgacatgtttttgaaccgggattaaaaataatatttagccccggttggtgtgttaccaaccaggactaaagattaaaaaaatacccgtgggttttcaaaccgggactaaagatatttttagtcccagtttcgatcatttctctagtagtgaacatactctgtagtactccatctgtctcaaaattaatataaccgtatattttaaatttgaattatatggctgcacttattttgagacggatgaggcagcgatttataactcattctttggacttgtggtggccaagtttaagaactatgtgctattattgtttaaaacatagc

SEQ ID NO: 13225 - DNA, 1217 bp, Oryza sativa
tcctgccgccgccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctaggatcgtcgtcgtcgtcgtcgagctctgatcaccattggcaacaactcgccactaatctagccatcactcccaagtttcatctggtgtgttcgtagttgcaccaaaagttatcttttttgagaggtttcggcccagtagaagaagtcattagcatagtgttaatcgcctaggttaagtaatcaaagagggttaattaggagggtttactcgaattaagatggttgatgcatgatagccatgtcaatccgtgtcgtctcttgtatcaaagcttcagagcttgggctatgaacatgatccatggtggtttttaattaattgccgtcccttttttttttttgtcgtggttgagatgatgcatgcagttcatttcgatctttgaatccatggaattccggtttactgcttgcgttgaatgctgattgcctcaggccttcgagcccatcagttggcctaataagccaaagcaaatatcaaaatgatgtcaaaatattaaaatttgaatttttaacttgattttaaatttgattttaagatattttcaatgtatttttttattgttgacttttaaatcgctacgaataaatatataaaagttttaccatgaattaatttatactctctaataaaatggcttattagaaaatatggacaacctatacgactttttcaatattgttaccactagattatttttggatgattttcttaagtttggggttagacttgtttgatgtacagggcaaaaaccgcgattcaaatctgggccggatcactagtatagattgcggcccagactgcatatggactaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgag

SEQ ID NO: 13226 - DNA, 1501 bp, Oryza sativa
atcatttcccagaaaatcgtcttcttcttttatcctactacgtcaaatttgtcatcacgattacgagtataatacggagtataaagcaacacgaactgctttgtcagacaaacatatagggtccgtttgagggagtttttagtttctcgtcgaatcggaaactacccaaacaatgcattttttattctagattataagaaacggtgtagtatatgctcatagataactattatataaataagctactccctccgtcaaaaaaaagataaaccctggttttcgtgtccaacgtttgactgtccgtcttatttaaaaaaattatggaaaaaaataaaaagataagtcacgcataaagtattaatcatgttttatcatctaacaatgaaaatactaattataaaaaaatttcatataagacggacagtcaaacgttggcacgggaactcacggtttgtcctttttttgggacatagagagtattagattagctatatagatgaattggagctagtagttggctataaaacttgctctaagagcaggtacaatagcagactataagtcagctataaacatattttaagaagattaacagagagaagaacagctggctagctgtagtacggactctaagacacagtgtgtgtatgacatgtgagaccagttattaatagtgtagtatataactattgtatgaatgagctattagattggttatagatgaatttagagctagtagttgactatattattaaacttgctctaagtattcggtacagtatatatactgtagtccacgccatctttttttctacgggatactgtgtatggagcttgctggactgtgcgaggtcgtgacgtaaacaggaagggtcgaaaaggactagacatgcccatcaaaaaaagaaagtaaagtgaaagtgtacgagacgaaacggagcaacaagaagccaccaccaccacgcccgctgtctcgtgggaaccggacacacaagcacccgatattttctcccccaccccgaccccgactccgaccgatgcgttcgcgacccaacccaccaacccattcgtctcgagacggagtcgccgcgatccgatcgatccgggtcagattcgggtgccgccgccgccggcgtcatcgtcgtcttccccaactccggcgacgtgtacgggcgatgaacagtcgcactgcctgcaaaaggcaaagcggacgctacgctaccgggtagtagtacatgtacatactcgaataaagaggacgtgtctttttgtggccaagcagcggtgcggtggaagaagcagagagctgcagcatgtgcaggccaatcctgcaccatcgattccaccaaagatgacaacgactcgccggcgactccgccgccgtcgcactctccgccggtctctgtcacggcaggttccccggcaccatcgccccccgctcagctccacaaaacacatcgatttcgtcactaatgaacagagatattaagatgagtgttat

SEQ ID NO: 13227 - DNA, 1501 bp, Oryza sativa
agtcaccaaaagcaggttttatcatagtctcatctgatgagactgacataactgcgtaaacaaaacgctgatcgaattagtcaaacaaacaaaatcagtgctttaccagtgtagtgtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtttatttaatttacacctcgaattattgaaaacggttcaccttactttataatgctatttcttttttttttctctctgtataagtcaccatttgcacaatattttgttaggactgatagagacgcattttaacttacctttaaacatttttagatttttttttcacttttacatatgtaggaaacaagaagacgggtgtaaacatcgaggttttaaattttaagcaaataattataaaaaaattgaaattatttccaaattttgatgatggcatcatctatggatctaaaaagttttagcttaaaatat
